United States Patent 7,745,391 (HUMAN THROMBOSPONDIN POLYPEPTIDE) - sequence listing, part 213

SEQ ID NO: 528770 - DNA, 425 bp, Homo sapiens
gaattacctgacgataaagcaacaaaagcagtctggaaccatgtgacattaaagacctgaaccccccacctcatcttgggacaattctaagggctacctgagttccacatattatcaaggactcagctgaatcttttgagtcttgctctgttgcctaggctgaagtgaatgagtgttatctcggctcgccacaacctctgccttccaggttcaagcgattctcttgcctcagcctcccgagtagctggaactataggtcatctaggggaaaacagaagtatgaggattgagacttcttctgaaaatcagtgagtgtctctctgcagtggttacagaaatgctctagcatggactccctcctgtaaactggctctgctgctccagcagtgacgaaaagcactcaatttggtttctcttggaagaga

SEQ ID NO: 528771 - DNA, 684 bp, Homo sapiens
tcaaactcctgacctcaggtgatccgcccaccttagcctccaaaagtgctgggattacaggcatgagccactgtatccagcctcatgcactcaggctagggtgaggacagccactgttgccaggccttgactagagatgcaggtgcaaggaccccaacccttcttacacctgcactcagcttcctgccagggtggaggataatggcagtcttggggggaagggttagaggaggagagtggcaggacctgggtgggggaaggttgaaggaacaggtggccaagaactcttctcaggctgagaagtgagaagaagggcagtgagaaggacagcgcttgagctgaaatgctaagtccctggcacatgctcgttatcccatcgtatttcactcacaaaacataaattcagagataacgtaagaatttcaagatagcagctgcagagcactaacccatgagcatggagcccttctgaatgtggggctcagggcaactgcactgactgcaagcccaggaagctagccctgggtctacaacatttcccacgaggaggagaaaatagaaggggactaagaaggaacacagggagcctcaatatgattgaggtaggtatggggccaggggaacagcattgggcagaaccaaatggcagaacctatgaccaggcccagaaggcaagagaacctt

SEQ ID NO: 528772 - DNA, 1110 bp, Homo sapiens
  misc_feature (8)..(9): n is a, c, g, or t
  misc_feature (13)..(13): n is a, c, g, or t
  misc_feature (27)..(28): n is a, c, g, or t
  misc_feature (32)..(32): n is a, c, g, or t
  misc_feature (45)..(45): n is a, c, g, or t
  misc_feature (64)..(64): n is a, c, g, or t
  misc_feature (110)..(110): n is a, c, g, or t
  misc_feature (192)..(192): n is a, c, g, or t
  misc_feature (204)..(204): n is a, c, g, or t
  misc_feature (216)..(216): n is a, c, g, or t
  misc_feature (252)..(252): n is a, c, g, or t
  misc_feature (260)..(260): n is a, c, g, or t
  misc_feature (266)..(266): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (284)..(285): n is a, c, g, or t
  misc_feature (292)..(292): n is a, c, g, or t
  misc_feature (294)..(294): n is a, c, g, or t
  misc_feature (328)..(328): n is a, c, g, or t
gggcgacnntggnggggagcggcgtcnnccangctattctaccgncagcaccttcgtgaagccnattttcagtcgggacatgaacgaggccaagcggagggtgcgcgagntctaccgcgcctggtatcgggaggtgccgaacactgtgcaccaattccagctggacatcactgtgaaaatgggacgggatanagtccgagaaangtttatgaagantgcccatgtcacagaccccaggtggttgatcttctngtcattangggaanagatcganctgnangaanncaattanangtatggaagcagcggacacatgtatgcggttctnccatgaaacagaagcgccaaggccaaaggatttcctatccaaagtttcctactgtttgggccagcgaatccatgacaagtcaattcacgtggaacacggatgcacggttgatacctaatttatagaagcaccaaagttaaaacctcagctatacaattggtcacttttgtgatacgaattccattgactggaaccaagttttcttgcaagacctcctatatttgcctgaagcaagtgggacctttgggtaatacacatcaaccttgttctttcccttttcttgaaatggtggtgtatagctgtgcaacttggattgaacttataatacgtcagaagcccttgcatgtcaagtacacaggaaggaagggagggccattctgtttccaaaacacttgtggaccattgggggcaattgaggcttggaagaacgttgtaagatgtaagtatgttctaatagggccatatgaattagaagactttcagatgtcaagggaacagaaatatgtaaggtttaggcagctcttacctgtacagagatcagggcaaggcagtaaaagggggcatcacggttgagcctgtccaagaattggggatagatattacgttgggttcttgacagaacaaggggcatgtgaacaagggttaggggaccggcgaatgtgtacaaagggacaggaccctataaagaaagttaagtactagtcagagcgacctagatatagaggcgccacaggtaccatttaccagggaaacagaaaatacagcgatggataggacacccg

SEQ ID NO: 528773 - DNA, 734 bp, Homo sapiens
  misc_feature (8)..(9): n is a, c, g, or t
  misc_feature (13)..(13): n is a, c, g, or t
  misc_feature (27)..(28): n is a, c, g, or t
  misc_feature (32)..(32): n is a, c, g, or t
  misc_feature (45)..(45): n is a, c, g, or t
  misc_feature (64)..(64): n is a, c, g, or t
  misc_feature (110)..(110): n is a, c, g, or t
  misc_feature (192)..(192): n is a, c, g, or t
  misc_feature (204)..(204): n is a, c, g, or t
  misc_feature (216)..(216): n is a, c, g, or t
  misc_feature (252)..(252): n is a, c, g, or t
  misc_feature (260)..(260): n is a, c, g, or t
  misc_feature (266)..(266): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (284)..(285): n is a, c, g, or t
  misc_feature (292)..(292): n is a, c, g, or t
  misc_feature (294)..(294): n is a, c, g, or t
  misc_feature (328)..(328): n is a, c, g, or t
gggcgacnntggnggggagcggcgtcnnccangctattctaccgncagcaccttcgtgaagccnattttcagtcgggacatgaacgaggccaagcggagggtgcgcgagntctaccgcgcctggtatcgggaggtgccgaacactgtgcaccaattccagctggacatcactgtgaaaatgggacgggatanagtccgagaaangtttatgaagantgcccatgtcacagaccccaggtggttgatcttctngtcattangggaanagatcganctgnangaanncaattanangtatggaagcagcggacacatgtatgcggttctnccatgaaacagaagcgccaaggccaaaggatttcctatccaagttctatgtgggccacgatccatgaagtcatccaggtggaaagatgcccgtgatactatttagagcacaaataaactcactatacagcgaaaaaaaaaaaataaaaagaaaacaaagtttgtggcgcgcgaccgggccacacagaaagggtttacaaacccatgggtgggggcggcgggcccaaatgggatgagaaactggtacagacgtgtccccaaggaaacccggcgccagaacagggctgggttctccaccaaaaagaccccgggggaacaggggttggaacaaccaagagggactggcacacacggggctcaccagggccgcagcatataccgacgccgaccggggtaggaaacagagg

SEQ ID NO: 528774 - DNA, 430 bp, Homo sapiens
  misc_feature (77)..(78): n is a, c, g, or t
  misc_feature (82)..(82): n is a, c, g, or t
  misc_feature (110)..(110): n is a, c, g, or t
  misc_feature (145)..(145): n is a, c, g, or t
  misc_feature (306)..(306): n is a, c, g, or t
  misc_feature (346)..(346): n is a, c, g, or t
ccgcgcgccccgagccccgcgccatgaagctcgccgccctcctggggatctgcgtggccctgtcctgcagctccgcnncgcntttcttagtgggctcggcaagcctgtgnccagcctgtcgctgcgctggagtcggcggcggagncggcgccgcgaccctggcaaccccctcggcaccctcaacccgctgaagctcctgctgagcagcctgggcatccccgtgaaccacctcatagagggctcccagaagtgtgtggctgagctgggtccccaggccgtgggggccgtcgaagctcgaaacggccntgctgggggccttgacagtgtttggctgagccgaagactnggagcatctacaccttgaggacaagacgctgcccacccgcgaggctggaaaaccccgccgcggggaaggaccgtccatcccctt

SEQ ID NO: 528775 - DNA, 185 bp, Homo sapiens
  misc_feature (6)..(6): n is a, c, g, or t
ccctgngtctccttaacactctgtctgacaagcagagtaacgccaatcggcggttgagtaggaggacactgaccacagcacgaggtcttgctcccagaccgcttcattcttcttagccgcaggacatctctacagctctggttatacttgatgatacttttcttcccgtttggcgttagtttttt

SEQ ID NO: 528776 - DNA, 325 bp, Homo sapiens
ccacatccccgtaccctccagccctggcaactaccatgacactttgtctctatgaatttgattattccaggaatttcatataagtggaatgacacagtatttgtctttttgttactggcttatttcactgagtataatgtcttcaaggtttatctatgtttatagcatgtatcagaatttgcttccctttgaaggctgaataatattccattgtatgtacatagcacatgttgtttatcctttcatctgtcaacgggcactggggtgtttccgctttttggctattgtgaaaaatgctactatgaacacgagtgtatgaatatca

SEQ ID NO: 528777 - DNA, 845 bp, Homo sapiens
  misc_feature (62)..(62): n is a, c, g, or t
  misc_feature (122)..(122): n is a, c, g, or t
  misc_feature (134)..(134): n is a, c, g, or t
  misc_feature (150)..(150): n is a, c, g, or t
  misc_feature (153)..(153): n is a, c, g, or t
  misc_feature (169)..(169): n is a, c, g, or t
  misc_feature (190)..(190): n is a, c, g, or t
  misc_feature (194)..(194): n is a, c, g, or t
  misc_feature (196)..(196): n is a, c, g, or t
  misc_feature (206)..(207): n is a, c, g, or t
  misc_feature (226)..(226): n is a, c, g, or t
  misc_feature (231)..(231): n is a, c, g, or t
  misc_feature (235)..(235): n is a, c, g, or t
  misc_feature (258)..(258): n is a, c, g, or t
  misc_feature (263)..(263): n is a, c, g, or t
  misc_feature (275)..(275): n is a, c, g, or t
  misc_feature (278)..(278): n is a, c, g, or t
  misc_feature (285)..(285): n is a, c, g, or t
  misc_feature (293)..(294): n is a, c, g, or t
  misc_feature (296)..(296): n is a, c, g, or t
  misc_feature (299)..(300): n is a, c, g, or t
  misc_feature (325)..(325): n is a, c, g, or t
  misc_feature (338)..(338): n is a, c, g, or t
  misc_feature (341)..(341): n is a, c, g, or t
  misc_feature (352)..(352): n is a, c, g, or t
  misc_feature (370)..(370): n is a, c, g, or t
  misc_feature (373)..(374): n is a, c, g, or t
  misc_feature (389)..(389): n is a, c, g, or t
  misc_feature (397)..(397): n is a, c, g, or t
  misc_feature (462)..(462): n is a, c, g, or t
  misc_feature (500)..(500): n is a, c, g, or t
  misc_feature (507)..(507): n is a, c, g, or t
  misc_feature (509)..(509): n is a, c, g, or t
  misc_feature (511)..(511): n is a, c, g, or t
  misc_feature (513)..(516): n is a, c, g, or t
  misc_feature (533)..(533): n is a, c, g, or t
  misc_feature (536)..(536): n is a, c, g, or t
  misc_feature (565)..(565): n is a, c, g, or t
  misc_feature (591)..(592): n is a, c, g, or t
  misc_feature (597)..(597): n is a, c, g, or t
  misc_feature (601)..(601): n is a, c, g, or t
  misc_feature (608)..(608): n is a, c, g, or t
  misc_feature (612)..(613): n is a, c, g, or t
  misc_feature (621)..(621): n is a, c, g, or t
  misc_feature (623)..(623): n is a, c, g, or t
  misc_feature (627)..(627): n is a, c, g, or t
  misc_feature (631)..(631): n is a, c, g, or t
  misc_feature (641)..(641): n is a, c, g, or t
  misc_feature (647)..(647): n is a, c, g, or t
  misc_feature (671)..(672): n is a, c, g, or t
  misc_feature (674)..(674): n is a, c, g, or t
  misc_feature (682)..(683): n is a, c, g, or t
  misc_feature (713)..(713): n is a, c, g, or t
  misc_feature (715)..(715): n is a, c, g, or t
  misc_feature (729)..(729): n is a, c, g, or t
  misc_feature (732)..(732): n is a, c, g, or t
  misc_feature (734)..(735): n is a, c, g, or t
  misc_feature (738)..(738): n is a, c, g, or t
  misc_feature (740)..(740): n is a, c, g, or t
  misc_feature (767)..(767): n is a, c, g, or t
  misc_feature (773)..(773): n is a, c, g, or t
  misc_feature (845)..(845): n is a, c, g, or t
agactgggctgttcagatccagtagtggatccggtgtgcagccagatggacccctttacccnctgtcagcaggtaaactgctgtacacccaggagactgacagtggtgataaggaaatggcngaagctatttcngaacttcgtttgagcngcnctgtaactggggatcnagattttgacagagaaaatcngccncnaaatatttcnnataatttatgttttttagnggggnagcntttgaggtcttatagtccccccnatgcntttccgaccccntcnccgagcnatataacnncntcnnaagaatgttccattccgtcccgtcnccccccgtttacntcnatggaattacnaatggggaataataagcntcnntgtgagaattgtacnaaaaaccnaccgaagtacccagaagaaacccgttttgccgaaaagaaagtagaaggagtttatactaatgccnggaagcaattgctcctttctgctagattccccatagtnctaaatnananannnnaaaaagattttcatccnggntgggcttggagtctctcgtaaaagtaaancagacactgtacgatttttccccccnntgccncccntttagcncccnnctctgtcncncgcnaccntgtaaagaantgcaangtgtggggagataaaagtttctcnncnggctctcnnttggcaatagtgggaacataagtgggctcncntgagagaagggccnccncnnccncnttatgtgaaaagtgagaacaccccccncgaaanttatcgggaacataacactaaaaagaaaaatgtgcctggtttgaaagcggctgatagtgaatcagcaggccn

SEQ ID NO: 528778 - DNA, 252 bp, Homo sapiens
agcccctgtgtcacagttgttaaatgttgtggtgtcgctccattggacctctttttccagctttccaccgttgcctgacgatcgatcttacaaaccagacgttagctgcttagatggccctggggaagcgtggacaagggacatgggagtgatctctatgatcatgcaccttcctgaacggaaccctagatacctgctgagtgcgaccggtcctggagtcctcagacccaccctatctactcttatctggcg

SEQ ID NO: 528779 - DNA, 101 bp, Homo sapiens
  misc_feature (22)..(22): n is a, c, g, or t
  misc_feature (97)..(97): n is a, c, g, or t
aatataaagaggaaatggctcntcaccttcataataccaagacctgctcaatttaagatggcccttgacattgaaatcgtacctacagaaagcttgnaagg

SEQ ID NO: 528780 - DNA, 298 bp, Homo sapiens
cgggcgcagcggactagcatcctctcacctcatcctcctgagtatcgggactacaggcatgcaccacggcacctggctcgcaaattattatttgcatgtaggtatccagtgtcccagcaccattggttgaaaatatgattccttcctcattttctggatcagcctaaccagaagtttatgaattttattaatgatttcaagcaatcatcctttcatatcaccaattatggtttttgtttttaatttgcatggatttctgcttttatctattatgtcctccatttggctggttccgctg

SEQ ID NO: 528781 - DNA, 136 bp, Homo sapiens
tgtttttttccaggtaggtggttagaaaaaagttattagtagtttgctttagagaaggaaatagccttacggtgggtggctttgaggtaagagtcatgtgcagtagtaagatgagtttgagcagatctggctttgc

SEQ ID NO: 528782 - DNA, 924 bp, Homo sapiens
tgtttttaaacgacgccagtttattttacgtcttatctatcacgcctgggttctcgattttcgtcactagggctccctccacctcagtgggtccgttaatggactcctgttcggggtatgttcccccagcctggaagaggattttgacagtttatgctatatcaacagcagtgaatgaagaggaggaggatgacgatgtagaagaagtagaacgaataggattaacgagtatagttaggatgatatacttttgtattgtagaggaatagagcgattaataggaatattctgaagaggaagattagaggagaatgaagagcttgtaggaagaatttgaggaagaagacgctgagtctcgaggaagaagcatgaagaggaggatgaggaggaggacataagtatctggaagagctggaagacttggagttgggcacacgcaggaggggaggtagaagaaggtccacctccacccccaaccctgcctccagctctgcctccccccgagtctcccccaaaggtgcagccagaaccgcgaacccgaacccgggctgcttttggaacgtggaggagccagggacggaggaggagcgtggggcagaaacagctcctacctggccctgaagcgctcccctcccagggagaggtggagagggaagggacaagcctacggcagggcccctccccaggagtttgtgaagaagacccctctgctccccaccaaccctgttggaagaggagactgaggatgggagcgacgagggcagcccccaccagagacacctgcagaagaagagatggagacagagacagagcgcgaagctctaccaggaaaaggcgcaggatgacacagctgccatgctgaccaaacttcatacgagtgtccccctgatgatgagaagccataatcccacagagccgactcat

SEQ ID NO: 528783 - DNA, 956 bp, Homo sapiens
ttttccttttccttgcctaattgttctcatacaaatttttagtaatatgttaagatagaagctgtaggcctgcctccaggtccatggctgggtgtgtctccttgcaggtctcttgataggaaggaccacttgtgtactgtagctgagaggagtttgagacaggttgcagaactgcttcagcatccttagtaagaccaagcttagtgtgccatgttttatctgcagccatgtctatgggctcttgagttggccacctgggtgaggccctgctttttccaaatatccctacttgatctttggctccactgaggtttcacaaccctagccaaaggaagcacctttctacttgtgttttctgtgagtttactacttaagatatcttacctaagtggaatcatacactgtcactttattagtatcttatttcacttaaaataatggctttaagatttatccttattgtagcatctgacaagatattttcatttgaagctaaggaatatttcattgtatgtataagccacatctttttaaatcattcatctattgaagggtgtttgagttttttcactttttggcttttgtaagtgatatagtttggatctgggtccccattcaaatctcatgtcaagttgcagtccctagtgttggaggtgggcctggtgggaggtgatgggatggtagggttggcttctcatgaatggttaacaccatcccctttggtactgtctttggcatagtgagtttgttctcctgagatctcattttttaaaagcatgtggcacctctcctttcactgtctcttgctcctgctcccactatgtgaggtgactcactctttgtttgctttctaccataattggaagctttttgaggcctctctagaaacagaagctgctatgcttcctgtacagcctgcagaaccacgagccaattaaacctttttctaaaaaacc

SEQ ID NO: 528784 - DNA, 173 bp, Homo sapiens
accatgacaagggtgctatttcaatgtgggcggctcaagcttagcgtgactaagtactgacactcacaatgccccaatacccggcttcaaacattctttctcatggctcccatctcaagcaatacccatgttatatactcagcatcctggatagcgacccaccctgcctcgtg

SEQ ID NO: 528785 - DNA, 1837 bp, Homo sapiens
taaagaacaggcaccgaagtacgcatttagcgaaatcttacgcgcacgtattactaaagcaatcacacatgtgttaggcgcattccttcccagtcatcgccgccattatttatgtccaatgggctcactatttggtcagccccattcatttattattcatcatttctcattctatatgcttcaaaaacagcagtactttccagtcaattgcacacatcaagcacacatcattattccattatcatattattgcacagcacacagtcatcaccagggcagtctcgtcatgtcacgtgctagtcatatatgtcaagtggtcatccagcagcataaacaaaacattcagtccaggcatgtgacagcacagtatataccacactacacctacgatataccagaccaattcacaacaaaatttacttgccagagtacgcgcaaaataccaagaagacggttcacaatagtagttcacggggaccagcagacgtggaacgctgactgggcacgacgactagacaattcacaggggaccaaacatcgtagacgacagaggacacatccacacaccgagcacacatcaccgtaaaattcaagacccggacacacgtagatgactagcagacctatggacaccatgcacacaagccgactacaaggaccccgataacgaaacccctacaatttcccaagcacggaccggtacgagaaaaagagcggacacagcaggacagcattccacgaccacaccacaacgtcgcaacacaaggagggatagggacctaacgccggtcaccacgcagtatgtcaacatataccacactcactcactacgcatccgacgacgacatgaaccagccgacgatcacaggcggcaacacacacagtcgcacaggcgccctatggatcaccgcgcaacacatccacaaagctcacaaacgaaaaacagaatcatactacacgcccaaactacccccccagatacactcggcgttcacacacaacacacacacccactggggaggcgcatccggtccacagacacgccggctagcatcaccacacacaggcacacacagggctgcgaacgaaggcgctaacttgcacgatgcgacaacaacgatgtcaccgaagtcagggacacatagcgacacgacactggtcacacagcacacaacgcgagtacacgaacaaccgcagcctcacgtgaagcgagagaaagtcagacccaacgtgccatcataacgaacgccgcatggagagcaccacgcgcgatactgttcacgcaagaacaacaacgagtcaaggcagcaggcacagccaatgggaggcccacaacacgatgggaaacacacactcaggacggaccaaccaccgagtacgtccacaagcggagaacacacgcgcccagagacgcatcacagcgaaccatctagccgcacggaatacaagagagattagaagtaactgccgaagacacagacgacacatactgaccagacagtgcaaccaagcgggcacacagcacaccaactgtcagcgcagaggccacagagcagtaagccatacacaggcaggtagcggacacagatccaacagcgaagagagtaagtcaacacagacgcagacaccaacggcccaagcatagatgcaaccgagtgactgagaaaccagccaacaaggagagacgcgccacctaacgaaccgacataggcggcagactcacacctgtcagcacaacgcacaagcacctcgcgtagacacagcaccagagccacgagatgacgagcaccaacaacaccctcagtgccaccaagcacacgagcacaagccaggagac

SEQ ID NO: 528786 - DNA, 974 bp, Homo sapiens
cctgttgctgcgcgaggcttaaggtttctgtcatgcaagatcgtcaattcagtttcgaattcttcccgcccaagacggcggaaggcgccgagaagctgcgcaacacgcgcgcgcagctttcgccgctcaagccgcgcttcatctccgtgacgttcggcgcgggcggcaccacgcaacagggcacgctcgacgccgtggtggaaatccagcgcgaaggcatcgaggcggcgccgcacctgtcgtgcgtggggtcgtcgcgcgagagcatccgcggcattctcaatacgtatcgcgaacacggcatccgccgcatcgtcgcgctgcgcggcgacatgccctctggcatgggcgagatcggtgaattccgcttcgccaacgagctggtcgagttcatccgccaggaaaccggcgaggcattccacatcgaggtggcggcgtatccggaataccacccgcagtcgcgctccgcccggcacgatctcgaaaacttcgcccgcaaggtgaaggccggtgcggactccgccatcacgcaatacttcttcaacgccgacgcgtatttccagtttgtcgacgacgcacgcaagctcggcgtggacgtgcccatcgtgcccggcatcatgccgatcacgaattcgtcgcagctgatgcgctttccgagatgtgcggtgcggaagtgccgcgctggatcgccaagcgccttgaaggcttggcgacgaccgtgaatcgatccgcgcgtcggctggacgtggtgacggccatgtgcgaccgctgctgcaggcgggcgccgggctgctttctaccgctccattgccggccgctctacgcgagcgatctggcagcggtctgggcttgtaaacgctgattgcggcaaggcgcagggggatcgtcctgggcggccgaccccgatccgctgattcgcctgggtgcttgacgaacctcccggtcgttcgcgccaaatcttggaaatccgggcc

SEQ ID NO: 528787 - DNA, 129 bp, Homo sapiens
gcagccaacaggatcaacatagagagagactatggcttggggtgagaatgtactgattacaaggtccacagacaattaagacacagaaacagatgggaagagggtgtccaacatcctgttggctggcga

SEQ ID NO: 528788 - DNA, 436 bp, Homo sapiens
atgtgtgcccatactatggaactacttatcataccatgaggaatgaaataattacatttgcagcaacctggaaggaattggagaccattattctaagtgaagtaactcaggaatggaaaaccaaacatcgtttgttctcactcctgagtgggagctaagctatgaggatgcaaagacataaagaatgatacagtggatttggaggactcagggaaaagggtgggagagggtgagggataaaagactacccattgggtacagtgtacactacttgggtgatgggcgcaccagaatctcagaaatcaccgctaaagaacttactcatgtaaccaaacaccacctgttcccctaaaacctatggaaataaataaatcaaaatttaaaatttataagaggaatagtatactacttgggcacacattatggagggggatcc

SEQ ID NO: 528789 - DNA, 587 bp, Homo sapiens
agcggagggtcggcctggggaaagtgaaagtttggctgaggtcctactcggcgcctgagcgcgtctccgcatcccgtggacagctggtgcggccctcggccggggcgcccagtccttgcacaggccagcgagcgacctgagcgagcgagggcggccgagtgcgcccggctgggacccactgcccgtacagaacggcagggcgccgacgggacggctggcaccgtcccactgacatagggcgtggggaggtccctgggtgcttgtgtcggttacctagtggtccatggagaagcagagaggtatcaaccggaggaggtgtcggagtcctgcacagcgcaccgatggattggagagtggacgactcttgcaagttctctagctaggcggctggtgtgacggtacgcagaaggcgagaccctacagtgccaacgattacatcgctggagtttgggagacgcaacggagaccagatgaaagaatgcccaggtgttgctgcaccctagaagaagagcatttctccctggtcgcaaggcgaacatggtgggagagacggcccatggcagcttgccagagcattaaaggaccca

SEQ ID NO: 528790 - DNA, 340 bp, Homo sapiens
gcgaagaagtggcgtagctcgtctgtgtgtcctcgtgtctggaagatgatatagaagtgctgttccacccaagggggtgagggttacccatggcaagcatgcagacgaccagcccaccccgggctctgcgtgcatgtccatcttggtcccttcatctcaatatcaccagctctgcagttgctccaaacttttgggtttaaccggaccctagtattgtatgagcctcatcttgatcctaagacgccccctctccctaacactcccgatttttctcacctctggaggacgtcccatcctctgataccataggtctcctctgatctctgcattactcctcctc

SEQ ID NO: 528791 - DNA, 1101 bp, Homo sapiens
ctgaagcctgaggaggtagtcatcaacctagaatatgaatctagatattaaaccttatttgtacaagctacctttagtaactaggcacatttcaccagatgtatcaacacacgttcaggtactgcagcagcatcattcatttcaactaagcacatatgttgaagtgttgagccagcaatatttaacacaattcgtgagggcacaacacattagatccataatgcacacatgcgtcacagttcaagagacgtagtttctggtcatgttcaggagatctacagaatgatatcagtcaaggatgaggagtgactctcgagaatgtacgagacctatgacgctttacctcccaagaccaggatggtagataggtaaagtcaagcatcttagtgtttgacgatgcgccacattataaaagtagaatccaggggaatattggatgatgcaaatgtaagtagatctcagaccagtgctcacttagggaaagaccatggattacaccactaagttcgatcatgctacttacctcaaaaaacttaagacctcgataatagagcagtatacattgaaggaacaccttagaatgaacgagactcccaaaggttagtcagtaagagagacgatagatgtacatctacaaagggaagaattagcaagaaactcataggtacttctgaaacagaacatttacaaggacactgattagaaagaaatacaagcactgaaaactgatcacatgaacaacatgggccaaccgacagacaccacgcacacacagcacaagacacaagccccaaagataacagcgaagacaagacaccagcacggaacaagagaacacaacacagaaatcagaaagaaacaagagcaaaaagcaagacgccacccaacagaaagagaaccaagggcactagcaagacagaccacgaaacaccgaaaaatatagacacaaaaaacaaaacaaaacaaacgcaaacaacaacacacggtaacaaagaaaaatagaagaacaacacagcaatcacacaacacaacacaaccaacaaaaacgacaaaagaagcacaaaacaacgaaagcacaaacgacatatacgaaaaaaaaaa

SEQ ID NO: 528792 - DNA, 151 bp, Homo sapiens
agctgtgtcatgtatgtgctgcgcatgagtgtgtgtgctgtgtgtgcatgtgtgtgctgtgtgttcgtgtgtgctgtgttcatgtgtgctgtgcatgcgtgtgtgctgtgtgcatgtgtgtgctgtgtgctgtgttcatgtgtgtgctgtg

SEQ ID NO: 528793 - DNA, 310 bp, Homo sapiens
ccccactccaccagttcccggttggcagccggagtttcctttttaccgcccctgtcaccccgtaggccacatggatagcacaggtgtcagacaagattccttcagatttcgagttgcccaccgggtggttttggtggtggtggtggtggttttctttttctttttttttttgaagacagccataaccccaggacatatttctgtagttttttatagtttttcatacattcataccataactttgttttttccttttttttgtttttaacttttaaaacaaaaataaacgatgataattttttctggtgga

SEQ ID NO: 528794 - DNA, 617 bp, Homo sapiens
gtcagtgatattgatctagcaacaggtaatatagctctttctttattatctgtacgctgtgccccatacgatcgtcctgatatgtggtagagtaacacctatatacgtgtgcttgcgtcctaatttaaaatactgtattcgcatgtcagatataatgtacataacgagttataacctcaaagttgctggagtcagggccccctgtgcttgcgacactaatacagagtgtgttcgcacttagccatgggctgggctcaagaacctgatacctgggttgatgtggattacctagaacccttcctgcagtattcatacagtgtatatattcttgttgttgtcattgcgtgtgtgtggttatgtgctgtgttcttaatgagaatcttgttttaaaatgtaactttctaacggttctaagcaccaacaatgttctcatattgtacgtggagtatatattatacaatagagaggtaccttaaacattcacacgtgcttatacttatacactcataagtactcctgagtacaagtggtcacctcccatagtattcatttggcttcgctgtcaaaaagtcattattctgtgcagtcgtggccctgggaaggggacaatcacgaag

SEQ ID NO: 528795 - DNA, 269 bp, Homo sapiens
actggtactaagagatggtcctgggctgaaagatggttatggggtgggcagagatggtgagctgatttggtggtttttatccttgatagaaaccagcaggtgtggccaggcgcagtggcgtcacgcctgcaatcccagcactttgggaggccgaggcgggtggatcacgaggtcaggagatcgagaccatcctggctaacatggtgaaacccagcctctacaacaaatataaaaaattagccgggcgtggtggcgggcacctgtagttg

SEQ ID NO: 528796 - DNA, 634 bp, Homo sapiens
agtcctctaaacccttagttattacgctcaatgcaagcactctccccccgaccaatcaacaccaaaatcgcggcagattgaatgaaatgaaatcgccagccccactaaaccacctaccacgaccacccacgtaagatacaccccccgcagcccgaccaacctgcctgccaataaacccccaactcaaacccggccctcaacacgccgacacaatcacctccaccagggaataacctacagaccccctaaaagaaactacgaactaatgctataatacaccttaaaaaacaccttagaagtcacctcagaagacccgctcctggacttcgttgacaggaaatacaccccggatcactacttcaacgaaagagacaaggcaagattcaaacactcgaccaaaggcttccaccaattctgcggatacgaccccttcaaatatcactaggaaaaaaaacgagatgacccaacttagatcggcccgactctcacagcggccggccggaacatagcgcaaaaaaggacaaagtccatcgcccgggccgtcatccgcccagagaccattccgaaaacaaaagcggaagcgacatgcccgtgatgaaaggccctgacatccggaaaaacttctagagcccat

SEQ ID NO: 528797 - DNA, 914 bp, Homo sapiens
ttaacggctagtggaggctagtggtgatccgttgagatgatgggagagtgtgctctttaacttcggagagagatgcgctctcgtgtatctcgtcagcggcctgccataaggtctgcatggtgcctgttgtctgggtttgggggtctgagtaccatagcggggcatgcgggagtcgtggttgacggaaaggagtatccccaaggggaggcgccatgtgtaagtacgccacgcaggagccatcggaggaggcgtaacgtgacgagacacgcctagaaagaacgcccgggctctggtagtagtggacagcgaaggagcgcgtgattgagtagatctgtcagaaggaaggcattcctcctacagatggcataggctagagtcagccttggcttgatgcccgaggaattcatctttctagagttgggtgtccaacctccggcttcgagaacccctctggtacgataccagcttgctggaatgaacctgtccagcaagcaatggatggaaccatcgtgctggtgggtgttcaggggaagcaggtattcccggatgggtcgccctctcaacaaaacacaggccctttgctacccggggacagtgcctacaggttacgttgtctgcagaaactctacgtcgaaaatcttgcaaagagagagagagctgagtaaggaacagctagtagcatttcttgagaacgtattagaaacttcgtgggaaactaacgggagaaccttcttcacggtgccttggaacactatgttaattgcctggatctggtaaacaagaggctaccttatggctgctccagcatggagtgtgttttcatcctgttttgaacacctaagcagaatacgaaaatggtgggtaacaggtattggtgaagaagaccggaacttcggaagatggttaactccccc

SEQ ID NO: 528798 - DNA, 733 bp, Homo sapiens
cgcaggttgcaatctgtggtgccgctgggaggatcgggaaccgtgacgtgaagtcttgacgcgcaggtctccatatgaccatttgcatatcagattatacgtagctttccgacctcggatgtaggaatcagagacaatccactgaatgggacaaggccgtagttcaaaggtccagaaattgcttcacttgagtggagattgtcataactggttgactcggggtggttcacgagagtcacgctacgcgctatggctagcccatgtatttctacctgcaggttctctcttgctcgtggagtggtacagacagtgtaggttccgggcctacttggacggaaagcggcctgcacccagagaatgggtggttcctctcacgattgaagtagtcaatactacagtagatcacacaccaggaatccggggaatttttaaatttcgggtggtggtctcaccaagaaaagcctttatcagtaagattccataattctaaattttaatttttaaacccacgattaatgttacgtcaacattgcggtcttggtaacggtataacagcggggtaatctccctgatttcggggggtccagtcttggccaatagaaagttttgtgatggattgggcaaaaaataaaaaacccccggggaaacaaagcggttttggggggcacaccccccctggagaagggttggaaaccttgggttggcaaggggccccaggacgagaactggtaac

SEQ ID NO: 528799 - DNA, 274 bp, Homo sapiens
tcactgtttatgctaggccggtcttgaactcctgggctcaagtgattctaccacctatgactcctaaatagtaggcgatcacaggtgtgagacagatgcacctggccgaaatagctcaactatctgaacaaacaaatctgaatctatctgtcattcttagcgtcactggtctggctaacagaattaacatacaaggttgccacacctagttctgaccagctttatgtctttcattccagtattccaccaaagtatgtttacctgcaaatgtagg

SEQ ID NO: 528800 - DNA, 345 bp, Homo sapiens
ataaacaggatcaaattagaaaagaagaattcaaattttccctcttcatacatcatacttttacatagaacctaaagaccagcaaaaaactcttaggactgataaacaaattcagtaaatttgcctgaaacagaatcacatacaaaatttatttgcatttttgtaaaccaataatgaaaatcatcaagaaagcaatcacatttacaatatctacacaacaaaataaaatactggaaataaatttaaccaaggagatgaaagatctctacaacagaaactacaaaacactgatgaaaaggaactgaagcgaatacacacaaaaaatggacaaacatcccatactca

SEQ ID NO: 528801 - DNA, 252 bp, Homo sapiens
  misc_feature (5)..(5): n is a, c, g, or t
tttancttgattggaggagggggatgatctaaaacactctatacgccggcttctatagacttgaggttaatcgtgtgaccgacggtggctggcacgacattgaccaaccctggggttcgtatagcttcattaaactttcgtttattgctaaaggctaatcactgctgttacccgtgagggtgtggctaggctaagcgttttgagctgcatagctgcgtgcttgatgcttgtcccttttgaatcagtttcatg

SEQ ID NO: 528802 - DNA, 113 bp, Homo sapiens
accaattgatatgaacccttaacatgatctaacttttttattagacagttccattctgttgcccaggctagagtgcagtggcacgatcacagttcactgcagactcaaatttc

SEQ ID NO: 528803 - DNA, 301 bp, Homo sapiens
attctttttttggggggaggggtatttgcttttttatcttccgggcaaaatttcccttttatttttttgaggggttatgttaacttccctctatcccgcttataaaaaaattttcccccaaaaaaacttgttggcttgatgttttatcccttttttaaggaagggtgaaaaatccctattggagcccctgtttttaatgtaaaggttaaacttgaaaaaaaatttttaatcccggggccaaaattcattttttaaccccatgggttagaaaattataaaaaataaaataattttagaaaga

SEQ ID NO: 528804 - DNA, 321 bp, Homo sapiens
  misc_feature (139)..(139): n is a, c, g, or t
  misc_feature (288)..(288): n is a, c, g, or t
  misc_feature (316)..(316): n is a, c, g, or t
  misc_feature (318)..(318): n is a, c, g, or t
ggcgcacttctggagcgccccaagctttctaacgccatggccaggacgctgcaccggcacattatgatggagcgggagcgcaagcggcaggaggaagaagaggtggataagatgatggaacagaagcgcgcctgggtgnagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaangtgcgcctgggtgcagaagtgcgcctgntngaa

SEQ ID NO: 528805 - DNA, 245 bp, Homo sapiens
  misc_feature (212)..(212): n is a, c, g, or t
  misc_feature (240)..(240): n is a, c, g, or t
  misc_feature (242)..(242): n is a, c, g, or t
gaaatctatctgctctgtgacaatgtcctcctttgctttgtcaatcatgcttgcgcgttcaagagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaangtgcgcctgggtgcagaagtgcgcctgntngaa

SEQ ID NO: 528806 - DNA, 341 bp, Homo sapiens
  misc_feature (308)..(308): n is a, c, g, or t
  misc_feature (336)..(336): n is a, c, g, or t
  misc_feature (338)..(338): n is a, c, g, or t
tgagctcggcacctttgcaccaggcgcacttctaagctgagaacactgtggaaatcaaccttccaacccctgcgtggttgtgtgtatgtgtcctgtgcatgagaagtgcgcctgggtgctgttcctgcaacccaccagtgatgggtgaagccaccccgaagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaangtgcgcctgggtgcagaagtgcgcctgntngaa

SEQ ID NO: 528807 - DNA, 310 bp, Homo sapiens
  misc_feature (277)..(277): n is a, c, g, or t
  misc_feature (305)..(305): n is a, c, g, or t
  misc_feature (307)..(307): n is a, c, g, or t
tatgtcgtttctctgccaacgcacattctctgagacccatgtcatcgccaacacaactatgcgcagatcccagaacaagattgtaagttttgcctaaattccacgtggagtccagcagggtcccatccagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaangtgcgcctgggtgcagaagtgcgcctgntngaa

SEQ ID NO: 528808 - DNA, 234 bp, Homo sapiens
  misc_feature (201)..(201): n is a, c, g, or t
  misc_feature (229)..(229): n is a, c, g, or t
  misc_feature (231)..(231): n is a, c, g, or t
actggtccggttgtacatggatgcgccctctacattgcagaggcctgtgtgcagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaagtgcgcctgggtgcagaangtgcgcctgggtgcagaagtgcgcctgntngaa

SEQ ID NO: 528809 - DNA, 403 bp, Homo sapiens
cccccaaaatgaatgtaaaggcaaagaacaggaaatgattcttagggaagctgcttttacctcttcagcttcatcttcttgatcccattcctatctgtcagttccttctcggcatatcttattggccatgttttcgaaacttaagttatagaaaaacagaaaaagtttatttttgctagcaagaataaattctttataaagaaattttaaaaattcactcttagcatgaagtgagataaaaaacatctctgggtttattatcagggaaaaaaaagcattctggaaactgctttaatgagaactttacataggtgctgttaggctcccagtgttacaaatcaattaaaggctttttccaggaggcagaagaagattcctagggaacaccagcagtcttgaagaa

SEQ ID NO: 528810 - DNA, 181 bp, Homo sapiens
agtgtgcaggtgagtgcgtaagtacaatatagtgatatctgaaatctaacagcatctccaaggttaagaaaaatccttatggcactcacttggcaagatatcccacaggcatgctcttaatgggagaaaaacaaaggccttagatccaaatattgtaaaggtaatttcttaaggttttttg

SEQ ID NO: 528811 - DNA, 518 bp, Homo sapiens
gcagttcggttttgctttcactgtgacaaagcagcatcaaattcaatgcaatgtctcacaatagctgcgctctccttcttccaagcacagagattctctctctacgccacaaagccactgccatgggatggggacaggtggcatcagcaactcaagactgtcttccctaccctcttcattgcctctttcaacagtatgaagttaaaatcaggtactgtgagtgctcatccaattgttggttcttatgatgaaggtgcttttttgtgtgtagatagttgttaaattttatgttcctgtgggggatggggagatggagccttctattcagccatcttgctccacctcctacaacggcagtccccaaccccctggccatggactggtactggtctgtggcctgttaggaaccacgctgcacagcaggaggtgagcagcagacaagcaagtgaagcttcatctgtatttacagccactacccatttctcattaccgcctgagctgcacctcccatcatatca

SEQ ID NO: 528812 - DNA, 900 bp, Homo sapiens
tctgctacaaccagacaagtaataacatgttagatacacaataatataatgtataaacagcgtattctcactcactctattacgtcgacgggttaatactccgtatcatacacgtatttttgttttatttctccaacctaacttgttcgctacgccacccctttggtctatgcaattataggttattaccatctcgccgtgttatattctgccacaatcggcacaaattgtgccaaaataggcatcacataggccccacttatgaagaacaagcttttcccctggggttactaccctatcgttgttcctgcgcgcccctaatttctaagaaggggtattgtgtgtccgatgacacaaccagagagtcttttttataagggcgccccccctctgcaatggttgataatcatcctccagaattctgtgggtctcctcgtacacctcctccccgtttctggtgtgtgcaccgcaaattgttcggccgcttctttgcgcaaaggtacattttgctaaaggaacactttagagaattcttaattcttctaaaagcacggtcgtctatctcataatgatcgtcgcctggaatttgttttcccccttgtattgtccccctccgggctttttttatattcccgggcgcctaaaatttctgtgaattgtgagatccgggttttaaaattttctaaagagagatttttggcataaaaattctccccgttgtacgcctatttaatcacagaacgtcaatcagcccgcctccctatattatcaccctcgcgcgtctcagtccacctacgggtagttccctccttccctcctcatccctgcttcacatgtgagaactagtcatcggacaaggagtttttgcccgagcctttaaaaaacattgttaacccccca

SEQ ID NO: 528813 - DNA, 510 bp, Homo sapiens
  misc_feature (231)..(231): n is a, c, g, or t
ccggtgtctcactcttgtcgcccaggctggaatcagcggcgcgatctcgagcttaccgcaaggtcctgcctcctgtgggttcaagcgattttcctgcctcagcctcccgagtaactgggactaccagtgcacaccactgtgcctggctaatttttggtattttaagtagacaaggtttcaccatgtaggccaggctggtcttgaactcctgatctcaggtgatccacccgnctcggcctcccaaagtgctgggattactggcgtgagccaccgtgcccggtggcttgtatactttgaacggagagtcgtgaacggcagtgatcctatgtcacatgtgatcttggctctcaggggacatttggcatttctagagattgtgtggttgtcacaagtcaagggggacagactgttggcatacagggggtagaggcttggtgacgctgttgaacacccagaacagggaagtacgctggcatagatagagccatcgttgggggaaacccctgctct

SEQ ID NO: 528814 - DNA, 224 bp, Homo sapiens
  misc_feature (1)..(1): n is a, c, g, or t
nctagaggaaacccagcaaatgtgacagacagttcgtctttcaagcagagtgggggagttgtagaaacaggttggaaaaggaaaaaaaaagggggattttaagccgtttgcaaatggtccccagtaactaaaagacggggaacccctttgactggggcactggagggttattttggggcaggaggtgaaaagccagagaagggaggtacaaatgccaggaaacg

SEQ ID NO: 528815 - DNA, 230 bp, Homo sapiens
  misc_feature (73)..(73): n is a, c, g, or t
cgaggatccaggtaccatggacgattcacagcccctggccactggccatttccagtggtagggagcacactgntcacattcgagacccaccacgttgagcagacaaaggcagcctccactctcctcgtcactcaacatgtacctccgtcccccaggatgttgtagttatagcaatagcagccctgcggttgacgtaggtgagtcggtgacgcccgatttggatcgggtgt

SEQ ID NO: 528816 - DNA, 183 bp, Homo sapiens
tggcttgcttgtgggggttggaccaggtatttaaaagatataccgggattttagaaattaggcagtctaaactatgataactaaggatggacacctgggtgataaaattatataagaaatgggcgggtgtggtgggtcacaactggtattccaggacttttagacaggcgaaggtgggttgga

SEQ ID NO: 528817 - DNA, 154 bp, Homo sapiens
  misc_feature (112)..(112): n is a, c, g, or t
taccttttcaaatatcttacttatcaactttactctatccacagagatacaatcacttttaaaaagtgttcgatttcaggtactagactagaagtagaaaatgtctggcttnatggtaaactgaacccgttggtttcttctaagggtaatttta

SEQ ID NO: 528818 - DNA, 129 bp, Homo sapiens
ccagaggagcttataatacacccggttagctcatggaagtagcctaagtgcaagaggagcagcaagatagggagggcggctctataccctacctgacataccctagaccgccccgatgcatactacaga

SEQ ID NO: 528819 - DNA, 195 bp, Homo sapiens
tacgacagtgaggcagaatatgttcgcggatatagacacgatccgcagggcctcctcgccaagacagctagagagactcaataagaagataaacgaaaatcaaggagatgagacccaaggtcagcatgcacctcaacgtcggtaccgccgcaacttcaattaccgacgcagacgcccagaaaagcctaaaccaca

SEQ ID NO: 528820 - DNA, 537 bp, Homo sapiens
tgcccccattactttgtcacagcacaccaacaccagtcacagagctgggtctagcaggttgtcccaccactgctactgccattacccatttcacaccagctgcccaggagcctgagaagttgcccacatgtctggcccactgctgccactgctagcatctgagcaagtcacctgaaggcccaataattggccctccaagacccactatcgctgttgtcagtttaagccactctgtgggccctagcacaggctcattcaacccaccgctgccatcactagggcctgaagactggcccacctagcatcttagttcccagccaaacttcaccacagccttcactaataagtgcaccttaagtcaatgaggaagtcacagataccactgatgttgtatactgccaaataaatcatacagggatcacactactataggcactcaaaatcaaagccaaagcacccaactcaacaaacaacacgtaaaatcttcaggaaaaaaatcctcccctatgaaagcaatttcaaaaatggaagaagtga

SEQ ID NO: 528821 - DNA, 159 bp, Homo sapiens
gaacatcatgctgccagactattgcagatatcatccgacatgtttgggaccagtcatgatgagatgctttggaccaatggaggcatgtgatgaccaatgatggcatgcattcttcgagagatcaggtccagtcgacatcagtgacagtgatatgatgct

SEQ ID NO: 528822 - DNA, 875 bp, Homo sapiens
  misc_feature (858)..(858): n is a, c, g, or t
gcctctcaagctcggagttgttggtggggttacactgcgtggcttcaacatgcgtatcgcaaaaagtgtatttctgtctcgggacccatctatcctggacacggcatgatgttcgtgccgcaacgatgaataggtgttcagatttgcaaatctaaatgtcataataaacttgaataaagaagcgcaatcctcgtcaagagtaaggtggaccaaagtattccggaaagcagggtggtaaagagcttacagtggataattcatttgaatttgagacttacgtagaaatgaagcctatcaaatatcagggagagttatggaataaaactattgatgcgatgaagagagttgaatgaaatcaaacagaagcggcaagctaaatttataatgaaagattgaagaacaataaggagctacgagaaagttcaggatatcaaagaagtcaagcaaaagataccatcttatggagaccctcttgtaggcatagggataatgtctggccagagataatggtacagcagttgcaagaggatgtggacatggaagatgtccttaaaaatctctgtaaccatttctttgatgttcgttttgaaaagtgcctttgtatattggaactgtaaattatttatttgttacataaggtccttaatgacaagcgattagaagactttttgtgattggctctaatagatcgaattacgggtagatgctccggggaacttactgtacagtatagtagctggatttatggtcctagaagatgggggaagggggatggtatggagggttttaaaggaaatggggggaaaaaattgggaattgggggggggggagaacattggggaaatatgtgtaaagagngacatagcgtggagtgc

SEQ ID NO: 528823 - DNA, 143 bp, Homo sapiens
acaagatgtttaagatgagtgacaagatattactctgtgtgttggagaggcttgagacactttacagtttgcagaatatattcagaaaacgtccacctttatagatgcgaatgaattattttcttccacggcagcagctaact

SEQ ID NO: 528824 - DNA, 778 bp, Homo sapiens
gaatatagatacaagtacaccatcttgaagaatttggagttcttcagggcaattcaacatgacctctatttgtttcgttcttttctgtattccatgacagtgtttctggtaattgtgatctctagattgtgctagtgttcaatgaacatcattctattcatgatggtgacgccatgattcatgataacttcaatgtttctttcatcttgtagtagctaagaatagtatgtcgtaagtatgcttatcttgtcaagggcttcgatttattgtatggtgatgatgtgacactattcaacgggtcagaaactggagcagtgtaggcagtatagagcaagtatagaatatcgtcttaggaagttagcaaagatagtacgtagtgtccctacttgatcccatgaggatcagtagcgtatccagagacaccccgagatgaactgtcttgaaagccattggactaggtatacgacagcgcgtacatatacactgttgttttgcactatatcatactatagcctgatgtagtaacagtgtctatgttatataatgcagggcacagtcatagagataagagagataactggcgatatagaacaattattaacagctgcactgtagataatagtgatgtgccatgtgatcatgtcttgtctgcgtttctcttcggaaagtatcttatggtcactggtactcgaccgtgtaatcaggactgtggttgaccgtgagtaaccgagaacaagaaagcaagaatcgtggataagggggagatactctatatgag

SEQ ID NO: 528825 - DNA, 444 bp, Homo sapiens
ccggtgtcgctatgtgcccccaatacagcactgaggctaggaggcaagtccctcaatgctccacaaaaggctgagaccttcttcatgacagagtgagtatagaacataacgaaacatgcccaaggcttaaatacagttgctagaaggtcatcatgtccaacaaatgaagattgtcctccttttctttgaatattaattacattgttacaacatttttgtgggttttttcgtttggtgtagcgtcattatgtactgtatgtgtgtgtacaacaacaggaaaagtccatggcaaggtgtcctgtgttagcagagtttggctgtcatctggtccgacagttggaggatctccgtgtggtacaggtcctaggtgtgattcaccgctgttgatctcgctgttgttcagtctcaggcgtggtgacagcatacaaggagaacgaagtccag

SEQ ID NO: 528826 - DNA, 715 bp, Homo sapiens
  misc_feature (492)..(492): n is a, c, g, or t
  misc_feature (619)..(619): n is a, c, g, or t
cctcaaatatactgggcacacagcaagccctacctgtaatgtggtaggtctcactcctatacagaacatggcatgatacaaattctaaaaagaagatgtctgatagcaccttgattgactgtctgattagaggtacttttaatggaataggcagaaaatgcaaatatctaatgaacatgctggagaggttcaccatcggcaagcatttcattttcttttcttcaaaaattaattacagagtgtggctgcgtttctgtggattcagtgtttctaattctttcttcaattagtcctttaattttcttcccaaggagacacatggatatacaacacgtaacacagtgacattttcttgtcactgaaagaaatttcaaagttcattttcaaattcaaagaaaaggaaggctggagtggattggaaaagaggctacaggctaagaacttttaagagccctagagagagtggggtgctggtgtcactgttatttcatngattttccttgtccacagccattttcaagactcatatttcagggccttagatggtttgtctcatatcactgctgtctgtagcaacaaccactctgtagaaggctcccagggaaagaccataagtctnccttgttttgttgttgtttttggaacacagagtctcactctgttgaccaggttggaatgcagtggtgtgatcttggttcactgcaactcttgtccc

SEQ ID NO: 528827 - DNA, 212 bp, Homo sapiens
cagcctcccaaagtatgaggattacaggtgtgagccaccgtgcctagcccgaaatttttctttttgaaatattcgggttcacttgagggtgacagctctttttgtatagtgctgcaagaattctgggtaattgacatttcggggttatcctcagaaactacccagagtgttattgttgcctggttcagttgcttggaggtgggaggagagga

SEQ ID NO: 528828 - DNA, 236 bp, Homo sapiens
  misc_feature (95)..(95): n is a, c, g, or t
tacatatttacgcccgctctatccgactactatagggaaagctggtatccccctgcaggtaaccggtcggatttcccgggtccgacccagcgcgnccccaaaattagcggggcttggtggcaaatccctgtagtcccaaatacctctggaggtacgaggggggaggatcacttgaacccggaggtcgaggctgcaggtgccctaggatcacacccactgtactccagcctgtgtct

SEQ ID NO: 528829 - DNA, 392 bp, Homo sapiens
atcaggtatgtttgataaagctgttatcaagaaaactacaacgcagtacctttcctgtgtgttgggaccctgatccgacgtgcattcttatcaccccacatggctgacctccacagctgactctccttaccttgtgtccttcttctcagtattctttgagatatccatttcattttggtctgctccttttgcagcatctgaaccttttacctcatctttttcagaatcaggctctatttttattttttttggacttcgtgaacattgtcttttatctgactcatccatattttcatccatattatttttggttccttctaacgactttctgtaattcacattagtattgcctggcgatttaggaacgaacctgtaaacattagttttactaa

SEQ ID NO: 528830 - DNA, 372 bp, Homo sapiens
aggcggattacttatcgcgttagcttgggcgctgaggttcgacccccaacacctagtaatcatcgtttacagcgtggcgtctcagggtatctaatcctgtttgcttgccgcgctttcgcgttctgcgtcagtatctgtccagtaagctggcttccccatcggcattcctacaaatatctacgaatttcacctctacacttgtagttccgcttacctctccagtactctagttatacagtttccaacgcaatacagagttgagccctgcattttcacatcagacttatatggggacctagacgcgctttacgaacaatccctccggatagcgctcgtgacatacgtattatcgagactgctggcacgtattta

SEQ ID NO: 528831 - DNA, 1254 bp, Homo sapiens
  misc_feature (52)..(52): n is a, c, g, or t
  misc_feature (63)..(63): n is a, c, g, or t
  misc_feature (72)..(72): n is a, c, g, or t
  misc_feature (81)..(81): n is a, c, g, or t
  misc_feature (83)..(83): n is a, c, g, or t
  misc_feature (87)..(87): n is a, c, g, or t
  misc_feature (107)..(107): n is a, c, g, or t
  misc_feature (134)..(134): n is a, c, g, or t
  misc_feature (137)..(137): n is a, c, g, or t
  misc_feature (139)..(140): n is a, c, g, or t
gagagcttccccatgtagtccctcaccattgggtcggccttcatctgaaacnagagcttttcnctctcctcnaactttgtngnaggntccactcagactctcacctntgcttccagggggaggaggaagaggcncangnngcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaatgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaaaaaaaagagaaattatttcaattttattttagacggtataactatttcaatttgattaatccactattatataaacaatagtgggagttttatatatgtaatctttcaggtggggaggctttaaattctgaagtctgtgtcttaaaaacaagaactgtatttactgtggttgtggacaaatgtgaaagtaactttatgcttaaataaattatagttgattc

SEQ ID NO: 528832 - DNA, 1182 bp, Homo sapiens
  misc_feature (52)..(52): n is a, c, g, or t
  misc_feature (63)..(63): n is a, c, g, or t
  misc_feature (72)..(72): n is a, c, g, or t
  misc_feature (81)..(81): n is a, c, g, or t
  misc_feature (83)..(83): n is a, c, g, or t
  misc_feature (87)..(87): n is a, c, g, or t
  misc_feature (107)..(107): n is a, c, g, or t
  misc_feature (134)..(134): n is a, c, g, or t
  misc_feature (137)..(137): n is a, c, g, or t
  misc_feature (139)..(140): n is a, c, g, or t
gagagcttccccatgtagtccctcaccattgggtcggccttcatctgaaacnagagcttttcnctctcctcnaactttgtngnaggntccactcagactctcacctntgcttccagggggaggaggaagaggcncangnngcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaaaaaaaagagaaattatttcaattttattttagacggtataactatttcaatttgattaatccactattatataaacaatagtgggagttttatatatgtaatctttcaggtggggaggctttaaattctgaagtctgtgtcttaaaaacaagaactgtatttactgtggttgtggacaaatgtgaaagtaactttatgcttaaataaattatagttgattc

SEQ ID NO: 528833 - DNA, 200 bp, Homo sapiens
cgtagtacccaagtaactgggactacaggcatgcacctccacgccctgctaatttttatatttttagtagggatggctttcaccatgctggccttaagtgatccgtccgccttggcctccaaagtgctgggatttcaggcaagcgtcaccacacccgacccctcactagtatttcagcatttgggtactacgctttggca

SEQ ID NO: 528834 - DNA, 130 bp, Homo sapiens
tgttctgttctgcccaggcctactgtactgatttattcatatctgctttgtggtgagggaagggacgactaatgtctcaaacagatgtggtgtaccctagctctgctctcctgtcttgctgtaaagctcc

SEQ ID NO: 528835 - DNA, 157 bp, Homo sapiens
tccaggttaaaaattaatggaacaaatggaattatcacaagaagagtgggaattagcttttccaggcatggaaacttaacaaaggagggtaaaaaccgtaaacagttaaaaatccatttatgtggctttcaaagggggagttttttgggaccttaac

SEQ ID NO: 528836 - DNA, 259 bp, Homo sapiens
tggggcgactctagagttatcccactgtcgtacttgatatgtgggtgtgtgtgggaagtggaagagaagggggtagggcataaactgagtcaagaattaataaacaccaggtacagtggctcatgtctataatcccagcaccttgagaggttgaggcgtgtggatcacttgagctcaggagtttgagacatggcaaaatcctgtctctacaaaaaataccaaagtagccaggtgttggtggtgcagtcctgtagtccta

SEQ ID NO: 528837 - DNA, 343 bp, Homo sapiens
  misc_feature (200)..(200): n is a, c, g, or t
  misc_feature (217)..(217): n is a, c, g, or t
  misc_feature (219)..(219): n is a, c, g, or t
  misc_feature (221)..(222): n is a, c, g, or t
  misc_feature (229)..(229): n is a, c, g, or t
  misc_feature (262)..(262): n is a, c, g, or t
  misc_feature (342)..(342): n is a, c, g, or t
atattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaaganggattctcagatatttntntnnccccccncccccccctacttgaggtcttttgacatgtggnaagtgaatttgaatgaaaatttaagcattgtttgcttattgttccaagacattgtcaataaaagcatttaagttgaatgng

SEQ ID NO: 528838 - DNA, 402 bp, Homo sapiens
  misc_feature (11)..(11): n is a, c, g, or t
  misc_feature (31)..(31): n is a, c, g, or t
  misc_feature (52)..(52): n is a, c, g, or t
  misc_feature (60)..(60): n is a, c, g, or t
  misc_feature (125)..(125): n is a, c, g, or t
  misc_feature (138)..(138): n is a, c, g, or t
ccagaatgganaattggcaagggaaaagggncctgaccccctctccggcctnccccctanttaattaaataaagtaaacccctcatacctttcaaccctcttccctctcctaatttcaaggcatncctacatatgcangggggatattttaaaaatgaagtatgcacaagttatttctttttgggaacttctgacatttgatgaactgactttctttaacggcttagctgcatgtttatcccaagggtatattgtaaacatgaatgaaatctctgtttcagagatttgatgttcactgttaatttatgttctgtgagtggtatttttcttatttttttattttaattgacaaataaaaatggtatgtatttatcatgtaaaacatgacctttttaaaatata

SEQ ID NO: 528839 - DNA, 170 bp, Homo sapiens
aaatagcgagggggtgcggtgagtacatttgcagctgaggagttgggcggaccgtcgagttgctatgagctgcttttaggttcgtgtttttaacatacggtgacatgaagctttacacgtgtactgtgaacgtgtgtcatccgcgtctttcagctccactagctccgcta

SEQ ID NO: 528840 - DNA, 884 bp, Homo sapiens
atgtgaacatgagatcatgtatcaccccccataataccagtgtgaaagtatgcggcctggtgatgcgtggctcactatcctgtagtcccagcccttagtggctgccgcgtctggcaatatcctctgagttcctgagttatggagaccagcctggtcagaactggctgaaacccgatgcatcttactcataagatacagcataaaaagagcaacaacccgtaatatgtagcataggtaggtgggcaagattccataggtagagtgcgacaaacctaccgagtccgtggtgatagctggttgtccaaagatagaatcttagttcaagctttacaattgtgcccacagaaccctctaaagtgccccgttgttaacttctaacttgtaaagatccacagggaggaacagctcttttgtgacactagagaaaacaaacctgtgtagagagagtacaaaaagttgtaacacccatagtaggcctaaaagcagccaccaattaatgaaagcgttcaagggttgcaacaccactacctaaaaaatcccaaacatataactgaactcctcacacccaatttggaccaaatctatcacccctatagaagaactaaatgttagtataacgtaacattgaaaaacatttctcctccgcataagcctggcgtcagattaacacactgaactgacaattaacagcccaatatctacaatcaacacaagtcattattaccctcactgtcaaccacacaggattgctcatagggacggtcaaccagtacaggactcggaatctacccgccgttccaaaaattccttctagctacgtttgggccgcgccgggcacttgttaggcggccctacggagggaaaacatgccaaggcgtaggccg

SEQ ID NO: 528841 - DNA, 802 bp, Homo sapiens
  misc_feature (575)..(575): n is a, c, g, or t
ggcagatgctgtggtcaggaactaggcatgctttctggcaatgcactcaccagacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgccgcaatctccccgggggggcttccccccccttttttaaaggtggcccccaaatgagtggagtcttttttaataagaaccagcacgcgcgcgccgctcttataaaacacgactgggtgcggagtagccaacaagcagctacacgccttggacttctgttggggacgacagacccccctccatggtggggggcggagcaaccacaagctgcgcgagcacaaccaccatccacgacagtgatttaataccacccctgaagcggtatcttaaatataaactatctgtggacggtggtcaaatgtgtgtggcaaccacacccgtgacgatttcattttcgctgccggtcggcgggagcaacacgttttggcctactcgagtagttagtattttatctccttacagctctcattattattanccagcggagcggggctatttattaataaatatattacctactcatacacagtaatagcgtacataaaccagaacacagcatgacactatacacacgacgatagcaccctcgtaacagtcgactaatcgaacgtcgatccagcgaaaggcgagcagcatctaacaccgatccgctagcacgacaagtcacgaaacgatatcaccagccactacgtgtaactcagcata

SEQ ID NO: 528842 - DNA, 744 bp, Homo sapiens
tatcgggtgcaggcactgtaggtgtaggagtcaatagggttcagttgctttggagtcacaatagaaactgctttgtgtaatgaggctacaagccccagcccatgtttaaagaggttcaaagttcaagtgtgtgtattaaatgggatacagtctgttgtataaacattgctgctttgctaacttgtggagtccagggagcagaatttggctaacctaaaattttgggtttatgtgctattttgaaaggttttagagctgccagtcttagcgtcagttttgttttaccctaaaacaggggtgtttaacttgcctgcagctgtttaaagcgattgattcttggtgcatctagaattaccccttgtattagtgcttttagacacctgggttagactgtggccaactcggttaccccagcctaatctgaacctgtggccatggtggttttttaggaaaccagggcctggccctggtaccccgcggagagagctgacatgggtcaaggagaccatcgagcctggagcacctgtctagtcattttgtggccttggatatgcacgggcagaggcaaatgtgggaggttgccccttgacaaggctgcaacctcgaggagaagtgccagaggagctcgttgactgtaagtgccagagtgcacctcatgtaacgtggagcaggttagcagtatcctgcagtaagcgatggctgccacagtgtcaagacggctgagtgtagaaggggcaccctgga

SEQ ID NO: 528843 - DNA, 1157 bp, Homo sapiens
ggtcttacttcagagggaaagctggggtgttatgcgttcgagtgtaccgtaccgtcgatcacgttacacaagaaagtatcaggtgacgcaagatggacactgcaattcgacagatcgcctgcgcaggctcatcctgtgagccacccatgagacacacacacgaacttggcacacagactcagcggtgcacaggactatcggatggccttcgagcggcgacagacggcgaaggcgacgctcgcatggccttcacgggagacacgcgtggacggacaaccagtaaccacttcaagtagcgacaggcggcgcacaggtcgagtatgatggtcccgagaggacagcgatcaggaggtggcaagcaaaagtaacagatcccaataaccaaacggccagaagtcggagtttcagctaaaggcattctggtcgaataattcagcaaatagaagcatttcatatacgcaaaaagagaatgatgtttggcgaatatagaactgcaacattattgtttccatgcagaagttaaaagccacattgtgcctccttatggagccacttgccaagtccctgtctctttcagacacagacaagcattcattttaaattatttcaatctgagtcattatcatttataacctttatggttacttcttcatcagtttttccttttgaaaggtgtatgaattcattacattggattctaatgtattatctgtacgattagaagactaacatcaagcatgtactctgactatacttcgtgagtcagctgtacttatactcaaaagtgtccttaatagtgtcttccgtgaaactaatactaaggaagtgaacagcctctggaggacaattgagcttggaagtcaggttcacagcaactgcgacaagtacaatgggactatacaggctctgagactaaacgagacaggtcaaacagattcacaagtcgggtgaacaaagcaacaccgggaatgccagacggacaagtcatggagagcggaaccacaaatgtcgtggaactacgcaaccaataaggccagccacgaaactcaagcgatcaacgaacagagcataacactaggagagaacaagaagaagagacagaacaaacaagaccaacagtggcgtggcttacccagcgatcacacaccaatcaacga

SEQ ID NO: 528844 - DNA, 416 bp, Homo sapiens
ctcaataggtccagggggaatctatcatccgggccactatcgacttcatctactctaagctctaactacagaaagattacactatgatatagttcaatgaacttgatatactatccccgaagatattcactatgtttcctacataattccagcaacactcagcacacgggctgtcatccaaaatcataagaatctgttttaagatttaagcacatgtgggccaggcacggtggctaccgcactataattccagcacttagggcggcagcgatgggtggcatcacctgaggtcaggcagttcgcagcacagcctggccaacatggtgcaaacccgtctctactaaaaaaaaaaacgcaaaaattcagtgggcgtggtgatgggcgcctgtactcccagatactcgggaggctgagga

SEQ ID NO: 528845 - DNA, 96 bp, Homo sapiens
ctccctcccctcccccacaccagaaaggggtatgttgggggattggaagcacttgaactttttattttattaaaaccttgttataagcagcaaaaa

SEQ ID NO: 528846 - DNA, 679 bp, Homo sapiens
  misc_feature (641)..(641): n is a, c, g, or t
tctgagagaaggcagcaccttaggatattatgtgtgtctcacttacatatataaatgaattcccttttgaggtagatgtattttagtcaataagtcatcttctctcaatagtaagccaacaactttcctggaaatctagcaaaacaacagttctatgaccagccttatgttttgttgcatgtgtgcataaaaaatgcagattgactctttccttttctgttttagaattggttccaaacagtaaagccgccagaaaaaacagacaaactcttaggaacaacaatgcccattatgtgtggagtagaagctgccagactttgattactggccagagattaacccctttggtgtcttaggggggaaaatgccaagtctgaatccagacatttccaggattttacagtcattcatggtatgagaccaggcgatttataatgacttgtgcaaaaaaaaaagactattgggagaaggaagtgcaagtcaaaggccacggctccttgcttcctgaattctgccatgactaattccagcaagcggacatagacctgatcacctctgcttttccctttgctagcctgcctggtcatggatgagaagcacgctgctcttgctaccttcatgtggtggtttgggtcctgaancatccacctattttcagaataaactaaaataatttctt

SEQ ID NO: 528847 - DNA, 342 bp, Homo sapiens
tagtacattgccaaatgtcttgtcaccttcctttaaacataagacataaattttatccttagaaagtgtatcctggcccattgcagtggctcatgccctgtaatccccaacactctgggaggccgaggtgggctgatcacttgaggcccaggagttcgagaaccagaactggccaacatggcaaaaccctatctctactgaaaatatagaaattaactgggcatggtgcgcgcgcctgtgattccagctactcaggagactgaggcacaagaattgcttcaacccgggaggcataggttgcattgagctgagattgcaccactgcactgtgacagagtgata

SEQ ID NO: 528848 - DNA, 597 bp, Homo sapiens
gtgatctagaggatccagtagagatgagcaaggttgagattggaggagagtgtagtatggagaatgtgttctggaaacatttattctagacataatcagggacactcacagttttggagataatctttggagttctaaagaagggatggggaatcgcctgagggctaagattaagtgaggttggaacctgggggacagaagggacttcttggtggctggctcggtggttggattggtcaatggacgggttgtggaggggacccaaggttgaaacattgcaggccaggaagagcttgggtttgcacaagacagaggccacaacaaggaaatgtggcttgggggcagtggtagggaatggcccacggtgtgaacttggaggctactaaactatggggaggggggcggggcaagggccttcgaaaaaggagggagagggtttgaggcaagttttaaggcaagtggtccggtcaaccacccaagtgccaaggtggcccctggccccaaccccaaggagtgggcaggcagggacatgggcaggggggagctcgggatggattttctgcctgccttccatttgccttgcatccccttcattaa

SEQ ID NO: 528849 - DNA, 340 bp, Homo sapiens
ggcttaaaaggctactgtctcactccgagtcgcgatataatgttacggcatatctacctattaacctggtagaatatattcatcagttcaagatggttcagtcccaactggaggataaaattctaaattactttggatcacctattctcatctatcttcttttgaacaccccataaaaccaagatgcaataagcataaaacaatgataatacatcaatcacatactattaaatataaaaagtaggcttctctgacccaggtttcaaaaaattctcattgtggcatttatagcaatgtcgcataacagggcagaatgaagaaagatgatctaaatctcagc

SEQ ID NO: 528850 - DNA, 402 bp, Homo sapiens
tgaccggagaaacacgcccacactacttcgacacgtctcaacccaggatgcggaatacggcctccgaggaggacgctgcagctgccgcgggccatatatggagaacacggccggctccatggatgaacacactgcagctctccgaacagcaggatacccaacggcacgcttgggaaaaagacctagtggcagcttggggaaaagacccagcgctccgtttagaagcaactgtgtatcagccaactgagatggcctgtcgtgctcaacggtgggaccatcccaactgctccgccaagtcacacaggaagacacctttggtgaaagactttaagttccagagaatcagaatttctcttactgatttgcctccctggctgtgtctttcttgagggagacatcgga

SEQ ID NO: 528851 - DNA, 1413 bp, Homo sapiens
tggtcttggtacaaaatttaataaaagggtcttaaaagagcaaaatccaaactccaaaatacagctgtgccaaggaaacccttgtttattgcttggtgggagacgtggcgtgggcgcatgtggaagggcgggactcgtggcttcccacccttatcggttacgtgaaagtggggggtgggtgggcagatactctctcattctttgtgggttctccaaaagtgcctcacggtggctcgaggcgaggggctttcttatagggcgccaatctttaccgaggtggggctcccgagggccaagcaatgatatctttcacctttgaagtgcccaagaaacaaccgctgtttttgacgcaacaggtgtggccgcacaggcaggtgttcaacgcgttagaatagttataaacagggggctcttcccgggtggtgagactcatatcggggcacaatccaaaaaaactttcagtggatattatagcgcctttgtgttccctcggaagtttatcccacaaaaacaccgcgacaaaaaccctttcgaaaggcccttgtgggggccccacgagtattccttccagggatgtagacaccgcggaaaggcacacacaatagcggagggcgcctatcgagagaacaaggaaaaggcacctaacaaaaggagagttgtggaaaagcgccagaaaggaactctccgggccaggagtgccacaggggtggacacacaaaaagacccctacaaagggggggcccacagcatatacacaagcaaaataaagaggcctacaaaaaaagagtgccgcccctcgggggaaaaacgccacaaaaacgcctcttccggtagaacccaaacagggaaagaaaaaggtcgccaggaaaaatttccgacgggagccctatattatttacccatagataaacccattgtgttggtgtcccgggggtgggggcaaaacacaaaagtgagctcttgggggaccctggggatggggaggtaaacatgcagacaactacataaactccgaagaagagtccgcatattgagaggcaacagataccccgaagataaaaacaacactataaccagacacaaccctaaaaaagaatactccacaatgaaagaaaaaacttcccccaatcaggaggagaaaaagggcgaggcccaaatgcgagggtgggccagcagagggaagtgaacacccccaggagacaaacacgatcacccgcgaatagtggagggggacccataggtagcaagcgggagaatcatatcaagacaagaatgaactaaaggaagaatacacactgaagaagagctaatagaagaaaagatagttatccagagtatagcagggagcacaaaaaaacacgtggggggaaaacaacaggaagaatcacagagacgaagacgtgaggaacaaga

SEQ ID NO: 528852 - DNA, 159 bp, Homo sapiens
cggattccggcatgatttccccaacattcctggaaaaagtcttccactggtgagcgaaaatatgcatgctgaatactatgacaacctccctcactacaattcctggtattaaagtactgtatgatttttgtgattggatgatacacataattccctact

SEQ ID NO: 528853 - DNA, 153 bp, Homo sapiens
ggcagattttgggatctctgctggccagtttgtggcagtgttctgggataagtaatccccagtggaggctctgaaaggtctcggtggataagctcaagcgttaaccgcaatgagggccgcgtgtctgtggataacatcaagcagctgtagcaa

SEQ ID NO: 528854 - DNA, 103 bp, Homo sapiens
  misc_feature (70)..(70): n is a, c, g, or t
ggtaccaatcctgaagttgccaaatgtggagcaggctgcagagacttgaagcctggggttgtgtgcctcncttttgttttgttttttttgagacagagtcttg

SEQ ID NO: 528855 - DNA, 558 bp, Homo sapiens
gaaatgtgcgctgtcaacgaagagccactggacagctggctcctgaacacgttgccacacgttaaatgggtatattgtgggatatagtagggtaaataaaacgtgctattaaaactcatgtcttaaacattgctactgaaagacaattacataggaagcttatatttctactggcaagcacttttcaaacattctaaactaaaaggaaatatataaagagattaatttatgcacaggaaaagagagaaataaattacgtattaaaaagtaaaatatggctgggtgtggtagctcacgcctgtaatccccgcactttgggaggccaaggctggcagatcacttgaggccaggagttcgagaccagcctggccaacatggtgaaaccccgtctctactaaaaatacaaaaattagctggctgtggtggctcacgcctgtagtcccagctactcgagaggatgaggcacaagaattgcttgaaacccaggaggcagagtttgcagtgagccaagatggttgcattgcgctccagcctgggcgacagagtgagactctatct

SEQ ID NO: 528856 - DNA, 211 bp, Homo sapiens
  misc_feature (7)..(7): n is a, c, g, or t
  misc_feature (74)..(74): n is a, c, g, or t
  misc_feature (85)..(85): n is a, c, g, or t
  misc_feature (91)..(91): n is a, c, g, or t
  misc_feature (96)..(96): n is a, c, g, or t
  misc_feature (110)..(110): n is a, c, g, or t
  misc_feature (121)..(121): n is a, c, g, or t
  misc_feature (127)..(127): n is a, c, g, or t
  misc_feature (139)..(139): n is a, c, g, or t
  misc_feature (143)..(143): n is a, c, g, or t
  misc_feature (168)..(169): n is a, c, g, or t
  misc_feature (172)..(172): n is a, c, g, or t
  misc_feature (180)..(180): n is a, c, g, or t
  misc_feature (193)..(193): n is a, c, g, or t
ccaacanatcctccgctgcggcgtcaggaaggacgaccgcacgggcaccggcaccctgtcggtattcggacaanaaagaagcgcnaaaaantgaanaaaagaattccctntgctgacaaanaaaagngtgttctagaanggtnttttggaggaattgatgtggtttannaanggatccanaaatgataaaaanctgtcttccaagggaagt

SEQ ID NO: 528857 - DNA, 1049 bp, Homo sapiens
  misc_feature (843)..(843): n is a, c, g, or t
  misc_feature (1041)..(1041): n is a, c, g, or t
  misc_feature (1049)..(1049): n is a, c, g, or t
acccggccgtctccgcggccgcggtgactggcaacacacagacaacttcggttttgcgggcttgcggatgtgggacgagcacatttctattgtcttcactctggatcaaaagcagatcagtctctccgccccgcaccagatcaagtagtgtaggacatcaccgctactgaaaacttagcgattatctcttcagcttctctgcagtactcttcagtcaggatgcaaggaaacagattctctagtgatagaagacttattatttatggaacctctcgaaaggaacagatttgctttgagagaatccgtgtgaggaacgcacgcagagtcctagtgaactctatagtcgactgggtccccggacgggacgagtcacggtgtgcgtctggcgccgcgtaccgatttgatcggcgtacctcccatcaagtgcacgccgacccgtgcagcgaccgcagccccgcggtgacccgaccgtgccgagtcctgcatgcggcgtcgctggagcaacgccgcccaccgacgcgaccgcgttaccgcggtcgcatacaatacgcgcgcccgcgttatccccaacagatattccccctccctcccgcgaggtcgcgtaccatgcgtactcccatatcgtaatcccacacccattgcataatactcgactcactgatattcgcctcccccggcgccatcgcccaccgtacggtcacgccgtaagacctcgtgccggaccattccgctctgtattgagctgttcgacgtacgccatcgccctgtcccgagaccggacgttcaccacacagatgccggccgcccccgcgtcatcaaccgatctctgcgcctgccgtaganatacaataacaatcagtactcggcgtcggcggcgagatgcgagttggcggcgtcccgccttcccgcacgtcatccgtgtgataactgatttactcggatctacgtgacatctattacacgcggcgagacaactgctgcggtgtggattccacgcgcgtagtccgtcgatcatgcgttatcgaacgtctgcgcccgcgncgcgcgtn

SEQ ID NO: 528858 - DNA, 1586 bp, Homo sapiens
  misc_feature (250)..(250): n is a, c, g, or t
  misc_feature (355)..(355): n is a, c, g, or t
  misc_feature (444)..(444): n is a, c, g, or t
ttctgtagagagcttatgggatagaacatacgaatgtatcgactcgacgtagtcactattagtcgtgtagttactgtctctattcttgatagtgactacaaactcatgcaagagatgcccacagtctatacttgcgagtatccaagatttctacatagactagtacaacacgtaataagcggcacggtgcggaggtgcgcacggatcatcccgtgtactctaggctacgatctcgaaagccattgcgtanctacactagtatgcgttctcaaatgatagcatcgcagtatcagacggtgaagatttatactgcatgactctctcatatgctccgtacacaatcgtaaaggacatntgtccgtgccaatatggtgcgtacgtaagcgaagtgttgcctcaaaagttcgtcgacattcttgtgcgtacccaggtgatatcgtcacncattgcgtgaacgtccaaataaagttctctctccctccacttaaacggtggtgcgggagtgcacgttaagcgactcttctgtccatgcacatatgggtcttgagcgatttccatatataccgaagcatataacatcgcggtacctgtgaacacaacccaccttacgaaccgtgtaagcgcatttgcgtcacccctaagcggaatgcggaactgcgttgcgcctcacaggaactgagagcaggaatttgagcgacataactttatacacgatgactcgcgctatcccttcgaggaacaacgaggggaataaagagttccctttggggctttcttatcgcacgtgagcgagtttatattggcacacatgggcccgacagtaccttttccaacgccacatccccatctgctcccctaagtgaaacattagagggacacgttcgcgttaggcttgggggggttcccatctgttacccccagttatacccccctacacccaattcaagggcaagatactccaagcgtcggttggacttatgatccttggtcagggtaagcatacccacgaacgaaattgacaggggaacgtttatcaggagcggcagttagctggcgataaaggactggaaagggtaccttggaacatttaggaattctcggggggaggcgtttacacccaaataagggtcggtcttattccctaactttgttcgccacagtgtgacacagaattaccccttgtgggactacgcaataacattgcgctccacaagccaaagtttccacacgtgtgttgggcctattttttcactatactgacaccgttcgacgacagattgggagcatacgtacctgtatgagctcgtatagcgcatcaggtatgcgtttccattttatgtgcactgtcctctttaaggacgccccattttgtgtgcccacgagtcatacaatacgatgatggagatactcgtgagccgctagcgttacatatcaacggtccccctattgatgagatagcggacccgcagaccacctgagagagaaaagagtcttcaccgcgaaaaatggcctatcctataggatatgacatcaaacgtgagaaaagtggcaaatataaccgcagagagatcacgcgtatgatcgag

SEQ ID NO: 528859 - DNA, 194 bp, Homo sapiens
agtgaaactctgtttctaaaactaacaacaaaaaagttgaataaacataaacaaatggagagcagcggatgatcactgttcaccgcatccttgagctcctagcctgaagccattcttccaccttggactccctaggtactgggatttacaggcatgagccaccatgcctggtctatgcaagaattttttactga

SEQ ID NO: 528860 - DNA, 460 bp, Homo sapiens
gagatggagtcttgctctgtcgcccaggctgccgtgctgtggtgcagtcttggctcactgcatgggttcatgccattctcttgcctcagcctcccaaggagctgggacaacaggtgcccaccaccacgcccggataattcttttgtattttttttagtagagatgtggtttcaccacgttagccaggatggtctcaacctcctgacctcgtgatctgcccgtcttggcctcccatagtgctaggattacaggcgtgagccaccacgtccggcctcaatcacattgttttcttatttatgagttttaagagttctttgtatatattggataccagttcaatatatactttgtatatattggagaccagtgagacagggtctcactctgttgcccagccttgacctcctgggctcaagtgatccctcctgcctcagcctcccagggtcgacgcggccgcgaa

SEQ ID NO: 528861 - DNA, 446 bp, Homo sapiens
tcccaatcagacgagcgccgatggtcgtggctttacaccagcaatcagactgaccccttcttcagtcctgtcaagagcggctaggccctgatctatgatatgcccatggaggagcaggaggtggctgtcatgtggtaacgcaacaatcctgatccccagacgtggaacgtgagccatattcatagtgagaccttggaggccgagcatgccacatgagccctgttaagaccctcttatgaacccgtgatgcacgtctctatagactaggctactccgcgatgaccatgcacaggatgacagacggcgacgagacggtggcccagagctatgtcttcaacgccatgcgcctgaacatacaggaccctgattttgcgaatgcgaatatacatactgcgcatatgtcattctagcgctgatgttccaggctactggataggaggactctc

SEQ ID NO: 528862 - DNA, 1300 bp, Homo sapiens
  misc_feature (254)..(254): n is a, c, g, or t
  misc_feature (387)..(387): n is a, c, g, or t
  misc_feature (694)..(694): n is a, c, g, or t
  misc_feature (1060)..(1060): n is a, c, g, or t
cccacgcgtacgctcttaacttactaccagagcaaccttaagccaaaccatttagcccatacatgcaaacgttatacggcgactatgacattgacacaccttggctgcacagttcatgccatctaagatatcccgggccaggcgtaatagcatgcagacaaattgatcaactcataagcattgatatgagcgcaaggtgacttacacccgcatatacgcttcatgccatagagtgcaatctaacatagcaaatngacttcttgacaaggcacggagtccaaagcgtgaagtacccccgataaaactagactcagcatacgctttaagaactagcgtcaagagagaagtcaccactcgcaggtccttatgttcagcaatcacataagntgtgagaccgcattttcatcacgcgctagcagagcggaggagaaaccttagccgcagcactgggtggcattagcctgcgtgtgttccatacgcactatgagaatcttacgcttcacacctattacaaattttgcgccatcaagataccgccttccttagagaatgcccctccttgttcaacactttgtaagactggtctcaggtacctacatagatgggaaacatagctcctttggggaccaactatgagatatagaaagcctttggtgatgcagtcagacgtaacatagaacttgtgagatccaanctcattagttagggcgtctataaaagcgagcccaaccaaggttcaagcaacagtcgttccaatgctacaaatattccagataaggctaaattaaaatgcctcaaaacaatttttaatcgtgagacttcccttgcagcattcgccaaagtgtgagacccaagtcttattcgacccgtgattacgaaggaaactcaagtggttaagtacgtaaagcctaaccagtgacaaagcatttattccctccggaataaagtccttgagggtttccacctttggcgcatacgaacagccgggggggcggaaacataagaagaatattcgcacgaagagggggccaagggataaaggggtggcccagagatgccntggtacagaaggagggcgcccaataagaagaaagcggacacattataaagcaacaagcgacaggggacggccgaattaaaacagccgtcgaacggcggagacacgcgtagcactgacgaaccgttcgtggaacggacccacaccactggcgcggggcacacatgtgcgacacctcacgcaaggaataacacacggcaaaaacacacacggacgatgtgaaacaccatactggcggaaaag

SEQ ID NO: 528863 - DNA, 262 bp, Homo sapiens
tgaaagtatcgtgaccatgtggcccaccagcagcctttccaaaggggaactccagagacatttcataatgcaacagcacttttgctttaagaacaaggctttggaggtggctaaatcgcacgcacgttgtaaaggccatcccatctttgcctccagttggagctttcagctgttaaacagtcaggaactattgattcttcctttggaaaaactgctcaggcagacggggtacatccacagaggatcggacgaaggatgtaca

SEQ ID NO: 528864 - DNA, 833 bp, Homo sapiens
  misc_feature (316)..(316): n is a, c, g, or t
tggctcacaaaaggtatactttaatttttaaagggagtaaatccagtggccgggtgtgttgtggtggctctcccacctgtgttaatctcccgagcactttggggaaggcgtgagggcggggtggactcacctgtgagaggctcgaggagttccaagacatcgagcctgtggccaaagtgtgggtgaaaacctcattctctcacataaaaatttcaccaaaaaatttagcgcgagggtgggtgaagtggctgtgtatcaccttatataatctcccgagcttacctcgagggaggcgtgagacacgggaaaaactcgntctggaaaactcgtggaggaggggcgaaggtttcgcagtgtgaaaagcgagaaatcaaccacgcgagctgtggcacctcccaagcgcgtgggcgaacgagaagtggaaaaacctcgcggtgttcacaaaaacaaccacacacattcacaacaaaacacacaaacaaaacaaaacacaacaacaacaaaacgagagggggcggcggccctcaaaagaataattacccccgggcgagaggggggggccccccacaacacctctcagacgcgcgtgctatcacgccacagctttctcgcgcgttgcaaccacagagggggggccccccccaaaatacgaggaggaggcggacactatcacacacgcccgagagagcacggggggcgcggggctatcaaacaaaccgtggggagcaaagggggcaacaccaccggcgtaccccgcgcgagggcaaccacctgggggagaaaaacgaccaccccataacccccccgcagggggggcggcccaccacacacgt

SEQ ID NO: 528865 - DNA, 454 bp, Homo sapiens
  misc_feature (18)..(18): n is a, c, g, or t
  misc_feature (79)..(79): n is a, c, g, or t
  misc_feature (256)..(256): n is a, c, g, or t
  misc_feature (335)..(335): n is a, c, g, or t
  misc_feature (403)..(403): n is a, c, g, or t
tgttgccctgaaaaaccnaccacgtttgagttgaaagaaggccagattgaagagagacccgaagaggagactgggcctnaaagaggaggaaggcgagacagcaggggaggttccagtttcccaccatgcgggccaccgagagaacgtccccgggtcaagtctctggtctcggtttgtctagttcctgggagtcactgcagccagagccctctcacccctacttagctcagcccaggtggaggcgagattgagttgngcagccccgcccttccatcctccccacatcccttgcagccacctcccagcagagcaggctacgtcctcactgaggtgtntttcatgagagtactagcctcctccactcctccccacagctgcagaggaaacagccagcccagtgacnttgacggttattagttttgttttcctaattgtaataaattttattgtataa

SEQ ID NO: 528866 - DNA, 208 bp, Homo sapiens
aggggctttttttcccccccttttttttttgggggggggcccccccccctttttccaaacgggggggttccttcccaacccggggggggggggccccccccccccctttggggggggccaaaaatgcttttttttttttcccagggcccccgggtggggttggggcccttctccccgggttttttaataaaagaatttttttttttta

SEQ ID NO: 528867 - DNA, 762 bp, Homo sapiens
  misc_feature (267)..(267): n is a, c, g, or t
agaaagaaaaggacaggaaggaaggacatactacagaaccccgacagaagaaagaacgatagaagaaatcagctagctcaacatagctttcttgacgctagagttgagagaacttaggggcactgtccaagctgaggggacaaggtgaaccccagaggcctaggagttaggtagtccaggtctcggtctaacgcagaagccacagcggcgccatgctggctccgctacacttggtggccaccattggagaagcctctcggagctcgntccgccgctttgcggttcgtcctctgcagggccgtcatcccatgccccgaaggaggcgaactagggcctctgcttaacgacagctctggctggaccatcatcaggcaccgagatcgagtgggaagtttctaccttgcagcacgcagcactggcgtgtaccctggagccggtcgactccggtgcctctcatcagcaccctagagctgacgcggcgggggcgaggtggccacgctggagctccagggagagaagcttccacgcgggggctcaaggtgtggataggggacgtggaggcagaaaccatgtacatggagcccgcggtccctggtgtgcgtggtgccggacgtggcggccttctgcagcgagtggcgctggctgcgcgctcccgatcacaatcccgcatgagcctggtgcgcgccgacgggctctgtctaccctaggtgccttctccttcagctacgacccggaatacgagcgtgccggccgggtatcccg

SEQ ID NO: 528868 - DNA, 307 bp, Homo sapiens
aaaacacaaagtcaggtgccttcttgtcgatgggtttaatgacaaactgtgtgtcattgaaagagatgttcctgatttcactccaacgaaagccaatctttgctgttaacttatcatctttctcataaatattcagtccaagggcgatcaactgcaagccaaagggctgttcctttcttgatttttatctcgaaatagttgatgtccatacatttccaggtcctgagcaatcttcaggtattccaacctaacattatctttgagcatcccacggtgtttcgcatgccccactgctggcattaactaa

SEQ ID NO: 528869 - DNA, 159 bp, Homo sapiens
cattcccaaattaaagtaaaacactagtcacatccaagaaccttaaagcaaattggatacaaggtcagtttaatatccaaaaatcatttaatgtaaaccactatactaataaaggacaaaacccacatgatcctttcaatagacaaagaagcatttgaa

SEQ ID NO: 528870 - DNA, 115 bp, Homo sapiens
tcgactcaagacagacataagtccccttcccaggacaccaactacccagaggagccagacccagacctatcagcccaaggaatgcgatgatgtcaggcgtaccaggtaggagacg

SEQ ID NO: 528871 - DNA, 1001 bp, Homo sapiens
  misc_feature (891)..(891): n is a, c, g, or t
tgccgccctgtactagacccccgggggcggtttcctccctccgccggggttttttctagttgtcccgcgggtggggtaaacacttttctctcagccgggagagcctgttgtttgggctcccttctgcggcccttttttttggcggcccccctagttgtgagacggagtgttggtcggccacaaaaaccagggcggtgtgtggttctcctgctcccgtaggttttctcccggggagtgttttgttgccgcccgccgccctctccgcgtgtcgcggaaatcttctcagttagcgtccgttgctcttctggatggatgatccgccgtgccccctcccgcgaggattattcctccctcctccctcctccctacgatgagacgagggggtttgtacgcgcggggttcttctcccctcgcggcgtcgttctcttattattgagggcggtggcgcctcccccgctcctcatcttctgcgtcgtggactgttctctccgcccgccgcgcttggtctctctcttctctttttcagtcttcttgttgtgtccgtcgtgttgtactcactcttgtgtaggtagacagacgccgagcgaggtggtggtgtggcgccacgctattattagagtggggttcggcctgcgcgccctctctcgtcgcacgaggaagatgtccgttgtccaccacagggcagcgcccctctcctcttccccatcgctgtgtattttatctgttgctggtcgccgcgagcggagagagaaaacaaacctcccctctgttgtgtggtagaagagaaaaaatggggggcgaaaaaaaatgggggtggggcaccacagcggatattgttaggtggtggatacccccgcggtgccccacagtttctcctcccgcgcgcggcgntgaatccgaccttataaagcacgccccctctttttttttgttccaagaggttttttatttgggagcggccccctttttttaaaaccccaaaaaaaagtttaaacctttta

SEQ ID NO: 528872 - DNA, 353 bp, Homo sapiens
tcacaggattctatcaatagcatgtagcatctgtaatacacgaacatggtcaacaaaatcatgtacacttcaaccccatttcatttaaattaaagaacaaaaccttttaaatacagtggttcattcaaactattaacttccttagtaccatgctgcagattacagtactgttaaggtattgcaagaatgcccaaccctctgatgtctgatcatgtatctagcaacattgcagtatgaagaaaagagatgccccggtctcagcccatggactagttaatacagtgaagcaggttcctgtctttaacccttcctgctcagaacataaaagattaagagactaaaatcaaggaaga

SEQ ID NO: 528873 - DNA, 633 bp, Homo sapiens
  misc_feature (495)..(495): n is a, c, g, or t
  misc_feature (593)..(594): n is a, c, g, or t
  misc_feature (609)..(609): n is a, c, g, or t
  misc_feature (629)..(629): n is a, c, g, or t
gggggggaaatttatttttttccccccccggcagagaaaaaaaggcccccccccccctggggggggggggggatactcctccccgggggtgtgtttggggggggggggggggagaaaaaaaaaaaccccccccccccccccctccaaaaagaggaaattttttttttttttttttttctgttttttaaaaaaaaatttggtgccccccccccccccccccctttaaaaaccgcaaaaaattctggggggggggggggttttttttccacaggggggggggcttaataggggggcgctttctttagggcgctcttaaaagaggggcccccccccaggggggcccgaaaaaaaattttttccggggtgacccgggggtttctccccgggccaaaaaaagggggaaaacccaggttttttaagggtcccttgggaagggggaaaacctttccttgcccagggtggggtttcccccaaagggggtcggtaattcccaanctgcatttgggccagtttaggaagtaagggggcccatgaacggtggggcctcatatccaggcaaagaattggccgatgtagttcatcttctccacagnngtgtgtgtggtgtcnccatacgtctgcactacagnaaac

SEQ ID NO: 528874 - DNA, 162 bp, Homo sapiens
  misc_feature (12)..(12): n is a, c, g, or t
ccggcaaggtanctgtactggtgtggctattacatattaagtttagtcctcatattttaaggagtttgcatgaagcaagatactaaatacaatgtagcactggttacaggcatctttcttcaaagtgctcaaagacttaattgcagtacaataccgtccgtc

SEQ ID NO: 528875 - DNA, 205 bp, Homo sapiens
cgggcgcaggtgcacaccatgatctcccccgtcttgatgccacggtcggtccggaactgagcgcagcaacttgcccggcgcgtaccgggagatcacctccatgacggagggcagcactggccggtgagtgcacagggccaccggcacatcccgatgacgcaggacatcggagacgaccttgcgcgccgccttgcgggaatcggcg

SEQ ID NO: 528876 - DNA, 418 bp, Homo sapiens
agcggggacaactcactagttatggtggattcaaagactccctgatttgtgattggttaacggaagcaaagctttgtctaacaacttggggtccgcagaaaggaacattaacggtctggccaggcccctcaggaagaaactgagagcaaagaatggaggtcagagtttagtccctggtgttcccccttatctgacgtctttgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtggga

SEQ ID NO: 528877 - DNA, 315 bp, Homo sapiens
  misc_feature (165)..(165): n is a, c, g, or t
cccggggggggttccccccccgggttttttcttggggcggggggggggttcctattttcccccggggaccccttttgccctttgggcctttttgggggcccctttaacccagttttgtccaaaaaaccggggggggccggggcgggatttcccggggtttttttnccccccggggccccccccaatttttttttttttttttccccggggggttttgggggtttggggccccggaacccccccccttttgggttttttgagggggaattcccccccccccgggttttttttttttttttttttccccccccctta

SEQ ID NO: 528878 - DNA, 164 bp, Homo sapiens
agcatgcatctggttctaatgcttgtacagtctcttcaaactgcattttctgccttttaagtatgcttgtaatttgctgttgataggtagacatgatacactgggtaaaaggaattgcagtaaacagggctttcatcctgttttcaggtgttggggataacata

SEQ ID NO: 528879 - DNA, 265 bp, Homo sapiens
ggcctgtctagtgagagacagctaatgtgacaaaagtaaaatatatcagatggtgagacaaccgaaaaatgagatcagaagtggagatgttggggccaggcacagctggcccaggcctgtaatcccatcactttgggaggtgcaggcaggcagatggcttgagcccaggaattcaagaccagtccgagcaacatagcaaaagcccttatctgcaaaaaactcaaaaattagccaggtgtggtggtgcgtgcccagggcccgagag

SEQ ID NO: 528880 - DNA, 199 bp, Homo sapiens
agaaccagatactgaaatggattagaaactattaaaaaaagttcactatttacttttttatgtaggaaaatatggttataaaggaattggataaaacatacttttactagcttatttggttaattggtaaagggaccaagtggagcctgcactagtggtaaaagatagattactattaaatgtttcagataaaaggttt

SEQ ID NO: 528881 - DNA, 355 bp, Homo sapiens
aaattttcactaggaggggagttcagcagtcttcccaaatcctgtgaccagcaaaagctttccagtcatctgatgagaaggcagcagcaggcattcatgtgtatccacaccatttcatcttccaattcctttttatacctgcgaagttttcattgtgcatggaaataacagcacagagcagaaagtgcacagtggtgatagctggttattgaaatcaccatagaaacccctcataaacacacactctcacatagttgtttacgaaaacacacacacagccgctcacacaacacacaccaatactccacacaggtgtgaataggaaccacctctctctaacaaccatacgagggca

SEQ ID NO: 528882 - DNA, 415 bp, Homo sapiens
actgcagtctcgaattgatcaggcctgtcatatcatcttagagctagcgaagaatagagcaaacggaatttctcgagactgatctcaaacagtttcttatatggattgccagctataataaaccataaagccttcaatgtctacttcccacatgtagaaactgacatcttcaatgtcactctttcctgccccccacttttgagtgccttccctggagactgtggacggatgaccacaaacgggtacactcacagggggggacatggaggacggcggacgagcgaacggacggaggacgagacacgctggggaacgtggcatgctcctgggatgtagatgagactgtctccagaccagggaccacagcagcagcaagtagcagaacgcagcaagtcgcagcacgcagcagcaggag

SEQ ID NO: 528883 - DNA, 179 bp, Homo sapiens
cggtgtatcactttgtctacaataaatataaaaattagttgggcatggtggtacactactgtatagtcccagctactcgggaggatggcttaagcccgggaggaggaggttgtagtgaaccaagatcacatcactgcactccagcctggcaacagagcaaggccttgtctctcaaaaaa

SEQ ID NO: 528884 - DNA, 327 bp, Homo sapiens
tccgtacgagcgctccgtacgtacctccgtaacagctttcctgtaacgagcgcctcctaacaccctaacgagcgcctccgtaacagccctccgtaacgagcgcctccgtaacacctcagtggtggtggtggtgggtgttgtctctgaggtgggtgctggtgtctctggtgggcgctgttatctctgagttgggtgctggtgtctctgtggtgggtgttgtagtctctggtgggtgctggtgtctctgtggtgggtacagttgtctctgagttgggtgctggtgtctctgtggtgggtgtagtagtctctggtgggcgctgttacgga

SEQ ID NO: 528885 - DNA, 130 bp, Homo sapiens
tgagaaagaagcctgtctccatcttgctctgtatccgctgctcttgtgacgttgtggagatcgggagcgtctcgggctgtgctccatggcgagctggataccatgtttgttgtggaagtccccgtgtttt

SEQ ID NO: 528886 - DNA, 83 bp, Homo sapiens
tgtgaccccagcaggatgtctaaatatgtcttttttttgttgtttttttaataagacattgcaaacagtagctatttcttatt

SEQ ID NO: 528887 - DNA, 138 bp, Homo sapiens
cgactcatagaggatacccagactgtcgatcaagaatagtacaaacggcattcacatgtcttcagaattagccgttccctcagaactcttgcaccacgaggtggtagcactgcccagtgtactgggtgtcttctagag

SEQ ID NO: 528888 - DNA, 958 bp, Homo sapiens
ttcgtattcttggctagagcctgtgtcttgtgctattagagcacagcacatgatggggccccagttgtgagaagtacccgacatttccagcatactcagcctcttcgccataactccctttccgaagcctgcgagtggcgaggttctaagactggaattatggtgctagcattagtaccatgagtgacttggaagtgagctacgtagtcttctttatcggtttgcgatttttacgtaccttgttccaatatagaaaaatggatgagttttgtatagcatggtcagatacaaataatagtgacttcacagtttagtaattataatgggtacttgttagaatattaggtactgaaattgatgttgctgcaagagtagatataaaattgagtatctatagctagtttctggtgaattatgcattttatttggtactgtaagttaggcagcactgtagttgctaatttaagcaataagtcaatttgctattcatgaagaaacggattcctgagaatctctgtcaggaattggggaatgaaaaaatacggaaaataatggtactttgtcccagtagaggttcatagtctatttagtgtgcatgtatatccttaaatgatgtattttgatctgactttgtacttgtcaatagaatcatactggggatttcaggtaccgtttgatgtttatgctggataaggtgaaaaagttgggtacagggagatttataactttttcacgttacacaaggtattagtattatcctttgtagtgaattggttaccaaagagagtattagccaatgtttagtgaaatcgggggttagaaaaattgtggtgcataggggaaagggagggtttcacagagacgaattctgggttgggcaaagtgacaccccggttgggtgcagcgcagaattgattaaaggcatgagaacaaagagagacagagagatagtataagg

SEQ ID NO: 528889 - DNA, 113 bp, Homo sapiens
gtgacctgggctagaaatctctgaggactgattaggctaggcctaatagggcatctccaggatccattcccaagctcccaattccataagaccagtagagcggttttattttg

SEQ ID NO: 528890 - DNA, 388 bp, Homo sapiens
ccacgacaatggcattcattgaatttgaagagataaacttgactgagttgtggggagacatggataatcagaaacacatttatgaaggttttgacaaagtgctcttggagatgaatacattactttctgcaaatcatgctagcaaaacccaaagtaaattattagaaagtccagatcaacctaaacttaacgaacagagaacatcaacaccatcaccaaacccgccagaacagcagagaggagtaactgcagaacaaggaccacaaagaatttcaattgaagaacaacaacaaggcaaaaagccaactgcagagcaagaactgtacatagaatcagtaatagaaccaggaacacacacagagtcaactctagaacaagggtcaagtag

SEQ ID NO: 528891 - DNA, 102 bp, Homo sapiens
cccatgtcagcctatcaggtcatttgtgtccagccactgcatcaggccagcacagcatcatcacctgcaggcaggccattccagatgcatttccagctgcac

SEQ ID NO: 528892 - DNA, 359 bp, Homo sapiens
tgagtatagcataagcttgaaaattattcacacccggctgggcacagtggctcatgcctgtcatcccagcactttgggaagccaaggcaggcagatcacttgaggttaggattccaagaccagcctggccaacatggtgaaaccccatctctacagaaatacagaaattagccaggtgtggtggtacatgcctgtaatcccagctactcgagagcctgaggcaggagaattgcttggacctggtaggtggaggttgcagtgagctgaaattgcaccgctgcattccagtctgggtgacggagtgagaccctgtctcaaaaattaaaaaaacctttttatcctaccacggtgctataacg

SEQ ID NO: 528893 - DNA, 180 bp, Homo sapiens
ctttaaaaaaaaaaaattttttggaacccaaggggcggggggtttttaaagtttttcctttcccctttcctcctttttggggcccccgttaagcctgggttagggaaaggggttttgggggttggggttgggggggtcaaaaaaaaagagggtttttttcccataaccttggggcaccca

SEQ ID NO: 528894 - DNA, 110 bp, Homo sapiens
tctcccaattacaaaggtcagccattggattaacctaataaaccaagggaccacaacaagaaccccttcagaccccaaaccaggtctgaccccatcttggtcttatcgag

SEQ ID NO: 528895 - DNA, 445 bp, Homo sapiens
cacctctgaccgagttccctcccctgaggcaactacttgttggaggccaaaagaatgagggtcatgatcaactcagtataccactggaggttatatgagtaagcaggaaactgtttttcataaatgcagaatgttggcaaactgacagactgcgtatgccacccagaaggaatgctgaaggcagtcatgcccaaagcacagtgtttcttgtgattaggtacatctgacgcctgttagtaacagtatgaacctgtgatcaattaagcagctgaccaatccttacctccttctccctgctcttgttacccaataaatatgaagggctgtggaagctcaggggctgcctttgctcactagaagcagggagctcttttcttcttcccctggcccttcctttaagacagttcctttcgtttctgggtgatttccatgtttgtcccttcct

SEQ ID NO: 528896 - DNA, 863 bp, Homo sapiens
  misc_feature (25)..(25): n is a, c, g, or t
  misc_feature (118)..(118): n is a, c, g, or t
  misc_feature (161)..(161): n is a, c, g, or t
  misc_feature (187)..(187): n is a, c, g, or t
  misc_feature (189)..(189): n is a, c, g, or t
  misc_feature (204)..(204): n is a, c, g, or t
  misc_feature (258)..(258): n is a, c, g, or t
  misc_feature (264)..(264): n is a, c, g, or t
  misc_feature (317)..(317): n is a, c, g, or t
  misc_feature (352)..(353): n is a, c, g, or t
  misc_feature (360)..(362): n is a, c, g, or t
  misc_feature (400)..(400): n is a, c, g, or t
  misc_feature (426)..(426): n is a, c, g, or t
  misc_feature (433)..(433): n is a, c, g, or t
  misc_feature (467)..(467): n is a, c, g, or t
  misc_feature (475)..(475): n is a, c, g, or t
  misc_feature (515)..(516): n is a, c, g, or t
  misc_feature (522)..(522): n is a, c, g, or t
  misc_feature (525)..(525): n is a, c, g, or t
  misc_feature (528)..(528): n is a, c, g, or t
  misc_feature (574)..(574): n is a, c, g, or t
  misc_feature (592)..(592): n is a, c, g, or t
  misc_feature (599)..(599): n is a, c, g, or t
  misc_feature (635)..(635): n is a, c, g, or t
  misc_feature (697)..(697): n is a, c, g, or t
  misc_feature (722)..(722): n is a, c, g, or t
  misc_feature (725)..(725): n is a, c, g, or t
  misc_feature (780)..(780): n is a, c, g, or t
  misc_feature (849)..(849): n is a, c, g, or t
tcggtagcttttcttaatagcacanctgtatgttaacataaaacaactttactttgtcttccattctccctttaaatttgttcaatggtgttaattatcctttttcccctcaaatganagtccagacatggtcattcctggatcacaaaatatcagttccncttagtaattcggttttccatttttntntgataggtaaatctntctgcattaaattttatgctttcatgtggccaggtgtggtggctcatgcctgtnattccngccctttgggaggccaaggctggcagacacctgaagtcaggagtccattaccngcctggccaacatggtgaaacctgtctctactaannatataannnttagctgggcatggtggtgcacggctgttattccagcnactcgggaggcagaggcaggagattnatttganctcgagaagaggaggttgccgttagccaagaccncaccactncccttcagcctgggcaacagagcaagattcagtttcaaannataaanatnaancacttcatgttttttccttccacatttcggactgatttagctaganaatttcaagggaaaaggnaaactgncattctttctcccctgttttgctacctacagcacanggcccttcatcatggagttcagggacaggaaaggacaggagaattctttcttcactgaaatnatttagttgatttagcttcactgcnctntgggtttggcattaagtaatccatccttgtattgtggaacagtttcacggatgcnttggagagcccatggctggaattcttccacttgcaattttctttgagaaaaggcatatccattccagcnggttgtttgctcct

SEQ ID NO: 528897 - DNA, 988 bp, Homo sapiens
gtgatggtgcgagaaagtaccagattcaacttatgaaatgattggtggactgggacaaacagatcaaggagatcaaagaagtgatcggagctgcctgttaagcatcctgagctcttcgaagcattgggcattgctcagcccaagggagtgctgctgtatggacctccaggcactgggaagtactacttgttgggcccgggctgtgggctcatcgataacgggactgtaccctttattccgtgtcatcttggcatctcgaattgcgttagagcatacattcattacgggggaaggcgcgcacagaatggtgtggcatgggcagctcgttagtcaattgcgctactggcggaaccattgcctccgatcgttatcatcattcatggcaccgaaggtcgcactcacatcaggatccgtcgcgagcttggatgggaggtgttcgtggtagggagtgatcagtgaaaagatagcgaagggctagcagatgctgtgagttgctcgaacgcgaggctcgacggcgtattcgaaggccactcgaagtagagcatcgaacggttatcatggctactaataggattgatatcctggatctcggcactgttcgcccagggcgcattgaccagaaaaattgaattcccaccccccaatgaggaggcccggctggacattttgaagattcattctcggaagatgaaccttgacccgggggatccaacctgagaaaaacattgctgaggtcatgccaggagcatcaggggccttgagagtgaagggcgtgtgcacagaagctggcatgtatgccctgcgagaaacggggagtccatgtcactccaggagggacttcgagatgggcacgttagccaaggtcatggcagaaggacgtggagacaaaactgtccttcaagaaactttgggaactgagtggccagctttgtggtgttttcccccaatagggccctggggggccagtggaaatgcaaaaaggagaaac

SEQ ID NO: 528898 - DNA, 1217 bp, Homo sapiens
agcgggcgactcccacctcgcgggcacgccggtgggctgtgccgccatgccccagccacaggctgctcacgggcctaggcgcggcggcccgacgataggggcccctgagcctcccgggggaggagagaggcagcgagccgcgcgctccgcccctccccccagggcgcgccgccgcgcctcgcccgcccagcctggcgggacaaggacggaggagcaagcaggcctccgcggcccggcgccgccagccgcaggacatttctgattcatctgcatccttgcaacgagcatctgtagaagaggaagtaccagatggcgctgtgaaaacatttactcatagctcctcttcccacagccaggaactgcttgcgaaagctaaatatgctgcgaccactgactcggacatcccggcggatactcactacttcgtgtccaggaccaaacaatcttccgggccacataaggtgcgtaactacgcaagcttgcagtgacttcctttcgcaccaaacttgtcaggccaagcccccaggacttgacgcaccaacggaactgctgctgcggcacactcctgcactcactgcttacccgctgaccccggcccctcaactcccctccattacaggaaaactactgcctctgacacacgcccaccctcttatcacaccttaaacacaccagcaaccactaactacgtcgacgtgactccctcaccacggcaacgaccacgccaccagaagttgccccgccgcgggcccccgccggtccgcccacggaacgccctgccctccacgaccgttcgaccgcaaccactccaggacgatctcactggacaacgtcgaccacccacaaaacgggcccaaccgcacgccacaccgccggtcgcacgacacggccctgggccacacacaccacccacccattaccaaaacgctgggcacacatagtacgcgatgaagacccgacagaatacggggaaggactctcgaccaccacgcaggcatcaacacacacagatctgacacacgggacggaacaagaaacacaacaacaccaacccacacggggcacaccgacccgaacaacttacacacccgaacccacgagccgccacgcgaaagcagcccacacgcacgcacacccgccacaccgacagaacacgaggaccacgaccacaccacgcagacaccacaccacacgaccacccaccgaacaccacaccg

SEQ ID NO: 528899 - DNA, 678 bp, Homo sapiens
tcgagatagaaacattcctggggtatgtgctgggggaaaacagggcttccttcttaaatggatttaataagagattcagtggactgaccaaaggacaaatacagggtctggaattttccacctatcactccctcctgggttgatgaagacctcaagactgtctcttcagtgtcatgggagtctagatgggcattggggtgtgagttattttccttccactaaatcaaagtcctctactttttactatttttctttctagctttttggggattaatgactatcatcagaaggaattgtcaatgtaaagaaacctggcctttttgagttgaaatcttggcttagataggccttttccacactaggaggaaactgcttcccaagctgcccttgttagaaagttggaagactcctccttttggttccagttccttttgtgcacattccgtaggactcacttagacttggtgctattttctaattttctctttctctctttcttttgtctcaaatttctttccagttggctgagaaagcagatatattctgtggatcaaaccagaagaaacaggtaagagtcattcagttttttttctgaatcactttggattttcgatcctcattctatctttaaaccttccaagggggtgggagcatgacttgtcgggagcaaggcctcac

SEQ ID NO: 528900 - DNA, 378 bp, Homo sapiens
tctcttttgctaaaacccctgtgatttgagatggagtaacactctttgtttgcccaggctggagtacaatggcgcaatctcggcttaccacaacctctacctcccgggttcaagtgattctcctgcctcaaactcctgagtagctgggatggcaggcgcatgccatcatgccccgctaatttttttttaaattttttgtagagacttggttttgccatgttgccctgggatcaagcaatccttccaccttggcctcccgaagtgctggaattacagacttgagccactgctcccggccattgttttttttggttttggtttttgtagttggtttgggccttttctatctctttagtcttagttgtaaccaagtcatga

SEQ ID NO: 528901 - DNA, 383 bp, Homo sapiens
  misc_feature (23)..(23): n is a, c, g, or t
cacatgccagagccagacattcncaggaccccccaccagccctcaccatgtgcatttgatctctttccctaatattggatcagtggctttccacagggtccttggatcctccatggaaaatccccccaaatctctgctaattaacttttttcaaaaggcggccaccactttatcatggtcttttttttttttttttttgaactctccttaaatgttctgaggacactcatacatcccatttgggattcactaggccaggtgctgtggctcacgcctgtaatcccaacactttgggaggcttgtgaggcccaggcaggagaattttttggggccaggcattgaagaccagcctgggcaacacagcaagactccatctctacaaa

SEQ ID NO: 528902 - DNA, 220 bp, Homo sapiens
gccgaaatgttcattgtgggagcagacaatgtgggctcaagcagatgcagcagatccgcatgttcccttcggctggcgaaggcgctgtgggtcgctcggatggtggcacatgaacgacccattggattgcgggcaaagtggcccattcccggatgggtggcacccttggtggaaaaaacaaaacccaatggcttccttgcggacgaaaaacctgtggctg

SEQ ID NO: 528903 - DNA, 531 bp, Homo sapiens
  misc_feature (48)..(48): n is a, c, g, or t
  misc_feature (50)..(50): n is a, c, g, or t
  misc_feature (110)..(110): n is a, c, g, or t
  misc_feature (136)..(136): n is a, c, g, or t
  misc_feature (149)..(149): n is a, c, g, or t
  misc_feature (209)..(209): n is a, c, g, or t
  misc_feature (212)..(212): n is a, c, g, or t
  misc_feature (294)..(294): n is a, c, g, or t
  misc_feature (326)..(326): n is a, c, g, or t
  misc_feature (349)..(349): n is a, c, g, or t
  misc_feature (366)..(366): n is a, c, g, or t
  misc_feature (421)..(421): n is a, c, g, or t
  misc_feature (460)..(460): n is a, c, g, or t
  misc_feature (466)..(466): n is a, c, g, or t
  misc_feature (472)..(472): n is a, c, g, or t
  misc_feature (518)..(518): n is a, c, g, or t
tgtatgttatggtagtgtagaaaactgggcaaggacactaaaagtcananaaggcaagggaaaagggggctccaaacacagcctctgccctgtccaggccctgtcccctncaaacagggtatcacagtgacctccnaggccgggaacgncagctcatgcctgaaatccaagcactttggaaggcctgggcacaaaacaagaccccaacnacngcatttaaaaaaaaaaaaaaaaaaaacctagccaagctgggcgggtggctcacacctgtgatcccagcactttgggaggctnaggtgggtagatgacctgaggccaggagttcnagaccagcctggccaacgtggtnaaaccccatctcaaacnccgtctcaaaaaaaaaaaaaatagtgtgtggtggcacacgcctgtaatcccagcnactcgggaggctgaggcgggagaatcatttgaaccccanaggtgnaggttncagtgagccaagatcgccctactgcactccagcctgggcgacaggnagactccctctca

SEQ ID NO: 528904 - DNA, 232 bp, Homo sapiens
ttctcttctgcctattcttctagaccttagaagacattcaatttttttaaattcctgtagctcaagctggtcttatttgctttccttgccaaggcttcattgtgtgtataccaatatttgtgtcctctactgacctgaaggttccatgtaacctgtatacacatgaatacttaaatgccaaatatttaaaataatttgataaagtctttgtagccactcaagtcaaaaaaaa

SEQ ID NO: 528905 - DNA, 141 bp, Homo sapiens
catgatgatccatattatgtctacgattggtgaaaacatcctagatgtcatcacaaactcgccaaattgtggaactatgaaatgtattatttgtagacataaggacttgattgctttccagtttaatgaaagcttaaatgt

SEQ ID NO: 528906 - DNA, 299 bp, Homo sapiens
  misc_feature (182)..(186): n is a, c, g, or t
cggggggggggggcaagaaatttgggggttttttttttccccccccccgggggggggggggggttgggggggcccccaagatttttttgccctgggttgggtttgggggccccttttttccccccttgggggggaaggggcccctttgggcccccggggtgggggcctggagggttaagaannnnnagggaaaccctcctttccccccccccccggcccccggggggtttttttttggggcccccctgaaatttcccccccaacggtttggggggggcctttttttggccagggaggga

SEQ ID NO: 528907 - DNA, 328 bp, Homo sapiens
gaaattcatagtgaatctggcgtctgagcacggtggttcaggctggtaatctcatcgttctgtgagtccgaggcagcaggtatcacattaggtcagaagtttgagactaagttggccgacgtggtgagtctccctctccgctagacatgctagaattctccagtgtatagtggcttacgtctgtaattccagagcgttggagaatgaggtgtgataagtgcttgaacgcaggagtcagaggtcacagtgagacgaggtctgtcctctgcacaccagactgggtgacatagtgagactccatcgcaaatggtagattagtgcactgaac

SEQ ID NO: 528908 - DNA, 499 bp, Homo sapiens
aagtgtacacatacaggctattggtaaccacgtattctaagaatatggtaagtacaaactaaacatactgaagatgtgtgcgattctaagtttcataccagaagatttctacactaaccacatcatttactattaatgacacattaaaactagtaaaaagctttattacataaataagttacactcgcttccagcttacagtataaaacaattttatttcgcacggacatgcaaaatgattgtttgccactgaggcacttcttgaacatactgaccagtgtctggattttcttgtgtacaattcgcagttcacgtggggacactggtcgtgtttaaaacccttacacttaatgtatacaagctctgtatcttcatcggtggtgcctattaggatatgtgatataagctgcagtatccctttggcgaaggggggaggcgattactttacctcaagtcctaatgaaactataattttcatcttttcatcatttggcgcgca

SEQ ID NO: 528909 - DNA, 323 bp, Homo sapiens
tatgaacagcaactacaaatacttgattgactaacactagtacaactaagatatttatagtacttaccatgcaccggagagttcacacacattattctttgccttttgaccattttcctcctttgagataattgtctcctcatctgtctctcctctctctcctttaggcatttcatctgtgaaactatttatatcccttaagggatgcccctccatatctttatatctacttctccttcatcccagctccaatattgtgtcttaccatcattatgttttgtaaaaggaaaaaagaagccattccctactttaaacttctctgc

SEQ ID NO: 528910 - DNA, 113 bp, Homo sapiens
  misc_feature (109)..(109): n is a, c, g, or t
tatgtgtaagaattttatacttaaagtatctgtagcttttggggtgaaaaaaaaacttttctaggttgggggttgtgaaatttaaatgttacacacaagaccctgtttnaaaa

SEQ ID NO: 528911 - DNA, 220 bp, Homo sapiens
cgtagcagaatatcataagttatatctccagatgaggttttcagaatttcccagtgatatcggagaaaataagttgtttacttagtgatgtctgataccctggcataatcactttatataccttagctcgttgaattctcataacactgagatacgggttgtcattgcccccattttatagatatgaaaactgagactcagagaggagaaatactttaac

SEQ ID NO: 528912 - DNA, 178 bp, Homo sapiens
cccgagcttattatgttgacagcatactatgctgtacctttccccaccttactcttttttggaacatcaaaaggatctgacgaaatgcattgacaataggtagtaactgctgctgtcaatctccaaacacacttatgtagcaacattaaatgctgacatatctgacaatccctaatat

SEQ ID NO: 528913 - DNA, 1244 bp, Homo sapiens
agggaactcgggggtgtcgtgacttaactagtggtttctgtgactgggtaacctccctataacattaaaacgacaaaaaaaaaaacaacacaaaaacaaaaaaaaactttttgggcccgccccggccccctgcaaacacagctatataagaccccatcgcgtgtgcgagcgcggcggggcccccacagtcgcggtcagaggcgcacccgtgtggccaagcacgcgggaaccccaaggagaaacaacccggggcacaagcacccagaggggccggggaattcccaccacacaaactatacaacaacacagcggcgcgggagggggggacaaacccccgagacgactgaccccgggacaccgacactcctcccaggaaggggaggcacaccacccgagggcggcccccaccagcggggggaacctcacgactcccacacagggaggagcacccaaagggcagagcaccccccagagataatacacaacaagaaattatcacacgccccagacgaggggggggggggaaacacgagacagagacaaacaacacacgacagaaagcgcacagaaacacacacacagaacaaacaccaagagccacagaaggaacacaaacaaaacgaagaacccccccaacaggccaagctacacaacgaacacaacaacagcacaaacagcagggaggacacgcacgacccaggcgcccggacaggagcggcgcgacgcgaaggaaagacgacggggggcgggacggagagagggaggaggacggaggcgaggaggaagcagcgaaagggagccagcggccacgagcgcgagcggaccgacgaagaggcggagacggaacgggaacgagacgagcgcgaggagggccccagacagacaaaaagcagagaggaaaatagcgaaggacagaccccgagcgcgacggaacggcgaacgcagaggagagcggaggaccgagagcagacagacaccgaaagaagagaagacacagggaggagagagacgaagaaggaggaaacaagaaagaacaggaaaaggaacaggaacaaagagaagaaaaagaagaaaaaaggagagaaaggagacgagcgagacaaggaacgaagagggacaggcgagcagagaaggagaaagggaagaaggaagaaagaacaagaaagagaacgacacaggggcacacgagagaaggacgaagaagagcgcagagcggatccaagcagcgagacgagaaaaagcaa

SEQ ID NO: 528914 - DNA, 147 bp, Homo sapiens
gtttaagatgattcagattatccttgtacttggaggagaagtttcttatttggagtctttgggaaacagtcttagtcttttaacttggaaagatgaggtattaattcccctccatgctctccaaaagccaataaagtgattacaccc

SEQ ID NO: 528915 - DNA, 447 bp, Homo sapiens
aagaatatctgaaaacaatgttatcttttcctcatataaaggaaagctagagacaggcattcccagcacaggtacaacaacaacaaaaacacttttagggacatcaagactttttgaagacacagttttactctgttgctcaggctggagtgcaatggccccaatctcggctcactgcagcctcccacctccccaggttcaagcgattctcctgcctcatctcccaagtagctggaactgcaggtggccactaccacatctggctaatttttgtatttttagtagaggcagggtttcgccatgtggccagactggtctcaaactcctgatctcaagtgatctgcctgccttggcctcccaaagtgctgggattataggtgtgagccaccacacctggccctaggacataaatcttttttttgtgacagagtaagactccatctaaaa

SEQ ID NO: 528916 - DNA, 185 bp, Homo sapiens
aaaaaattttttaaataaggacaatttgtcattatttcagtatatgacaatatatattgacaatgtcaatatatgacaatatgtagacaaaatgtttacgttgtttatttggtttgagtgtgagaaagggaataatgatttctttgttcaatggaccgagtcgcccacttcctattaaaataggc

SEQ ID NO: 528917 - DNA, 396 bp, Homo sapiens
ttatggtgggaataaggagtaggctaaaggtagacagcatggaacgagagaggccagcacagtatgccggggtggaggggtacccgaagtcctcctggcccacgtttctgttccttactctgttcactagcttcatggagccactcagtccttggatagcagtggagcaaccatccacttagccgctcattgaccaacccacccacccacctgtccatcatccatccacataccgtccattcactcttccatccattcacccactcatctatccccccatcatccatctatccctcatccatccatccatcatctacccacccacccacctatccacccatctacccacccatgcacccatccatccacctaccccaccactgactcgtgccccac

SEQ ID NO: 528918 - DNA, 410 bp, Homo sapiens
  misc_feature (359)..(359): n is a, c, g, or t
ggcacgctcctgggcgtgccaggagagcagaagctggaaaaagggtcactcgttctaaccggagcgtacacaattcttcggcccgagagtcctgcgccgctccacgggggactgagccaaggatgtgttatcgctgagccaagttccgcaccgctcaggaccctgctgagccgagcaccttcgccactccgccgcagagactcccttgccgggcgactctcggagacccagggcgcggagctctgcgcagctaggctcaggactcgggcgcgtttcagacccaagaccatggtttcttaagcacggccccgcacccctttcctcctcgtcgcccgaagcccaggaccccaagaagggcncgcagtgcttggtccctagttccagcccctgctgcgccagcggggcagctc

SEQ ID NO: 528919 - DNA, 505 bp, Homo sapiens
gctagactaatcatgctatggtcatattggagagacccatctttcaagggtggaagaaactctggacttggcatcagaagacttgagtctgagcctcacatctgcccgtgctgagctctgttgccttgagcaagtcagttcatcaaaagtagaagatagttatcattaattttatcatcattattactaccagtagtaggaactctctgaaattcaatttcacaatctaaaagatagataatatttgtgtaagcatcgtcagaaggtttaaatggaataaaagatgtggaagtgcttagtaaactataaagtaattcacaaatacaaaatattaacaccaagagacagcttgacgtgctagaaagagtttgcattggcatcagacagatatggctgcttacagactgcttcatctgaacgcatcacttacatgctcagcctcagttttctatcagtaaaatttcttagtgtaaatctgtaaaatgttctacccatgttacaaacc

SEQ ID NO: 528920 - DNA, 471 bp, Homo sapiens
ggccgaggcgaatcgcggaacaggtcagccgaaagtccaggtccatctgattcactgcatcggtttgtggcacggtgatagcgtccatcgggaattctccaaaagtcaaaaagcgttgaacttgcttttggtgatggcgaacatcaacaaataaccgatgacttgcccagatgttgactacgggcttcgagcagcggagtggttcaacggcgcgctgatcatatcagaatatcggtacgtgttatgattctttgcgattatttgctacgaattttcgatctgccaggccatcggcctcaaaatggtgtcacttgcatccaactcgaggagctcggtggtaggcagcaactgaacatccagggcgctgttcaccgtctgtaccacgtcgagctcgtgtgcaggagttgagtgggggccaatggcaatacgcacagaacctgtcaccaaaacgagttgtccgcctgcggcgtt

SEQ ID NO: 528921 - DNA, 177 bp, Homo sapiens
cgtataatacgtcctcacacgtcattctcaagcccgacaaaacatatagccgaccccttccttgtactatccctataaggcttacctcataacaagctccatctgcctacgacaaacagaccttaaatcgctcattgcatactcttcaatcagccacatagccctcagtaagcttgt

SEQ ID NO: 528922 - DNA, 1284 bp, Homo sapiens
  misc_feature (795)..(795): n is a, c, g, or t
aggttgccgtctggtgttgcttgcacagacaagtatttgtgtggccccggtgtgttatcacacaacggattcgccgggggggcgccgcccacattgttttgatcgaagggggggggccgtcccaaatagcggccggtggtgttgtgcaacaaataagacgtttgaggagagagtagttgttgtcagcaggcaccgcagggggctgtccgcccccccttcgtgtgtgtggtgtttgtgtttgtggtcgcgccgcctcttgttgcgccggcagcgcacgcgccccccggtgttgtgcgcaccacgtcccgccctcactgaggtggggcggcaaaggggggagacacaacccccgccccactactccgtcgaatgtacaccccccgcggggggcaacgacgccggggcgcaccgccgcggcgggaagaaagacgggggagcacaacacacggcaggtgatctcttcacacacggcagcttttttctcactcgtgggggacaacagccagcccacaactgccgtccgattgtagacacccgctggtgggtgtgtcgccaccgtcggttcccaccaacgagggggccactcttgccgctgtgtcgcgcccacaagaggggggacatctcgcgcctctcttctttcgtctcctcacgcaaacagagggggtgtccaccctctcgctcgcgctcgtgtctgtcctccccaaacagagagagtggcttatctttctccaagagggacaccctcttcttctccgggggggcgtctcccgcttggagaggccacaccccctcgcnccgcactatttgcgcacaaaatatggtcttcggctgcagagagtgtgtttctctctctctctcccccgctctcgctccccctcgcacagggggccacacaagggggttgtgtgttaaaagggggcgacaccctgtgagagacacacttgtgaaaacagcggtgtgtttccccttcttctcacttaattatttttctaataaacagaccacacccagactgtccgaaggcgccataatagagggacccaggcgcgtccctctcttttcttgtaaaagagaggtagaaaatttagtggccccggtagacccacggccctgtgatacagcgccctctacaccgccaacacgtcccagagtttccgcgttttgcggcaatttaaatttgtgcgggaggggaaatgggtttaagaggaataaaaagaggcccaaaccaattgtaaatagaaacccgttttcccctttccttttttttaacacaccaacaaacca

SEQ ID NO: 528923 - DNA, 353 bp, Homo sapiens
gtccccatttatgattttgaattttaaagttggaaagttctaagtatcaaagtttttaatataaaaggcgggtccaatctattcataataattttcaagttcaggagccgcagagacgcccaactttacacttatcatttctaccagtttatgggataaagaggttactcttctatttacggttaaaaacgggaagggccttttttaggcctttagctttgttcccccagtaataaaaaagttaaaaaaggcttccctagtcacccattccccaaaccatttggggttattcccattccccggcccatttcttgttattcacatggccagtaaaacaattgttttttaaatta

SEQ ID NO: 528924 - DNA, 113 bp, Homo sapiens
gctgcggttattgacttagaggatccccctgtggtgtttaacatggacccttaaaatggttaccagtagtgaagcagatgaatgatgtctatcatctcacacgggtaccgagc

SEQ ID NO: 528925 - DNA, 141 bp, Homo sapiens
acttgctagctatccaagctgaagtcgttgtaaatgatcatactctacatgttgatgtagaacacacagcctgaccgctgcatatggagagccagtctcgtcccttgctcgaagggctggtcctaggcagcaatctcctgg

SEQ ID NO: 528926 - DNA, 278 bp, Homo sapiens
ggtctacgtggaaagggacgtggtctaggatggaacgcgacgtgggcaagtagcgcgctgagcatccagttcattcagtcctatttcgtgtctgactacgaccccatgattgaggagtcctacacgaatatctgccgtgtggatggtgtcccagctcgggtggagttcctggacaccgtgggccaggaagagttcgggggcaatgagatatcagtacatgcgtgctgggcacggctatcctgctggtgttcgtcattaacgaccggcagagtttcaac

SEQ ID NO: 528927 - DNA, 115 bp, Homo sapiens
tagctggaccaggtgtggaggtcgggctgtggagagttctccgagggacactcctatgcagaccagacgttcctgctgaagcgaggcctcttggaggaaactctccacaacccta

SEQ ID NO: 528928 - DNA, 488 bp, Homo sapiens
gttgaggtagacgagtgctatgtctggtcattccttaagctcgtcagatggatcgtatagcccttgattaatttccagacgtatctgagaaactaaatagcagctcttgcgaaaagtctaggtcttgttagtgttttgtgatctcattaaaaggtggcccagctgatgaacacaagttatgaaatgacctatgtttgtgtaactggctggagttgcgtaatgctcaggccctgaaaccgtaatatctctaagcagacaggctagggcatatatctcggagatgttttcctaggatagttaggagagaaaaaagaacagcaaaaagaaaatatccaagaaggggaggtgtgtgcaacggttactgactaaaacaaaatcaccaatgaccaatctttgagattaaaactataacttgaacaggacatatctttcatgcctcaagttcctgtcatatataagaacagaggctgtaacagagactagtctgt

SEQ ID NO: 528929 - DNA, 1599 bp, Homo sapiens
tcacaaagaagcagaaaagaagaaaaaagtactagaaaccttttatattagaacactgagtaattagtgttcacttgttgtgtgctacattatgtagtgcaacgacgtgagtactgtctctactatgatgatacgacgtggtcttctatgtcacgctgtagatcgtgtgttcttctagtagttcccatatatcagcgtgtcctaaattcttggtttctccaccctaggtcttccggtaattttcccaccttttttgggagcccctgggggtgtcgtctgctctccctcgtgtcgtttttgtgagtgttcgcttgttgggggcccgtcagtgttgtatcaccctatgtatggtgctttggtacctactatacgggtgctctcgcgtgttaatacagttgttcataggtgtggataatcatcgtttagctaatacacatgtatgcccgtatctactatgcctcttgtgggggtgatcatgagtagtaaatcttatgttttaaaggcccgtttttttatatgcccacagggtgctaaaccacatggtttatgaggagaaaggaggacgtgttggtgttcacatggcgaaatatatttcctacggtgtggtcaccagagccatccactcagtattgtgtgacccagcttgcgctgagaagcccccccgtgtgtcgctgaggcacacttgtcaaggggggacccagtacaccttgggcgacctcaaagttgggaatggtcaattaccacgggtttctttgtgtggtatttcctcacggacatactgtttggggtgtgtgggtgctgacaattagtggggggtctgtgtaaacacacacaaatgggccctatacacgcgggtattggcgccgtgaaatgtgtgttttttgtttgtgtgtcgccaactgtgcgttgttaacaacggcccacacgcgtggtgtttaaacctcatatgttggtacgttttttcgtggcgggaaaaattgtgtgttaacccactgttatcgtgtgtgcactaccaacaacttggttgtataatgtgcctgtgaaacacgctgaacacaaccccttgttgtgtcttccacatgtttttcccacactcctcccaatgactataataatgtcttcacaccttaacacacctatatagaccccccacatggaatatataaccacgcctttatgagtcaccaaattggttttgacttcttatacactgagtacacactctaaaccactgtgggcgcacacaacaaatcttctccacacattctcttctcaccaatattattagtaactattgcacctgacagtctctcctcaaataattttttggggtttacacaccaatcactccctacacacaccccacatctcatactttcctgtatagggccctctcacaagagctacaatcccccaccacccccagattgttccctgtagagagaatctaacactccctgtagatctaaccaagagccaaaagtgacaccaagggccacggaaccctgctccttcggaggacctgccctctaaccctcactggtccaatggcttgtagactctaccccgtttgccccagttaaagacctttttgcacag

SEQ ID NO: 528930 - DNA, 896 bp, Homo sapiens
ccctcagtgtggggaacccccctcccgtgattttgtggggatcacaaaggcatgttggttgtagacgaaaggacggaaggggctgtcttttgtcctactagaggaatatatcagggccagtagcgaaacattttttggggggaagacctttttacaagctgctaatttaggggtcggatcattcaaaaatcggatgcgatccctgtgactatgcgggagaacgctggggcaaactctagtaaagcgggcttaaataacaatggcggtaaaacaacatcgggggaatatttattagctgcctcctcctgacaccttaacgagggatctattgggttaaacatgcagaaaaaattaattgttatgagcaaaggtctagcaccgcgaaaaagaaataacggtgatgcggccccccaagggttcgagcgcagttaggctccaaagaccagagaatctggaatatggcagcgaatgccgtggtggaagaaaatgcccttctcgggggggcgaaaaaaatggacacaatgaaccgccacctgcgggaacactgggcccccaaccatgtcggttacagccacacagagggcagcacgcactgagtaacagaaggctcctgtgacgaaacgccgaacagtctccccccagacccacaataggccgtccccgaggcgcccgggggcatttgaaaccacacacgcggagcacaccctcggtgtgccccggcccaggcagcagcaggcagattgggagaccaacgaagtcccacgcagggcggagaccgccgggggcacagccccatccccgcgaccccggttgaagcagcactcgcacggcctatgttgaatgaccaacgacaaaagaaaaaaatagggaggaaacctagaaccccaaacaaaaca

SEQ ID NO: 528931 - DNA, 951 bp, Homo sapiens
  misc_feature (951)..(951): n is a, c, g, or t
gcctggtgggattcgctgatcgtgtggcaaaagctctgcggaatgcggtgttctcccactgatgttttcgcagctctgtactagaatatggccgctaggcttttgcgtaagggggataagtccctggtcccgtggcgccacacagaagcacgtgggaggccgagtccttgggtgccgagacgctatcctgtgtccgtgcatgcgcccgcaaccccgaatgactcatctgggatctctcgttgcagggtagcgtaaccgttataccctgtgagtacttccttgaatgttctacgagaggacagcgctctggagggtcttatccagaatgagattacggtacgttgtaaaagtgacctcgcgtgttaatgataccctgcccaggaactgggagtgctatttattctattgaaaggcgagatgctgaggtacagaaacgttatgctccccctatttcaaccaaggaaggttctggttagaagactactggtacacgttgcatactatactgttagtaagattgtaccgcgggggtcctgcctgtgacacctaggtgaacttattcgggctggacttgatgactgcatggaagtggttcctattgtgtggggcagtgtttccagtggagatgtggcgttggggtgcacgctctgttggttccttttttttggaccatcctaagcatcgtgaagtttggacacgtaggaagtgttacgctagtttcgaatctgctgcacagtcacccttgagatgcgtgtgatgagatgttttttgcttaggcttatggatttaaagggcttgtaagacacggaaaaagtgaagggagttaaccaatcagacgtggactttaagggaataggttaaagaaggggagatggcggtatacttggctgaggagggggttgaaaggggaaagaaatggtggtattgttcagaaaattaaaacggagattn

SEQ ID NO: 528932 - DNA, 379 bp, Homo sapiens
  misc_feature (10)..(10): n is a, c, g, or t
  misc_feature (118)..(118): n is a, c, g, or t
  misc_feature (376)..(376): n is a, c, g, or t
  misc_feature (379)..(379): n is a, c, g, or t
aaattttccncccccatccgtgggttgtgttttccacctttaccgaataatgtcccttagacatataaataaatttgtattttaaaagtgaccttgaatttggctgtgccaaggtgcntcacgcttgtaatccccagcactttgggagactgaggtgggtggatcatatgaggaggcctaggagttcgaggtcagccctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgttgnaan

SEQ ID NO: 528933 - DNA, 399 bp, Homo sapiens
gatcgagcgcggagacaggaaagaagagttggagatgagatgaagagaaggactataacaaataaaaaaggaaaagaaacaaaaaaaacagaagagaaaaggaaacctggtaacttatgggccttgagattctctctgggctcaagatgacctggatgccaagccattgaccctcctctgggggcctcaacccatctacaaccggatgaaggttcgcctgatatactagggaatggggtagggtaccttgttcactccaatggtggcacatttttataccttcacttcaaccagaccttactataatgtgtccagaaaatggaggctagaaagcaggtgaaaggtccctcctggtcaaagcaacaaggtctgtgccggccttccaccatcaataacccc

SEQ ID NO: 528934 - DNA, 195 bp, Homo sapiens
ggcaggatccctaaccagccgtctgtgtcgcgtgtatacgcgggttcccgtacgaattaccggcgtcgcccgagtcgtccttacgctccttcagaagagggcatagaggcgcaaggtaggtgaagcgaccaactgagaacgctgttccacccacccaggagagcagtgcggatctaacatccaggtcgtcctcgg

SEQ ID NO: 528935 - DNA, 284 bp, Homo sapiens
atcgagctcggtacgcagctcgctgtcgctggtcgatacgacggggcggggacttgaacgcggcggggacggtaagggtgcggggactagacactcggggactcggggacgacggacacggggtgtgaataacaacaacgggacttgaaaaccaggagaggggtggggcgcagtggtttacgcctgtaatcccagcactttgggacagccgaggctggttggaccgcttgagctcgggaattcaagaccagcccgggcaacacagcaagagccagtctctacaa

SEQ ID NO: 528936 - DNA, 910 bp, Homo sapiens
attaatcccctggcccaacccgtcatctactctaccatcttggcaggcacactcatcacagcgctaagctcgcactgattttttacctgagtaggcctagaaataaacatgctagcttttattccagttctaaccaagaaaaataaaccctcgttcccacagagagctgccatcaagtatttcctcacgcaagcgaatcgcgtatccatgaatccttctaatgagctatcctcttcaagcaatatactctccggagcagatgaagccagttaaccaatactaccaatcaatactcatcattgaataatcataatggcgtatagcaagtaaaattaggaatagccccgcttttcaacttctgagtcccagaggttagcccaaggcacccctcgtgacatccggcctgcttcttctgcaccatgacaaaagagtagcccccatctcaatcatataccgaaaatctctccctcgctaaacgtaagccttctgcctcactctctcaatcttgatccatcagtagcaggcgagttgaggtggattaaaccagaccagtacgcaaaaaggcttagcatacgcctcagttacccgcataggatgagtaatagcagttctaccgtacaacccgtaaacataaccattcgtaattgactatttatattatctaagtatacggttctaatatcagttaaatccagacagactatagattcggactgaaagtagtgatagacctgatgctcgactcttctaggggtgcccgtaaggtttgccagtggctttgagattgaaaaagtttatccgcatagaataagttattattaaggaatccaaaatccttagaaaaagggggaaacccccgtgggttttttaaaaaaaggggttgggggggtttcgtgtttgttgcttgtga

SEQ ID NO: 528937 - DNA, 137 bp, Homo sapiens
tcagctcggcacctttgacgttccgaaagctggttgatttggtataacacttgaaggccgtatcaaaacagtcttgacgtgtatgggtcccatattccaatctctcatattgagcagaatcacctttttcacctcgt

SEQ ID NO: 528938 - DNA, 483 bp, Homo sapiens
  misc_feature (350)..(350): n is a, c, g, or t
  misc_feature (440)..(440): n is a, c, g, or t
  misc_feature (476)..(476): n is a, c, g, or t
ggagaagcattgctcaggacagcgtgtaaatcgacttcttgtgaggtgccctgcacgccggtcctgggagcaggcgggctcccgggggtgcggggagccctcgactcctacctggtgtgtgtgttgccagtttgcttgcgccacagtcgtggaggatgcgtgacagtgccgagagctcgccccaggcaccagcccagggaacaggtggaggacatgcatgaccgcggtcgataggacacactggtgacacacagagtcacgagagagctgtctggggatagtactgtccagagagacccaagtgcggcttcgccggcactaagacgcagaggagcctgaacgtatatagntgaacgaaccaggaggagccgtcaccctgggcgtagaggcgccaccgaggactggctcgcatcccttgtgagtaggaggagtgttactgngaaggctcgtacgtgtgacagcgtgtgtctactagnccgaggg

SEQ ID NO: 528939 - DNA, 169 bp, Homo sapiens
gaaagatcctagtacaaggaaggcatcctcctgaccagcagaggttgatctttgctgggaaacagttggcagatggacgcaccctgtctgactacacatccagaaagagtccaccctggaccattgtgccccgctcttagaggtgggatgccgatcttcggtgaagacc

SEQ ID NO: 528940 - DNA, 1402 bp, Homo sapiens
gtcagtagtcttaagagtaaagctttccagtatgaatttagatgatcacgcaaagaagaaattaatttaacacttgtaggcagcagcgcatactgcaagaccacagatgtgcttaccatcaaaaccagatcaggtgccctttaaggcaggcagcaattacgattcatgcagtgtatctactaacagtgttatacccatgcagtctaggaaatactgcaagcacatgggcaacgacacagtaagcacttgacagcagcacgatggcaagcagtcatcatcatgaggcaacacatagcatccatctagcaacagcacacatcatccttggcgcacacacgcttcgtcccagcaattgcaacaagcgtggctgcaagcacacacacatccatggcacacatacacagtcacagagtcacaggcagacgtccgatgtggggtacctaacaaggcaaaatttgcagcagccagtgacaaaacaaagtgcgtgttctgtatcagtttcgtataaacacatgcatgggaaggcacacagagtggcacaacattgtcaccatgtgtacatcgaggataacgaaacaggcacatccaggtagaaagcaaggaacgttattgaaaaactggtagaaacccagatgggacaagtagaagtggggcaagctacggaacacagagaagtcggaggaaatacgcaactaactcactaaacaaatcatatgcactgacgctcactagatcgcgtggcaagacccaggaaagcatagctacaaacatcagacggaccgaacactcagcaaagcaagacgcgagacacaagagagagagcacagcgaaagacacagagaatcgcgaacgagacaagcacacacgcggacagaacacggctaggatgaaccgagagcaagaccacgtacagaaacacaacacaacacaagaacgactcacaaaataggacatgcacaacacgggaggaaacacaaaggcagcagatactacacaccaagacagtgaaaaatagagaacaacacacaaacggagacaaataccataggcagagaacaacatagacagaaccacaaaaacagaaagaagaaaccatagccacagaacacaaagatgatcaacacagagaggaaaaaatgacacaggaaaggatatagaggcaccacacaaaaggaaaaaagcaacgaacagcatagcaagcaaggccacaatcgaagcaagacatcaacaactggtatatataaacaagacagtagcaaatacaacagaggcaacacaaaatgagagataccacaccatagaacaaaaaatataaacaaaacacacaagaagacaaagggaggagcacacacatacgcccagacaaacagagaaatgaagaaaagagaagaggaggaagaca

SEQ ID NO: 528941 - DNA, 469 bp, Homo sapiens
ctcaggcgggcggctggctcatagcccacactgtactctacattattaccttagatgtcaacaagacctggtcctgaactcttactcgccacttagctctatgacctaggacaagtggcttcccctccctcccgtaagtctctgctacatcataggtgaaatgggaaaaaccatagctcgctcgttagttatttgtgaagattagttaattactggattgaaagcacctagaaaagtgccaggcccagggtaggcacatggcacatgttagctatcatataagacataaatcaatacggggctccatcactatactgccaagctgttcccactgagtctgggatatctattacccaaataaaaagaaggagccagtttcacttgcccttaccactgggcaagcagtagactacatgctgaaacagaagagatgacatggtaaatccttctttaccatccatctgtgcta

SEQ ID NO: 528942 - DNA, 353 bp, Homo sapiens
atttgtggggaattttggtcattgaggagatcttatgacatgtacgtgacatgtagtcatcccatttcctgattgcggaaggatgaagtttcccttgccaaagattgttaaatcacattaggagaacgaggcaacttaagatggaacaatgatagaacaatgtttgtaaacactgccaaatacattttaatgtgaaaatttttataaatattaacgtatgccttttactgtaaagatatttcagtttagcttagtgaaccaacttttgttgtgtttccactatatatcagaccctatgctgtatgcttgagatagtcgacgcggccgcgaatttagtagtagtaggggccgct

SEQ ID NO: 528943 - DNA, 166 bp, Homo sapiens
gctgctacaagacgacatgtcttagacaaatactcatgtgtatgggcagaaactcgaggactgtattgtgactaatgtataacaggttattttagtttctgttctgtggaaagtgtaaagcattccaacaaagggtttcactgtagattcttttttttgcacccca

SEQ ID NO: 528944 - DNA, 265 bp, Homo sapiens
  misc_feature (68)..(68): n is a, c, g, or t
  misc_feature (73)..(73): n is a, c, g, or t
  misc_feature (82)..(82): n is a, c, g, or t
  misc_feature (105)..(105): n is a, c, g, or t
  misc_feature (115)..(115): n is a, c, g, or t
  misc_feature (245)..(245): n is a, c, g, or t
agcgctttgcacatgcccttatggcaggggcaacgtgacctgagtcaaatctcaggctgatcactctnatttnaaggaaatnagggcggggggcagaccctcgtnagcgtttttncacccaaaacccggctgctttaactgtttcccaagttcccccctcagaaggaagtccttttcgaaaggaagggcaaagtgagagaagagaggagtcagtgagaaagcaagtgggcatgtagatgactgangctcacattatctgagccac

SEQ ID NO: 528945 - DNA, 412 bp, Homo sapiens
  misc_feature (60)..(60): n is a, c, g, or t
  misc_feature (63)..(63): n is a, c, g, or t
  misc_feature (118)..(118): n is a, c, g, or t
  misc_feature (120)..(120): n is a, c, g, or t
  misc_feature (125)..(125): n is a, c, g, or t
  misc_feature (144)..(144): n is a, c, g, or t
  misc_feature (184)..(184): n is a, c, g, or t
  misc_feature (296)..(296): n is a, c, g, or t
  misc_feature (338)..(338): n is a, c, g, or t
agcagtagcagctgcagagcgcggagcagagcacagcctcagccaccgcctcgccatggnggntagcagctcgctggaggcggtgcggagaaagatccggagcctgcaggagcacgtnantgccnggcaggagcgtgcgggcanctgcagcgcgactgaccaggagcggaactgcgggaaaccntgaagctgacgtagcttctctgaacagacgcatccagctggttgaggaggagttggatcgtgctcaggagcgtctggccacagctctgcagaagctggaggagccgagaagntgcagatgagagtgagagaggcatgaaagtcattgaaaaccngagcccaaaaagatgaataaaagatggagattcaggagatccagctgaaagaggccaagcacattgctgaagat

SEQ ID NO: 528946 - DNA, 1262 bp, Homo sapiens
  misc_feature (216)..(216): n is a, c, g, or t
  misc_feature (259)..(259): n is a, c, g, or t
  misc_feature (270)..(270): n is a, c, g, or t
  misc_feature (375)..(375): n is a, c, g, or t
  misc_feature (392)..(392): n is a, c, g, or t
  misc_feature (404)..(405): n is a, c, g, or t
  misc_feature (430)..(430): n is a, c, g, or t
  misc_feature (435)..(435): n is a, c, g, or t
  misc_feature (437)..(438): n is a, c, g, or t
  misc_feature (440)..(440): n is a, c, g, or t
  misc_feature (442)..(442): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (472)..(472): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (494)..(494): n is a, c, g, or t
  misc_feature (496)..(496): n is a, c, g, or t
  misc_feature (507)..(508): n is a, c, g, or t
  misc_feature (512)..(512): n is a, c, g, or t
  misc_feature (514)..(514): n is a, c, g, or t
  misc_feature (521)..(521): n is a, c, g, or t
  misc_feature (528)..(529): n is a, c, g, or t
  misc_feature (533)..(533): n is a, c, g, or t
  misc_feature (540)..(540): n is a, c, g, or t
  misc_feature (543)..(543): n is a, c, g, or t
ctcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactataaatactgtacttctgtaccnacattgcctcctagcagagaagtgtgtgtgtgacaagccagtnctacaggcatnacctaggtgtgagactaaaagcttttcttattgacttaaatttggataacagcaaggtgtgaggggggtggtgggtatggtgtgtgcttggatgggaaagaaaangctccactcacctatangagatattttanntggaatccatttaaactcaaaacanttatnannancnaggtgaagaacatnaanctgtntcttattnatttnattccnaanganctacntnttaagtgaaanntatnancaaccanattaaannttanccacatnctncattttaaggtctaagtttaactggtcaacatatacaatggattggagctattagtaccatcaagtgtgatggggctatagttcccaactactatgtacatcgtccacataaacacttcaacattgggccttaagaagaccccatacattactcatcattaccatcatactacgagatgtactagtgggtatcctcaagataaataacataagataatagcctcttaataaatcctatatgtcaaaaaacagaagttaaggatcctaataaagatgagaagggctgacaaatacatatgaatggaaatactagaaggtaattacaaagaaaccaaatagaccactcatggagacatgatacatttaaacagaactgatacagccgtgttggttaataaaacggataacacaggtaataaccttaactaggcggtggaatcgagccacatgacaaagcaaagtagtaaccaagcattaaggagagcagacacgcggataagagaagctaaagaaatggagacataaagggtagcacaacaagccgcgacaggaaacggcaaagacgaaggccgccacgaatagcactacgaacgataagagacgaaaacgcgcgcggtacgagcaaggcagaaacgacagagacacaccagacagcacggcaggagcacgggagcagagaaacaaaaagagaataaggaacggagcaaagaacccacatg

SEQ ID NO: 528947 - DNA, 755 bp, Homo sapiens
  misc_feature (638)..(638): n is a, c, g, or t
cgcgagctgcgggcgctgttgctgtggggccgccgtcctgcggctttatgctgcgggcgccggcgctggtggtcgtgccgggaggaaagaccaattctgtgtcctcggaggaccacagcccgagatggcggcccctaaggcgagaaaccctagccgtgagagcttgcgggctaggacgactgttcaggccacgctagacgcgccgatgcacaaggaaggaagcccctgcactcgattatcagcaagcacagagagcgtgcagggttccatttccaaacatgagttccaggccgagaacgaaagaagcttgtggacattgtcggcccggtccctgttagctcagaaaagaggaggtgtcatatacgggagctgatctccaatggccagcgatgcccttggaaaaacctgggtcacaaacctggtgtctgacgggccaagcacgtgccatgaaattggagattcactttgcagaccaatgccggagaaaaggctaccatcaccatccaggatactggtatcgggatgaccacaggaagagctggtgtccaacctgggggacgatttgccagattcggggtcaaaggccttcctggatgctctgagaaaccaggctgaggccagcaggcaagatcatcggncagtcgaagtgggtatctactcaggttcatggcgggctgacagagtggaggtctattcccggtcggaaccccgggaaacctgggttacccagtggttccagatggtctggagtgtaa

SEQ ID NO: 528948 - DNA, 629 bp, Homo sapiens
  misc_feature (216)..(216): n is a, c, g, or t
  misc_feature (259)..(259): n is a, c, g, or t
  misc_feature (270)..(270): n is a, c, g, or t
  misc_feature (375)..(375): n is a, c, g, or t
  misc_feature (392)..(392): n is a, c, g, or t
  misc_feature (404)..(405): n is a, c, g, or t
  misc_feature (430)..(430): n is a, c, g, or t
  misc_feature (435)..(435): n is a, c, g, or t
  misc_feature (437)..(438): n is a, c, g, or t
  misc_feature (440)..(440): n is a, c, g, or t
  misc_feature (442)..(442): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (472)..(472): n is a, c, g, or t
  misc_feature (477)..(477): n is a, c, g, or t
  misc_feature (483)..(483): n is a, c, g, or t
  misc_feature (486)..(486): n is a, c, g, or t
  misc_feature (489)..(489): n is a, c, g, or t
  misc_feature (494)..(494): n is a, c, g, or t
  misc_feature (496)..(496): n is a, c, g, or t
  misc_feature (507)..(508): n is a, c, g, or t
  misc_feature (512)..(512): n is a, c, g, or t
  misc_feature (514)..(514): n is a, c, g, or t
  misc_feature (521)..(521): n is a, c, g, or t
  misc_feature (528)..(529): n is a, c, g, or t
  misc_feature (533)..(533): n is a, c, g, or t
  misc_feature (540)..(540): n is a, c, g, or t
  misc_feature (543)..(543): n is a, c, g, or t
ctcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactataaatactgtacttctgtaccnacattgcctcctagcagagaagtgtgtgtgtgacaagccagtnctacaggcatnacctaggtgtgagactaaaagcttttcttattgacttaaatttggataacagcaaggtgtgaggggggtggtgggtatggtgtgtgcttggatgggaaagaaaangctccactcacctatangagatattttanntggaatccatttaaactcaaaacanttatnannancnaggtgaagaacatnaanctgtntcttattnatttnattccnaanganctacntnttaagtgaaanntatnancaaccanattaaannttanccacatnctncattttaaaaactaacattaacttttctacatttaaatagaattgaacctattaatacaataaatattactttttaaccctttttg

SEQ ID NO: 528949 - DNA, 363 bp, Homo sapiens
gtctagaggatcccgaatagggcggtctcacaagagggatgcaaaggcacattgaacagttagaagaaagagtcagaaaactgaagagaggataaggaaattattgagtctgaggaacagaaagaaaagagatgaagaaaggtgaaagcagtctaaggaaccggtgcgatacctcaaccagatcagcatacacatggtgataactacagaaggagaagagagagaaaaggctggtgagaatatttgaagaaatgatgaccaacagcttcccatatttgatgaaaaacatgaatatgaatatctaagaagttcaataaaccaagtaggatgaactcaaagaaacacatactgagacagcataca

SEQ ID NO: 528950 - DNA, 1195 bp, Homo sapiens
  misc_feature (506)..(506): n is a, c, g, or t
cggcacgaggccggaccccgcaaccgcgaggcgagagagcagcgccggcgaggcactggctgggctctgactgtcacgttaattccctgctgctttttctagtccccagccgcctcgcccctcctccctcattcccagcctgggtttggaggcgatttccctctattgactgagccgactgcatctctgggcaagcggcgctttgcctctctcctgtctttgtctgctcttcctgcaaggctacggcgcctggagcagggtctgcagcgggcagcacgcacgtaaagcacgacggcaaccgcacagtgcccttccgtacccgggagccacggagggactgagacgcatcggcatccgcgcggcgcgggcaccttagagagcaaccggggccgcaacgaaagcggacatagcgacatagtagattgacaggaggacacagtgtggtgagcatgcaagccgcccgccgaaactacgcccaggaacggacaattcacactgcgctggtngcgcacacgccgcgtgcgcacagcgttgtgagcccagcgtcttgctttggcacgtcagatggaaggagcaagtcgggccgtgcgcggaattcaattgctcgagcatgccaggccatgaactcttggtacgaacctgttcgcgtataaagccctggatataccccttcgtacgcattagttgatgcgtacagtgcccgtaacaacaaggtctctcggttccctggcgtagcacttgagctggtaggccctgttgccactctttccttggcacaggggataatggatgctttacccatatatcgggaactagctactatttggtggtcatatacaatgctagggcgcgcgttttgaacagactggattcccaccacctgggacaagggccacactgcgcacatacagttcagctagagaggggcagacgaggtaatcgcggacaggacagcaattttcatattcccactgcccttgtcgaaactagccacggtcttgaaaccgtggggcattctcggggaagtattccgctccgatttcaaggaagttcaagcacattcttaactgtgcgcccaatagatgcaaaccattgtgttagcgaaatggcggaagccactgctcctataccaaactctgtggcgacgcacagatcttccctcacagtgactcgttggtttccccatacgacgata

SEQ ID NO: 528951 - DNA, 180 bp, Homo sapiens
tgttcacttgaagctcttgccctgattgaaggctttgccacatgctggaaggccccctcccgggaaaagtcctctcgacccagcgtctgggtctcctcgctgccgggttccagtttccgccatgtgtttgactcgtagtccacctgccattctggactcagcggaagggcaggctcctgg

SEQ ID NO: 528952 - DNA, 142 bp, Homo sapiens
  misc_feature (1)..(1): n is a, c, g, or t
ncccttgtcaagtgattgatcagaaaaccagctctcggcaaggtcggaaggtctgggaaaaactgcgtgcagtcatcagcggactttcgctcactcgagtggggagcagagcggcagcgacacggacacagacaaacacgaa

SEQ ID NO: 528953 - DNA, 167 bp, Homo sapiens
gaacctatgcaaactatacatttttgaatgacagttatcattgaagaaatcagggtaaagtaaaaagatcctagaatcaaacagaaatgtctgctcgagccaggcacagggatttttgacatccaagctcagaccctgttacttacacagcaagtgcttggtgaatt

SEQ ID NO: 528954 - DNA, 350 bp, Homo sapiens
agtttgtattgaagatataatgctgagcaaaataagccggtgacaaaaggacaaatactgtacagttccactcctaagagctgcctagaatcatcatatttattgagacagaacgtacaatggtgggtgccagggactggggaaatgggaagttatgtttaatgagctgagagtttcagttttgcaggctgaaaagagatctggagctggatggtggtgatggttcacagcagtctgaatgtgctccatgctactgacctgtacccttaagatagttacagtggtacattttatgttacatataatttaccacaatttaaagaaaattaaaaaaatttacaaattccctt

SEQ ID NO: 528955 - DNA, 798 bp, Homo sapiens
gcacgagaaattttgtaacattaaaactggttaaagaagatattgcgtgtcgatattctccgttgaaaaacttattgaaataatttattagtgacaacgcatccatacagctaaccataaagtatttcttgtagaatgggaagatacttttatccttagtaattagtgtttcaaaatgcaagaatacggccattgaagttctcaacatcaatagtttattcattattcgattgtgaaatgaagaagaattttctgaagataatatattcatttctgaaatcacattcatgtcatcaaggtctgacttatcctgtgcgacacttttcaatggtactatgggaaagttttcctccacaaaaatctcaattttttctcttatgaattcaattgagtgcaaatggaaactaccatagtatgtcatcgtcaagttatctaagtctgacaggagtaacgcaagctgggctctcttaaatgtaaattcatgaattctcaaaagtttgtgattattgatatcgcttagatcgcccctaactcggttcatatataccgtcagagaatcaggatccttaatatttaggaataaggccattaaagatatcggtgagacagaatgtctacccttgagacttgcttcaaacgaacaaacggtaacgatactcaaccagagtattcttctgtgattcaaggttcttttatctgaggtggacggggaaatcaattgagggaaatctgaaggatctctgggagaccaatcgaggtggaaagcatcattatcaaactactgataacatcggtggg

SEQ ID NO: 528956 - DNA, 342 bp, Homo sapiens
cgggtctccctgcccatgtacaagtctgtaggcatcctggtcaagggccatcagagactgaaacacagtagtatatgttaggtggaaaggtcctgagccctccaagcacaagattatgagtgtgctgaagacgaacataaggaatatcacagagatgctgccaaacaggtcagggctgtaccactgttactattgaagcagagaccactagtctgagtgaacctctgaagctggtaatgaccacagcttatgacaaaccctttctctcaatcatgccaggcactgaggtggcatcacgagagaatatgaagttgcaatgtttctcaaaatttgaacttggtt

SEQ ID NO: 528957 - DNA, 154 bp, Homo sapiens
  misc_feature (77)..(77): n is a, c, g, or t
  misc_feature (119)..(119): n is a, c, g, or t
caaaaccttaaattctagagaaatagagggaaaggatttaggacagtatttcttgtctatgacaccaaatgcaaggnaacaaaataaaaaaacaaacaaacaaatggggctacatcaancttaaaaacttctgcatagccatagggcacaatca

SEQ ID NO: 528958 - DNA, 250 bp, Homo sapiens
  misc_feature (6)..(6): n is a, c, g, or t
  misc_feature (35)..(35): n is a, c, g, or t
  misc_feature (38)..(38): n is a, c, g, or t
  misc_feature (203)..(203): n is a, c, g, or t
  misc_feature (210)..(210): n is a, c, g, or t
  misc_feature (246)..(246): n is a, c, g, or t
cggcgngagggaacttgcaccgaagcatcactcanttntcccaaacctccaggcctgagccaagccagcgcccaatggatgacaaaaagaagaaacggatcccaagccctgcctggcccagcacccaggccccaggacactatggagggtccctgtgcctaccagccacagcggctccttggcctaggacttcctcatctgcnatccccnaagtagcgggccaagttcaagatagtaggcaaaganaagt

SEQ ID NO: 528959 - DNA, 162 bp, Homo sapiens
  misc_feature (158)..(158): n is a, c, g, or t
gttggtcagttcatggtaacggcatgaaggaccatgtcagtgagcgagtgtacaatttgccagtcctgacaagaactgcccaccaacataaccaatttatgacaagtcaattcattacaaaggtatagacacctctgtgttgggcagactggtcatgntgca

SEQ ID NO: 528960 - DNA, 618 bp, Homo sapiens
  misc_feature (479)..(479): n is a, c, g, or t
gggtgctgactgtttaagtaatttgacccagtctattaaaggcagagtcagaaaatgaaatgaggcagtctggctccagagtctaagctcttactgttatatatcctttcaaagagacacaagtttcacttttttgaaattcacagcccagtaatgagctagagagaaacaacacaaaaagagtcagaaggctaatatctattcccaggactgccccttacaaggattaaggtttaggttaagtcatttgatcctcatgggactgaattgtaactaatctgttaattagggatagaagtagttgcttaggctctctcattggcctgctctgagaacccactgagagggtacttataaaatcttttgcaaagccctatataaaagttggtgttattaagtttaggtcttatctttagattgctcaagcacttagcaccttttatttgtacctgttctgtgcaaatcaaaggaactcaccnatcaataaatgtttgttaactgaatggtttcagagatcactttaaatatacttggtgctagatttgaacatacaacccaaagttcagaggcccactttagctaagttctaatattcacaaactctagagtctagaagac

SEQ ID NO: 528961 - DNA, 89 bp, Homo sapiens
aaaccttcctaccctacctaccttacagggctgttgttaggacccaggggagtttggatgtggaagtaaaagtgctgctaaaacctaaa

SEQ ID NO: 528962 - DNA, 272 bp, Homo sapiens
gggggccccttttttaaagggcccccccgttccttggggggccccccttggttttttgggggccggcccccccccttcccccccccccgggggggggcccccttttttttttttggggggggggccccccccccccccccccccctgggggggtttttttttgggtttcccttggggggggccccccccccggggccccccggtttgtggggggggtttttccccccccccccggggggggccccccctttttagggggggtttttttttta

SEQ ID NO: 528963 - DNA, 328 bp, Homo sapiens
agctttcattgttgactttggcatacctttcattaatgtagatcgatatctgcatcatcatatataaggacgtctccggatatatttgtctcgtaaatcaatctgtaattaccagatctatgaccatcctgtcaatttactctgtggaaggcacatgtgttccatgaagaagactattggatgttgggaaaaactcttctccatgtttttctctcagtctctcatatgtttccatgtcaggtttgatctgcttggtcaaccgatgatactggcgtaactgggcagcagcataatctgaaaatcccagatcagggtttttcctctcctt

SEQ ID NO: 528964 - DNA, 795 bp, Homo sapiens
ggcgccgcgcggtgaagtgttgtctagtgcacgctcggaggcatgccgtccaagggtccgcatgcagctcggtgcaggtcttcggtacgctactaagacagcgacagctgtggcgcactgcgaacgcttgctatggtctcatcaaggtgaacgggtcggctccctgtgagatgatagagccgcgcacgctacagtacaaagctgcttaggagccacgtgctgcttcttctggcgcagggagcgatttttggaagggcgtttgggattgtatcacaatcccgtggtcctggtagtacaaggggtgtgttgtgccacggtggctcgcagattatatgcatatccggtcgacgtccaatctcgcaaagccacgtggtggccgtattgaccgatgaagatcttgtggatagaggccttgccagttaaggaggatcagacagagcatccgtcatcgcagatagtgaccggtagccctgcgtgggtagactgaccctcgatcgatgcgagtccatcaaagtttgggaggccctggtgcccgcgctcgctaccagaaatcctaccgataagcccgtcgtgactcaaaactgactttgtattagtaaaccagttgtccgagggacttgtgaatacgtttcaaatacaccagagagtgaaccctaagaggccacaattctgacgtaccattccccacccacccatatgagaaccctaggcagtggacttcccaaaggccagaaggggaccctttgcgtggctggttgtgattaggaaccagtgcgccggcgtattcttgtcgac

SEQ ID NO: 528965 - DNA, 280 bp, Homo sapiens
tagattgacgaaatgaatcaaggctcgtgggcggcgcactgccacctcctcggaggacacgctggggctcggcggtgaagagtctgtttccgggggcgctctcccttgggtgccccgatggctgctgagggcctgggggccatttcctgcattccggggacccgtcatcactctcacattgtggtcaggacacaggaccaagaagggcccttcacaaaggatggaggtggtcacttgagggtggccggactgggcgcagctgtggacctgcccccctaaa

SEQ ID NO: 528966 - DNA, 395 bp, Homo sapiens
gcaaacccactccaccttactaccagagcaaccttagctaaaccatttacccaattaaagttttagggcgttaggaaattgaaaacctggcgcattagatatagtaccgcaagggaaagttgaaaaattttaacccggcttaatatagcaagggctaaccccttttaccttctgcataatgaattaactaggaataacctttgcaggaggggccaaatttaagaccccgaaaccagacgggttacctcaggacaactaaaagggggcaccctctttttttaggaaataaggggaggttttgggggagggcgcaaacccaccgggcttggtttacttggtcgccacgtagatcttagtcactttactttgccacagaccctctatatcccttgtaa

SEQ ID NO: 528967 - DNA, 292 bp, Homo sapiens
aagtcatataagcgggagagattggtccaaggcacatgttggctagcaggagagctgtgactggaactcaagtcgtctaaaattcagcgtacctttcaaatgcctaggattttctcaggaatccttcctaaagaagtggattttcagtcacagaaatctatctcttgaagctccaaagccttttatttcggttttggatagacatttattggtttcttttcgaatagagatcttgctgaaatgtatcatatacatccctattttgtcttaaagcatacctgaaagataattt

SEQ ID NO: 528968 - DNA, 802 bp, Homo sapiens
tataaaaatactttcactttattttaaaaaaatgaaaactcatagagtaagcttatcacaaacgggcctattaggagtcacagaattcacaggaaacaattcctgaaaaccaggtgcctgctgccacctctccaagcaggccagagtccagtagagaaggcgattcaggaagagggctcctcagagggcagggaggttagctacggaggccgctcacggtggaaagtgtccagttgaaccatgtgccaaggaagaagataaaattctcgggggcgtgaccacaacagggggggggggataaagacaacaccactggccgtgtacttctcatctctattggtccatttcacggcgggaaggtgacctcttttcccctaatcttctttcaacccacgagaagtgtaagtgcttttctcagagctaaaatctataatccacccctatttcccagtggtctctactcctgggagaccagcccgggtggcatctctccctccgtgtccctgggccagaatcttggtggagtcaagggtctggcgggagtaagagggcagagtccaggtactggacctcgacggtggtgtggtcacctggaagctcttcgttggcaggcctagatctctttaccgtggagaggtcctgggacgtgccattttccctgggggggctcgcaaattgtgcgaagtgggccccatgacaggaagatttaggccgtgggaaaaaggaactcttccctgttgtccatttcccgagcctggtcccgcagggtctggtctgaagcctttgagttccagaaacccgg

SEQ ID NO: 528969 - DNA, 487 bp, Homo sapiens
atctgctgctttaggctttaagaaaggttgagtgtagggagattgattggtctcctcatacttttttagttttctcaaattctgttattgtccaatttcctaatgtcctagaaaaattgacaattgtggaatgcatgggactaatggacgctggctctgcagtcagtcattattaggcatatggtaccttcaatccagcccacacaaacaaatgatttagggtatcaagtgtcagaggagagttaagtgtatcaaagagaaggaatcaaagactaaagaagagactgcctagagattctacaggctggttagaaaatatacataatagaaaggggtttcaacctgtttaagtgcacagatccatgccaccaccatgctttcttgaagataatcacagatttgtaatgtaaggtaatatgtatcctgtgatatagtcgtctagttctggtgtaagaaagaccccaaaagataaagagataaaagtaaa

SEQ ID NO: 528970 - DNA, 779 bp, Homo sapiens
agtcatcctgctcaggttgggcatagtggctcatgcctgtaatctcagcactttggtgaagccaaagtgggaggattgcttgagcccaggagttccaaaccatcctgggcaacagagggagacccaaaccatcctgggcaacagatgggagaccctgtctctaccaatgaaaaaaaaaaaaaaaaaaaaagagtgttaaaaaaaacaattaggtctgggccctggggggtgtggcaccctctccaggtagggcctggaggttgagaaagggtttctcttttaacctctggggaagatctggagagccgtgcaaggtggagcccattggactcggtgcccacgtgccacctccagagttctggggtggcacaaaggtgggtgcacccttattcttaaaaaaaaaaaaataaaagagagagtctctctctcctcctctctccaaccttggctgtgtttgagcacattatgggtcactactcacaggctcctcgcaacacctcctctcagggggatctcgggggggactccctatagggggggtgtcctattttgtacatcgagcgtggggagagaagggggagcactttttagggggagacgtggtgtgtggcggtgtgaactgcggatttttggcccccatttttccctgcggggtcccggggtcctcgtggccgcgcgtttctccaactctttcctttttggccccgcgtgtggtgaaacctccaggggggtggcatttgccccgagtttccacttcctgggggctggggggtttccct

SEQ ID NO: 528971 - DNA, 151 bp, Homo sapiens
tcctagacgcacaggtacagatataaacgtctgtcctatggcctccctaatccctggtcttcccagctgtctgggacttcagtgtgacccccatccccatgcccccacgtcaccaaggcctcgctcgtccctctcgtctgacatgtctgtg

SEQ ID NO: 528972 - DNA, 217 bp, Homo sapiens
ctagctgtaccagaggatcccttcacccattagtccaaggggattttatggtctgggggcagaaacactccaagttgattagaaagaccaggccaatgtcagtgtacctggtggccaaacccacctgctaagtgtgaatgaaatgtactttcaatttatggtttcctggtgcgaggtggcaaaagcaacattacatagtctttgggcagaaatggct

SEQ ID NO: 528973 - DNA, 310 bp, Homo sapiens
actgggcagtattagcccagtggtatattaaaaaaaaataaactgtagcaatcaagacgaagatttagcagcagtaactggtttaaagtagatagaaccaccttataattaatggatataattcatagagtcatagtgcatggctccaagtagaacggatgacaaaaagtatgactaataggaaaggaaatagttgaggaaaaatgtcccagagaagaaaagtcttcctaagacagaaagaaaaacaccttacctataccagggaaaagacttcaaaaagactttttggaattaaactcaggtatgcatc

SEQ ID NO: 528974 - DNA, 956 bp, Homo sapiens
gggaaactctgggcggcataaaactgagaggtatggtttatcgtagtagcctctgcattgagaacagctgcatcgcggcccacgaccagagggggaggtacgggaccctgttcacgatggatcgggtgctgacccgcccaatggggactgtcatggatgtcctgaagggagacaatcgcttgagcatggctggtagctgcatccagtctgcaaggatctgactggagaccctcaaccgtggaaggagtctacgaacagtcttatgctcccacgaaatgaaggccgttccgagccctgcacagcatagagaacgggagcgagactcttgggagatgccgaaggaacttgcctaatcgagtccgtgaaagtaccacagttggtgatgaaatcctggttagcgggaggcactcggggccctggtgcggctaaagtctctcgcaaggtgacgaagctggaagtcacgcttggaaaaacaatgtggtgagtgtcaacaaggagcctgttgccgagcctgacatcatgggcacataatggcgtggtccattgtcatcagccatgtgtacgtgacagtctccagtacaagcagaacgtcaggacaagaggggatgaacttggcagaactctgcgacttgcgatcttcagacaaggcatcagcggtgaccagggcttcccaggaggtctgctcgaactacgcccctggtctatcaaaacgttatgaggagacggatgactgcattagactgggaaggcacctacgggacggggaaatgcaactaacgggttaaggatcagtccgacacaatgtgctcgtcacgagttaccaccagaggactggtgtgtgacagtggtcccagaaaaataccataggatatcaagacctgaagagtgtaccaatgggccgagcgaccaagagtgaagaatggacgcggtgttcccatgagggggaacgacgtaac

SEQ ID NO: 528975 - DNA, 805 bp, Homo sapiens
ctgcgctatgctctccgtgtttcccgctggggtcgtttccccagggcctcaccagtccccgtttgtatgctctcgccccagctgttcgccctccaacccccatgtgtcgccgtgccccacggttcaccggcgtggaccgttcctgtggccactgccccttggcggcaatgcgccgtggatctctgttccaaacccttgctgggtttctttttgcgtactgcatcctttcggcgtcaccttcgtgtgaccttgggacgtcccaggtcgtgatcgcccagtgaaccctttggcccttcgggccccttttggtgaggtctctggtatgatatgtctctgggcactagcctgcagcttccacttgtcctacaagatgctgcgtggtaaatccaccagatcaggctacacttaccgtcggttggtccactgaaggaggccatccaaggatcaaggaggaacactctgcatatagcccagacccggtctgtaccctgccctcacaccggcccatacatgctaggctgtgccgcgaatcagcccagttcagccccagctcacaccccctcacaacacaccccaagctggtgagtgaggtggatcgagctgtgacaagtcctatcacagcgctgcaggagaagcgttctacaagcagatcagtccctgtgcaacctcgaggacatccacatgagcctggagcaagaacatcactgccatgaccaacagtgctcttcatcgaccgccagaagtgcattgggcccaatgcgtacatgctaccccaccatcctgcaataggccggctacccgtgaa

SEQ ID NO: 528976 - DNA, 168 bp, Homo sapiens
aaaaaagaaagcataccctaatgcagtgatatcacatatctttcatgtgtgtcatagttattatgtatgtcttctctggagaaattgctatacaagttcttatgctcattcttaaattgggtttgtttgttagtatgagttatcgttctttatatatccagtgataat

SEQ ID NO: 528977 - DNA, 290 bp, Homo sapiens
gctccataaaacaagaaagaggaggatgtgagatctagttgtattagttcgttttcatgctgctcataaagacacacctgaaactgggaacagaaagagggttaattggacttacagttctgcatggctggggaggcctcagaatcatggcatgaggtgaaaggcacttcttacatggcagcggcaagagaaaaatgaggaagaagcaaaagtggaaacacctgataaacccatcagatcttgtgagacttattcactatcaccagaataccagaatagcatgggaaaga

SEQ ID NO: 528978 - DNA, 302 bp, Homo sapiens
ccatcttattgaacagcaaatttgaagttatcaggaaactttgaagaggccaggtgtagtggctcatgcctgtaatcctagcactttcggaggccgaggtgggtggatcacctgaggtcaggagttcaagaccagcctagccaacatggtgagaccctgtctctactaaaaatacagaaactagccaggcatgcggctgcatgcctgtaatcccagctactcggaaagctgaggcaggagaatcacttgaacccaggaggcagaggtagcggtgagctgagatcacgccatcgcattccagc

SEQ ID NO: 528979 - DNA, 458 bp, Homo sapiens
  misc_feature (23)..(23): n is a, c, g, or t
  misc_feature (385)..(385): n is a, c, g, or t
  misc_feature (413)..(413): n is a, c, g, or t
  misc_feature (428)..(428): n is a, c, g, or t
  misc_feature (442)..(442): n is a, c, g, or t
  misc_feature (458)..(458): n is a, c, g, or t
ggaggcaagcagtcgtaaacacnttgacacattgcaggtgttgaaaagtaattgaagtttgaagaggacataaaatcagtctttcactaactaacctctattccttgggattgtagaaatttaattttttaatgtgtaaattactcctacccctgtacagctgtttcctacccactcttgtaaactctgctgcttcccaacactagagtgcaatgttgatgtcctagaagggaaacgacagtttacaactgcggccctgtttgttacacggtgtgtccttccgtgtcttcactgtgctgagtaactgtgttgagggactctgctccttgattttgcctttctgtgagtgtgtaatcctgggttacattacatagctgccaatgcntttcaatttcccctttccactaaaatgncctttttttttaaanggaatattggacanttagattaaatggccn

SEQ ID NO: 528980 - DNA, 1075 bp, Homo sapiens
  misc_feature (12)..(12): n is a, c, g, or t
  misc_feature (94)..(94): n is a, c, g, or t
  misc_feature (130)..(130): n is a, c, g, or t
  misc_feature (145)..(145): n is a, c, g, or t
  misc_feature (154)..(154): n is a, c, g, or t
  misc_feature (169)..(169): n is a, c, g, or t
  misc_feature (198)..(198): n is a, c, g, or t
  misc_feature (254)..(254): n is a, c, g, or t
  misc_feature (276)..(276): n is a, c, g, or t
  misc_feature (287)..(287): n is a, c, g, or t
  misc_feature (316)..(316): n is a, c, g, or t
  misc_feature (318)..(318): n is a, c, g, or t
  misc_feature (325)..(325): n is a, c, g, or t
  misc_feature (343)..(343): n is a, c, g, or t
  misc_feature (346)..(346): n is a, c, g, or t
  misc_feature (356)..(356): n is a, c, g, or t
  misc_feature (362)..(362): n is a, c, g, or t
  misc_feature (366)..(366): n is a, c, g, or t
  misc_feature (390)..(390): n is a, c, g, or t
  misc_feature (405)..(405): n is a, c, g, or t
  misc_feature (407)..(407): n is a, c, g, or t
  misc_feature (438)..(438): n is a, c, g, or t
  misc_feature (443)..(443): n is a, c, g, or t
  misc_feature (450)..(450): n is a, c, g, or t
  misc_feature (460)..(460): n is a, c, g, or t
  misc_feature (466)..(466): n is a, c, g, or t
  misc_feature (505)..(505): n is a, c, g, or t
  misc_feature (512)..(512): n is a, c, g, or t
  misc_feature (527)..(527): n is a, c, g, or t
  misc_feature (545)..(545): n is a, c, g, or t
  misc_feature (566)..(566): n is a, c, g, or t
  misc_feature (570)..(570): n is a, c, g, or t
  misc_feature (588)..(588): n is a, c, g, or t
  misc_feature (619)..(619): n is a, c, g, or t
  misc_feature (681)..(682): n is a, c, g, or t
  misc_feature (686)..(686): n is a, c, g, or t
  misc_feature (688)..(688): n is a, c, g, or t
  misc_feature (693)..(693): n is a, c, g, or t
  misc_feature (710)..(711): n is a, c, g, or t
  misc_feature (734)..(734): n is a, c, g, or t
  misc_feature (742)..(742): n is a, c, g, or t
  misc_feature (746)..(746): n is a, c, g, or t
  misc_feature (748)..(748): n is a, c, g, or t
  misc_feature (758)..(758): n is a, c, g, or t
  misc_feature (763)..(763): n is a, c, g, or t
  misc_feature (786)..(786): n is a, c, g, or t
  misc_feature (858)..(858): n is a, c, g, or t
  misc_feature (867)..(867): n is a, c, g, or t
  misc_feature (870)..(870): n is a, c, g, or t
  misc_feature (880)..(880): n is a, c, g, or t
  misc_feature (889)..(889): n is a, c, g, or t
  misc_feature (891)..(891): n is a, c, g, or t
  misc_feature (915)..(915): n is a, c, g, or t
  misc_feature (924)..(924): n is a, c, g, or t
  misc_feature (939)..(939): n is a, c, g, or t
  misc_feature (951)..(951): n is a, c, g, or t
  misc_feature (955)..(955): n is a, c, g, or t
  misc_feature (959)..(959): n is a, c, g, or t
  misc_feature (961)..(961): n is a, c, g, or t
  misc_feature (963)..(963): n is a, c, g, or t
  misc_feature (967)..(969): n is a, c, g, or t
  misc_feature (976)..(976): n is a, c, g, or t
  misc_feature (980)..(980): n is a, c, g, or t
  misc_feature (984)..(985): n is a, c, g, or t
  misc_feature (998)..(998): n is a, c, g, or t
  misc_feature (1007)..(1007): n is a, c, g, or t
  misc_feature (1014)..(1014): n is a, c, g, or t
  misc_feature (1058)..(1058): n is a, c, g, or t
ctggacaagtanggcgtgcgtgctggatacatcgacctgtgtgactccggacactcgtcgtgaagacatcagcgccatctccccgcctgtaggnttcctccgcacagaacccgtttcggggcctcagcancgtctggtgagatgntgttgccgntgctgctgctgctanccatgtgctggagccgtcgcgaggtcaanagcgccccggggcgtctcccctccaccgagatgcgatcatctgtgctacgatgganatcacagacgacctctctccanctgaccgtggnacgagtttcgggccgacccaatcctcacntntgaatcnagagatccaagcggatgnacntaattgccgnacgtgncaanagaagtggtcgtcgtgcacggagnccagaggcacggacngnccctgctccgtaaatggccagactctccganatgtnacccaancacctggacntaatanagccccctggtaataatcccccatccatatccggagctnaacagantggatgatttgctgnactgtgtgacgaatgganacaagacggagttacaaacangcgngcgatcagtctcgtgaanaatcaccctgtcaaaggagcaagtggcccgntaatggacgagtagcagttcccttgccagccagcaatggtccggagagatcaccccgacgtnngggntntccgntcctgcaagagagaatnncttagttcgagagagctgtgaanaaagagcncggngnagcgaagaangacancaaaaaagcctcaatctgagccntaccagagcctggagaatgagagatcttctgggatagaaccaaggctggatgactgcatgcgggacagctgnaagtgaggnaangctgaatganagccagcananatgatggccaaaatgagccagcanccagaaagnctgtggggaaggagnagactggtctgnctgncaangncncaannnagggagncagngagnntgggcgggctgantgcctttcnagggagnctgtgaatgaatgaacatggcactgggaacggttcttcgggtgntctgtagtctgcgagac

SEQ ID NO: 528981 - DNA, 997 bp, Homo sapiens
aaatgcaggctgtactggcctgggattttgggcttccggttggggggttccaggctcccacagaaggtgacgttgggtgaccacatgagtatcctgaactgagtgaagatgttaatgatgcttaggaagtttagtgtacgtgcacggagaaagtgtccaggtagagggaacatggatatgcagaagccaggaagtgaggtgagatcatagctgtatgctttggaaacagaaagaagtaataggcctgagtggatgggagagatggggaacgctggagaagaggacttgaggcttgtgtggcgcatgcagtgatggtcaccactttgtactacacccagatacagatgtccactgaggggcccattgccactcccctccccaggtccctgaatgacttcatcgtccgcgagagctgtttgacacatgtccaagttgtacatcatcaccaatgccagagctgcaggacacaaagcgttatcactgtctatgtgcaacatgactgctgagtcggatagtcctgtgtgcatcgaaacactaagaagtacagcacgaatggctctcctcttcaacctgtggcttcgtaggtgtgatgcaccaggacaatgaacctgcgcacctacgagcccacttgtttaacaatgctggctggactaatctgatactacacataagaagggtctgcaaattgagaataggagctttgtagatcatacacagacaagtgcatgaagttatggagcgaaaaggtgtgttccccattagtactagccaataaggttcacccacataaaccgtagtgtgaccaccttgtcaaaagcgacaagcttcaaatcgacattcaagggggcgaaagccaaatccagagccaacgggggggttcctgagggaatagtagcagccaaaccgaatagcattctctcaatagcatatctggaatgacgccttacgactgacggatagtgttcagatcggttccattgtgacagagaagatgcaa

SEQ ID NO: 528982 - DNA, 280 bp, Homo sapiens
  misc_feature (21)..(21): n is a, c, g, or t
acagagacagagggtgatgtntgaggtggactctgaagaagatgtaggattatcccacaaggacagagcggaagcagagtcctcaggcagggggaatcatccaagtggctaccaaggcggcacaagccatttattaaagaaatgctattgtgaatgccaggaaaggaggtttggggagatggtgttttcaattgatttccttagaatcttttgaaatgacccaataagtaatcacctcttaacccctgtctccatctcagattttatccagaattccaga

SEQ ID NO: 528983 - DNA, 167 bp, Homo sapiens
aagagaatcgagagagagccgacaagtgaggtccaggagagggcaggagaagaggagattcccatagggggattacactttcttttcttttttctttctaagacaggtctcactctgtcgtccaggctggagtgcagtggcacaatcttggctcactgtagtgtagg

SEQ ID NO: 528984 - DNA, 400 bp, Homo sapiens
  misc_feature (254)..(254): n is a, c, g, or t
cctgaaaagaggattctctaattctgtacatgagctgaattccgtgctcagcccagagctgcacatacaagagacagagcccaggcaacacagccacactctgaactgacactcggaccaccaccaccaaacaaaaggcaacgcaggacctcagactaaggctaagaggctgattgcctgacaaaacagaaaaaaaagaaacattcttcagggattttagcagaacacagagtctcccaacaaaaacagacagnctcatgcacagcagttcagaactgtaaaaataccttccaacctgaaaatacatgtgctgtcataatcataagggaaaatgtattttttcctgtattgaaaattgcaaaacataaatctgactgttaaaagaaaggaacaaaaagta

SEQ ID NO: 528985 - DNA, 159 bp, Homo sapiens
catgagtgtccagtcgtgtgcatgaatttcaccccaacttgtgactgctcacttatgacggctcccccagtaccctccatctcaaatagggttggggggcctctggaaaagaagagagacaaaaagacagtgtcttaatcagattgcagattaggctca

SEQ ID NO: 528986 - DNA, 765 bp, Homo sapiens
tgggttataaaaccttagggactaaaataaatataaaattgggcataaggtgggatggaatctacttttgggcaaaatttaaacttccccacttattgtcaaaattaatccattcatgtgcagctctcgtggtttttgtggctgggggttcgaattgtgggttgtgggttttggagtctcgtggcctcgtgtcacccgaaggctgttgcagttgcagcgtggcgttgactcgtgcaaccttcgtgcccccgcgggttccaagcgattctcgcgtgcctcaggccctcccgagtatagcctgagattccgggttgcgcgccaccacacttgggccatacattttgggtatttaatacagataagaagacgggggtttcacacgcaatgtggtggtgctaataggcgccgggatcatcctcccttgaccctccagggttgactcagccccaccttcgggccttcacacaaggtgcgggagattacacaggcgcgtagacgcacaaccttttgccccaaagccccaccattttccatcccaatgttgctcgacatctgagacactcttgtggcgcaacaaacccaacgcctttggtgcttgtcccgccaacaccacacttttattatcaccactggaacacctggtttgggacaactcacacgcgttttatatcctatatcacatgagatgcccagcactttaggagttaccctcccaggggcttagacaaacacgggttggtccccagttaacaaaatcttaacagg

SEQ ID NO: 528987 - DNA, 218 bp, Homo sapiens
ccaatggtgaccaatgactggacacgcagctaatagcggctcccacggcctgaccctgggccggggtgaaagctgaggcacttgtcagtagcacatgggcacctgctggcttctatgccactgcaggcgggctgaggtcttaaaagcgagaaaaacactagcttagaaaacccctttttcctaaaaaagtgccctggaggagtgagcagctgactgaa

SEQ ID NO: 528988 - DNA, 450 bp, Homo sapiens
tatccggcagtaagcgctgtttggggccagtgccaggtccgcatccgctacttgggggaaaggagaggggagccccactcccttttgcccctgagccgcctgtgtgtgcgccccaacctgggggatacccgggtcggccaggtgtttgccctgcccttgccccctgccataaagggctacctgttttaccagtgagccctgtgataccccagattgtgttgaggttttgcccccacccctccccttggggaggtggggaggcactgttggcctaaaccagctgttgaaagctggtgggggtaagcccccccccccccccaagctttggggaaatcaacacccccaaacccccttggagggaggaaaaaagggagccggcgttcaaggctatgccagtttgctaccccaaacattttttcaagtaaaaaaagtaaaaaatgttgttataga

SEQ ID NO: 528989 - DNA, 377 bp, Homo sapiens
agcaggtcccagtgtctattgttcgtttctttatgttcacgtgtactcaatgtctggctctcacttattagttagaatatgcgatattaaggccaggtgcggtggctcatgcctgtaatcccggcactttgggaggccgaggcaggcagataacctgaggtcgggagttcgaggccagcctggccaacatggtgaaaccctgtctctacaaaatataaaaattagctgggcgtggtggcaggtgcctgtgatcccagctgctccagaggctgaggcaggagaattgcttgaacccaggaggtggaggttgcggtgagccgagatcgtgccactgcactccagcctgggcatcagagcgagactctgtctcaaaaaaa

SEQ ID NO: 528990 - DNA, 130 bp, Homo sapiens
cttagaggatcctgttgctagctggagtgtagtgcggggtatacggcttactgcagctcaactcccaggcccaagcagctctcccgcctcagcctcctgagtagctgagaccacaggcctgctgcactgg

SEQ ID NO: 528991 - DNA, 554 bp, Homo sapiens
  misc_feature (406)..(406): n is a, c, g, or t
  misc_feature (427)..(427): n is a, c, g, or t
  misc_feature (440)..(440): n is a, c, g, or t
  misc_feature (491)..(491): n is a, c, g, or t
  misc_feature (514)..(514): n is a, c, g, or t
agaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactgggaaaacccgtttgcacatattggactngggaagggtgatcttgggtgnaaatgggaatccncttgccacttcttttttcccaaatggaaacgggcaacgatttttcaggccngtaacaggcttttttcccaaccngatttgctagtgggtagggcgattacttgtggttgtaaaa

SEQ ID NO: 528992 - DNA, 324 bp, Homo sapiens
cgtggcctggcttacttggtgacgtgcatagctctctctggggggctgcagctcatcttgggcgggagctggactcagatgcccccgtaggtgcaatagcaccatccaaatctcactcctcccggtgctttttgcggtattcctgctgcgctttctccgccacggttctccataaatttagggttcttcctgcagacttctatcaggcaccgtcacagtgatgggatcagagtcgaatagcttcacgaccacctcagtgacaccggaaggaacgtccgactcagaagtgtgggaagccaccgtggtgacccacatccgtactgg

SEQ ID NO: 528993 - DNA, 872 bp, Homo sapiens
  misc_feature (70)..(70): n is a, c, g, or t
gctaggtctgccatgtatgttggttcctctctatcatattatgaggaaaggcacccattactccgtgtantatagcctgtccatgactacatttaaccgtaaatgatgctgtccgtcagtctctgcagtgtcctcttattaacacgtaacacattactacttatctgaatatttaacatgactagcttataaccctcgtttacgcactgtcgttcagtgcaaaattagcacacacctgcttctcgatccatgattcgctgtttcccgtcccatcttttccttaagttccatccaatacgtaactccctccatacctcttaccaactatttcgttacatagttataaacctcagcatcggagggtttcacccctctaaaccgctcccctgttgattcatagctagtttccaatatgggaacaaccaaatagggttactagagacattaacgaagataacaacacggaacataaccgggacggcacatacacatcctttacaaacgtcccataacaattactttatcccccacaaatgaattttcccaataagaaaacccagggacgaaaacagtgggcgaacggtcgctttgaacggttgtgaacaaactccggagataagtacttccccggagttggagatgccccccccgagttccggggcattacatacgcttaacatttcacgagaggacggttccttggccagcttccatgaaagctggtccccccaaaaatttcaggggccttcaacacgagacccagaattgcaattcccccgagaacggtactcaaaagccaataaccaactttcaacgcgcgtaacaacggactcgcggggggtattactaacgtgtcccaatgtctcctggaa

SEQ ID NO: 528994 - DNA, 1085 bp, Homo sapiens
gacggtcagccaggtacccccatggccccattgcccctacccccaaagggtgctaccctagcaggttccctacccccaatggggctacccacatgggtcccctgaccacaacgagcggctgtacccacagggatccgctaacccgcgaatgcgggaccatagaccatcagcgtgcccatgagtcacccagagacaacttgaacgatcacagatcattgtctccccctcgagcgcacagtactccgattgtggaatcgtgaggctccatcacttgtcctcgctgtccacccttccaggcacgactgttgtgatcatgacacagcaggaggtatgacgacgtccggccccctcgcagtcggtaccaaccaggaaaatgcattcgtaggcggagctagtgaccgtgtagttcgctgttagcagccactcttcgtctgaaccagaaagcctagacttggctgcagaagaaagctcatggactgagcatctgggcagtgggcctttcaactggctgataaatgggactatgattactcagatgcacaggagctgtttcgttggtgacaccaaaaccttacgcgcgccttcgccatacctcccccggcaaccttccacacacaactcgtgcactccccccgagctcgactacgcgtccaacgcccccgactacaccggacggtgaatgagtcacaccggaagccaatatacacgcccaccagcgacgaattccacaaaaacgatttgtcttggacccgacttaacaccgtggttccgaattttgaccccgaccgtagatccccgtcctccatgccccactgccgacggacgactacctagcatctgatcccaacaccaaattcctcaaccaacaccatcccgagcactacaatcatcccccttcatctccccccccccttgcaaacagacccacacccaccaaacaccctctcatttccacatagcagacacccaatcctgacccccaccatttcctcactcttgcccaaaaaaccccacaaacactgcacattcaaaacaaacacactccactgccactcgctcgactccacaacaactgaacgaccacg

SEQ ID NO: 528995 - DNA, 248 bp, Homo sapiens
taattgcaggacttgtgagagttactttatgtatgctgttcagagagaggtggagctatcaaggcgaagcctcgagcagcttgttgagaagcacctcaggcttagcagggtggccacaccattttgacgcccctcgaccgccagcagcaggttggagacctcccctccttgcccgtttgaggaccaccttcagccctcctaaacccgccccgccttggccgcctgggtttaagtgggtctctttaagc

SEQ ID NO: 528996 - DNA, 188 bp, Homo sapiens
tatgactttatcttgaactttaactgcaacttgtcctttcacgggatcttgatacataagaatggaacacggacttagacagtgtcttgaacattataacaggaactcccgtgacagctgcctctagaaccagcgtcccaacgatgaggaacaccaccacgatcaagaagctgctggcccatcatggt

SEQ ID NO: 528997 - DNA, 254 bp, Homo sapiens
ggcacaaagggtattatatggctggcttagtcaaagaagagagactaaacaagggtaaaaattttaacagtacagaattggccatcatatcatggcctggattctaacggttggtgtcctaagatgcaaaagaagtcagtggcttttaactgtttacaaatagaaggtgatggtaaaaggtacagttgggtggtgttggaattatgaaatttcttcagatataataaaccatgacttttgggcggctcaacatt

SEQ ID NO: 528998 - DNA, 327 bp, Homo sapiens
taggtgactctgaggatcccctatctgctccatcagtctaacataggaaaatgctactccctaggtcaccactggtctcctaattgtcaaatctttcttctgttctcattctttcatctgtctctgtcattcaaaacatttcatacggctaggcgcggtggctcacgcctgtaaccccagcactttgggaggccaaggcgggtggccttgattgcttgaggccagaagttcaagaccagcctgggcagcatggggagacctggtctctacaaaacaagtacggaaagtactgggtgtggtggcatgtacctgatgggagaagatgcg

SEQ ID NO: 528999 - DNA, 1384 bp, Homo sapiens
gacactcgagctaagaccggcgacattggtaggaacgtgtcgtggggtatcgggaagagcgagtaccgtcactatgcgtcacatattcactctactacaattgcctattcccttaggcaagcattttaatagtaatgtaagtatggcctggaaggtaacgtgccacctaatgtgtagatggaggacggtgcgtcgcacagtgttgaccgttgtcaggcccgaatgacttgtgtggcaccgtcatgatccctgtgcatcatctacatagccttgtaaattccatacgaagggagatgtactcgcatctacggggtcagctatagatcctccgtagactgcgtggcgtagcactggcgcgttgagaaccgacggaatttcggctaagtagtaccgcaagaccatgaacaaggaactcccctctctggtaagcattgtgtgcaccgatgggttaaccacggagccgtgaacagccatttggtagccttcattacgcccagaaaccgcaacagcgaaaacgggtagcgcctctggaacattgtttggtgtgaagaacaagcaaggtccctttgtgcgccatggagccctatatagctgtagactcttacttgttgcaactagaattcccctggggaattccccaatttgggccaataggctggttgagctagcttaaactggccatttacacatgcgtgtaatgcgggcattctgtgtcaaagaagccattggagcttcactagaaatccaagtttccttcgccaattgaggattagcgcgccccagctcctagctggttgcattatgggccataatcaaaaactttccttgggcgcctacacctgtgtggcgcatggtgtcgcgcgcacacgacaacaaccacggaagcggctggcgagcatggaatttccaacccaaatatgtccacaccacaccagggcacttgaaacttgcaccccaaagggtaagtgccatgtgggcaggaagacatcttaaactaaggctatcgaggaagggtgtcctccattatatcaacctttgactggggcagttggcctatggaatcggcaattgagggtttgaaggtgctcccaagttccgcgtacagggggcagttgctcgccaacagcagacttgacatcccctaccccattgctttcacgacgaactgggaattcacgcaaccaggacgggtccccgtgacgcaaatgtaataatatgtgccaagtagcggctcccaaaactagagacaaattgtggtctgacacaagaaaatgaccaggtcctctccgaggagctcaggtcataagtggcagtagtgacccaactccaaccccacttacactatgggtgcagcaacagaggcaaacgcgtatttcacaaacgg

SEQ ID NO: 529000 - DNA, 325 bp, Homo sapiens
tctaaggatctcgagcacatctgacccagagagtagcagtatgcagatttattgcaaagagcgaaagaacaaagcttccacagtgtgaaaggggaccggagcgggttgccactgctggctcgggcagcctgcttttattctcttatctggccccacccacatgctgctgattggtagagctgagtggtctgttttgacagggcactgattggtgcgtttacaatccctgagctaggcccaaagttctccaagtccccaccagagtagctagctaatctggtggggaggtggagaactttgggcctagctcagggattgtaaacgg

SEQ ID NO: 529001 - DNA, 598 bp, Homo sapiens
gaatttatttggacaaaaacgcactggatacaaggctgtactgcaaacgagcttaatgcgtattaacacatggggaggtcttgcccctccggattggataacctattaaaccagcgttggctatggaattacttagccttatagagacggacggtaaaaaggcttcccatatagattttaagaccgccactcaagttttattggaggatgatgcttcattcccgaatgagggatacaagggctttattcatgtgcgatagtagaaatcaggacgaagcgtagatatacaaccataaatggttatataaaatcgttttttgcgctgggctagcggaaaacccacgggctaagtatttctggatcttgaactacaaaatccacttattttaccagaccaaagtggaacttcgaattgacgaagctatattgaggttgagagaaaatctaggaaaaaacggcaagcatgactttgaaggtgtgtctacagtctaaacaggtaattatccaacaaaaacccccacgtcatacttatacggtaatatcctgagtcccagcacatagaacactttcaaaagaagataggttgcgtctcaccccc

SEQ ID NO: 529002 - DNA, 534 bp, Homo sapiens
  misc_feature (6)..(6): n is a, c, g, or t
  misc_feature (64)..(64): n is a, c, g, or t
  misc_feature (70)..(70): n is a, c, g, or t
  misc_feature (79)..(80): n is a, c, g, or t
  misc_feature (82)..(83): n is a, c, g, or t
  misc_feature (87)..(87): n is a, c, g, or t
  misc_feature (89)..(89): n is a, c, g, or t
  misc_feature (101)..(101): n is a, c, g, or t
  misc_feature (146)..(146): n is a, c, g, or t
  misc_feature (179)..(180): n is a, c, g, or t
  misc_feature (182)..(186): n is a, c, g, or t
  misc_feature (190)..(190): n is a, c, g, or t
  misc_feature (212)..(214): n is a, c, g, or t
  misc_feature (262)..(262): n is a, c, g, or t
  misc_feature (338)..(338): n is a, c, g, or t
  misc_feature (356)..(356): n is a, c, g, or t
  misc_feature (431)..(431): n is a, c, g, or t
  misc_feature (451)..(451): n is a, c, g, or t
  misc_feature (466)..(466): n is a, c, g, or t
  misc_feature (470)..(470): n is a, c, g, or t
  misc_feature (478)..(478): n is a, c, g, or t
  misc_feature (481)..(481): n is a, c, g, or t
  misc_feature (488)..(488): n is a, c, g, or t
  misc_feature (510)..(510): n is a, c, g, or t
  misc_feature (516)..(516): n is a, c, g, or t
ggttgnggagtcactgggcctcatgggatacgcccagggcaagcaatgatgagactccaaaccncccccnccccgtccnncnncagnanggcagccaagcntcctgacccaaaaggccctatacagcaatggagccatcgcggaantccgtcctcccaatgaggatgttgaccacaacnngnnnnncgtntcggcactgctgctgggcatcnnncagcaccttgaccacctgatcctcgttctcccgtgagaacagcaagcnccgggcccccagacccatggctgccttgtgataatcagtgtaggccaggccacaggccacgttgctgcccagaaanggcacctgttcccgaganatctgtgtccagccagcatcattccctaccaaggccatcactgggatcttgtgtctgacgaatgtatcaaattcnatgaggctgtagccaaaaantccgtccccaaaaangaancagacctnagnatctggncggcacagcttggccccaagtncaaatnctgcaccaattcccagag

SEQ ID NO: 529003 - DNA, 200 bp, Homo sapiens
tgctgcccaagttggagtgcagtggcatgataatagctcactacagtcttgaactccgggactcaagcgatccactcacctcagcctccccagcagctaggaccacagacatgtatcaccatgcttaattttttattttattttattttttggagacatagggcctctcctttctgcccaggctgctctctcacgttccc

SEQ ID NO: 529004 - DNA, 157 bp, Homo sapiens
cggtccagaatatatatatatttgatgtactttcatatttatatacagtaataatacatgctttgggtactttgatatttttgtacagtatagaatatataccttgggtactttgatattttatgtacagtatataatataaactttgtgaactttg

SEQ ID NO: 529005 - DNA, 505 bp, Homo sapiens
ctctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaa

SEQ ID NO: 529006 - DNA, 651 bp, Homo sapiens
aggacgggaagcggccggggaaatgtccggcgccaaatttggctttaccaggggttttgtgtataaaaccttccccttacaggtgggggccaaaaaaacccaaatccctcgggggcccccccggcccctccggagaactaacccctgtgggaggaaatgcccaacccctccccccgggaaaaggggtttttagcggggaaaaaggggtccccctaaaaccaagggcccccaaaaagggggtgggaaaaatcccgccccgtttcttttggggtgcaagcgccccccaggggaagggtccaccagggccccccccccccttggggcaaaaaaccctaggaaacccctttttaagttttccccccccccccccgggggaggggtttggggcccctcttttgggtccccccctttttttaaaaaaaaagggcggggcggaactttttttgcccttgggtaaccccagaaaaaaccccccgggggaatttgggccttaaaaaaaacaagggtttttttttgaaagaaaaagggcccctaaaaaaagccccgggggcatcttttttaaaaagaagttttcaaaggtttacaaaaaaccccttttaaaaaaagggtttttaaaaaagagggttttttaaaaacttttggtgggtgggg

SEQ ID NO: 529007 - DNA, 992 bp, Homo sapiens
taggggaaattccgctcacgggctccttccaacgggttctgagatgcgaattggctgaccggagacttttgtgtggcgaagtcagagccggagaggttacaggcccaggatccgggtcgatgaaggtctcgtcctcacagcttctgtgtaattctggaccgacttgtgagtctcatcgattccctcccgcttgcaacctacctccagcgccgagacttaactgtgatggccgtaccaactctctcgatgacttcccctcaccgcttccccttccggctcttccccttctgtgcaactgggaccgaggcctcaggcacggctccaggtttatcctgaaagttctcgatgtgacctggctctcaaagagccaagccactctaatcgtcatggtctgctactctccccgatgcctcgatggggctgtgtcatgccttgtcctcacggagctgatgcagcccagagctagaaggctgagctggcagagggtagcccttcgctgggacctgcctcagggtgcataggacggctctcaactctcaggccgttttcctagatggacagtcccagggcccccaggacctcccagccatgggctctccacctcggcctctcctctggggctgggccctgccagtctcttccttcgagcttccccggcacacgtgctctggcctccaggtccgattcctcaggctggccttcaggccatgcggcaatgccaacccccacaagtgggtgcgacacctaagccacagcgacgcctatgtcattctggatctgaggctccccaaacgaggacacgacggtccaaggtggcagtttgtcccacgggaggacagtcgtttcttttccagccatcctggccttcggactctgaatctgggcaggaagagtcctcagtcccaacgaccaggagggggcaatgggcccagcctttctgtggtatctgatgcaggaaggactgcagtggatataacccacggaccaacttt

SEQ ID NO: 529008 - DNA, 383 bp, Homo sapiens
ttgagtaccatacacagagactaaaggacgaacctgagtcatcgttgtagtactagtatccttgggtcagttgagcattgccacaccgtaagccgtcctggactcctgcctcactcatttacaccaaccacccaactatctatgaacctagccatggccatccccttatgagcgggcgcagagataataggctaacgaacataagattaaaaatgccctggaccacttcttaacacgaggcacacctacacccctaatacccatactagaaataatcgaaaacatcagactactcatacaaccaatagccctggacagtacgcctaaacgctaacattactgcaggccacctaatcatgcacctaatagtaagcgcgtgctgt

SEQ ID NO: 529009 - DNA, 355 bp, Homo sapiens
agagtatgtagtaatatgctaaagctttgtaaactctttctttgttgttttggaagatggagtgcagtgatgtgattttggctcactagagtctccaccttctgggctcaagcagtcctctcacctcagcctccctggtttgtggaactacaggggcatgccagcatgcccggataatttttgtattttttttcttttgtagatacagagtctcactatgttgcccaggctagtctcaaactcctgagctcaagcagtcctcctgcctcagcttcctgaagtgttgggattacaggcatgagccattgcacctggccctaaattttaacagatacaaaactataagtttatactt

SEQ ID NO: 529010 - DNA, 407 bp, Homo sapiens
  misc_feature (43)..(43): n is a, c, g, or t
  misc_feature (48)..(48): n is a, c, g, or t
  misc_feature (98)..(98): n is a, c, g, or t
  misc_feature (117)..(117): n is a, c, g, or t
  misc_feature (132)..(132): n is a, c, g, or t
  misc_feature (148)..(148): n is a, c, g, or t
  misc_feature (182)..(182): n is a, c, g, or t
  misc_feature (339)..(339): n is a, c, g, or t
  misc_feature (359)..(359): n is a, c, g, or t
  misc_feature (364)..(364): n is a, c, g, or t
  misc_feature (394)..(394): n is a, c, g, or t
  misc_feature (405)..(405): n is a, c, g, or t
gggacgaaaacttaccctgggtgcatcccaagccccgggggtnaccgngcaacaaaagtgtatccgaaaggcttccggccggccgggcttcggggctncgggcgtctcaaccaaaanggcttcaacaccggngccggaaactcgttcntcgccgggccgcctccttcctccttccctttgcngaacggccctcttccccttctcccttcaggctgggctcttgctgagctcagacgggctccgggcggtgcgttttctcctgcgtcacctcctcctgctcctcctcctgcagcgacggcttcaccttcccctagtcgccgcttctgtccccgctccagnctggtggctttgaagtagcntctcnctcctcccggcgccgacccaagcaccgggnctaaggcgtgncc

SEQ ID NO: 529011 - DNA, 789 bp, Homo sapiens
agcggaggggagaggcgagaccccgcgcgtgtgggagcgggcgtgaagaggggagcaggccgtgtcctgactggacgtgtgcttgcatgcgtggctcgcaccgacagaggtgcctgccggaggaagccgctccgaggcggaagatgacggacgatcgaggactacgtgccctatgtgcaggttacggtcagcgccggcagctactgctccagaacgctgctgcagcgaagacgcaagggagctgcggaggaagagcagcaggacagctggtagtgaaccccggggcagatgaggacgacatcccgactaggcccgtcagctccaacggtcgagcctccgtggactcagcaccagcaccgttaaagagaaggctgaagcgcgcaaagagtctgccagggagaagcagctgaaggaagacgagaagatcctggagagtgttgccgacgggccgtaggcattgcatgtcagtgaaggagatggctgaacgggcattacgtatgatgaccccatcaaaaccagctggactccatcccgatatgttctgagcatgtctgaatgagcgacagtgagcgcgatgcggacagaaataccacgatcctggatggagggagacggtaatccatgacccatcaagagcttcaaggaacatgaccgtttcctggcagtcatcctgagaggcctgaagaagaaagggcattcaccgaccaaaagccattcagatccagggcatccgcacattctatctggccgtgacatgataggcatcgctttcacgggttcaggcagacc

SEQ ID NO: 529012 - DNA, 127 bp, Homo sapiens
ggcgaaggtctccttgacctggacctctccgttctggtcgatcacgaccgtgcggtcgtatacccacatgaaggagggctcaaagcccgagctcgggttgccgtagaagatcgacgtggtagccggt

SEQ ID NO: 529013 - DNA, 573 bp, Homo sapiens
tattctgtcacccaggctttagtgcattggtgcgatctcggctcactggaacctctgcctcccaagttcaaacaattctcctgcctcaacctcctgagtagctgggactacaggcgggcgccaccatgccctgctaatttttagtagagacggggtttcaccatgttggtcaggatggtcttgatctcttgacctcatgatccacccgcctcagcctcccaaagtgctgggattacaggcgtgaaccactgtgtcccgcctaattatgacctcattattatctttatttgaagattatgtataatctcaggagatgtgtatgggttcagttgacaaggggtggacttgtgatggtaaatattgagtgtcaacttgattggattaaaggatgcaaagtatttatcctgggtgtgtctgtgaggctggtgccaaaagattgacctttgagtcaatgggctggaagaggtagattcacccttcaatctggtgggcacaatctactcaagtttcagggaatataaagcacgcaggaaaaagatgtgaaaaagagagataggcctagccctcctgcct

SEQ ID NO: 529014 - DNA, 1645 bp, Homo sapiens
ggccgcctgccatcgaatgcccgaacccagacgactatgtccaagcacaggctccgattggatatctaggcacatatcatataggcggactgtgcagaccttcgctgcattcctcgtctgatgcggcctgatatgcgaacaacggctactgactgtacattgaccatactcatggcccaagcattggcgcaggtaagggaacgacttctcaggaaggccatggaatgaacgtgcacctgaaggcgttggggccaaaaaggatgtatcagttgaggatgtcagcagggagtgtgtggaagggagttacatactcgtgccaccgtgcctatccaggtacgcagacagcagctgctactgtacggacacggcctacactccctcgtggtcacccttcatctctagcactagggccctgaaatcggcgccgacaaaacaaagtgggtaaaatcgtcccaaactggctatgggggcgccaagtatgtatcccacgggggccacaaggagaaactggggaaccgactcagggtcctggttatgaggctcaagctgctactcactgggccccccagaataaaggtcattgctccctgggaggatgcctgaattctaaaaccggttcaagggccgcaatgacctgatggagtacgcaaaggcaacatgggattccatcccggtcactcccaagaacccgggagcatgatgagacctctgccatcagtacaggttgaatctgagaacccagaccagcgctccaggtcttacacaaaaccaggaccagcaaagcccaaaccctgaatttgagatcgtcaaaaaggccgtaagtgacacgtatgtggcacccaaatctggacttgtcaaaattggaacatgggcgatatggaacatgaatccggttacacgcccaacatagcaaggagaacgtcttttgctttctgtagcatcttctgctatgaacgagagaaacaaaacgagaataaaaaagcaaaaaaaaagcagaaaaaaacacagaagaagcaacaataaaaaaaaaagaaaaacaaaaacaaacaaaaaagcaaaaaataaaaaagagaaagaacgcagacaaagaagagagaagagagaggaggaaggaaagagcgaagaaaaagcagagcgaaagaagacagggagagggagaagaaaagagacaggaaagagacaaggaagaggaagaacaggagaggaaaaagaagaggaaacagagaacgagaggaaagaagaagcacaaagagaagaccacagacgacaggggaagaagaagaaaacagacaaaagaggaacagaaacaacaaggaggaggaggaacgaggaagggagagaaggaggacagcaagagaaagagcaagaaagaaagacgagaacagagaaagcagaaagacaacgggagaagaagagtgaccgagaggaggagagagaagaagagagcgagaggatgagaatcaaagagacgagaaaagaacaagaaaacgagagagagaaacagaaagcggagagggagaaagcagagagaagaagcagaggaacacagaaacagacaacgcgaacagagaggaagagcagagagacgcgaagccgaggcgacaaagaagacaggaccaaaaaacaacggagaaagaggagaagg

SEQ ID NO: 529015 - DNA, 160 bp, Homo sapiens
tgagccagactagagctagtgagacacttaccagagttagctcagtagttatacacattgactcatccaggaaaagtaggccttttaaatatatataggtgggcagtgtatccatatccatacttggagttagcggcagtcactgagtcagatcagacac

SEQ ID NO: 529016 - DNA, 199 bp, Homo sapiens
ggttatgccatgtgtccccaaggtgggtgtagggtacagtggcaacatgctggaggctgaaggtgtccctatcccacctctctgaggtcacgcgaggctgggcagagacagggtgatggtgggtcagcgccccggacaggctgcccaccgctgagccctcctctcctctcttctcccacaattaatagcgcagacacag

SEQ ID NO: 529017 - DNA, 377 bp, Homo sapiens
  misc_feature (12)..(12): n is a, c, g, or t
  misc_feature (223)..(223): n is a, c, g, or t
  misc_feature (348)..(348): n is a, c, g, or t
gtctcaaaaaanaacaacaacaacaacaacaaaacttcctaggccagaggtggtggctcatatgtataatcttagcactttgggaggccaaggcaggaggattgcttgaggcgaggagttcaagaccagcctaggcaacatagggagacccccatctctacaaaaatttaaaaattagcctagcatggtggcacgctctgtaatcccaaatacgcggtaggcngaggctgaggagggtggattgcttgagcccaggggtttgaggctgcagtgagccacagttacgccactgcattctatcctgggcaacaaatggagaccttgtctcaaaaaaaaaaaattcctganatcgctatgtattcccaactttatcattt

SEQ ID NO: 529018 - DNA, 801 bp, Homo sapiens
gggctggtctccagctcctgaccgtgagtgatctgcctgcctcggctcccgaggtgccgggattgcagacggagtctcgctcactaggtgctcaacgttgcccaggctggagtgcagtgacgtgatctcggctcgttacaacctccacctcccagccgcctgccttggcctcccaaagtgccgagattgcagcctctgcctggccgccaccccgtctgggaagtgaggagcgtctctgcctggccacccatcgtctgggatgtgaggagcccctctgaccagccgcccagtctgggaagtgaggagcgcctcttcccggtcgcatcccgtctaggaagtgaggagtgtctctgactggccgcaccatcgtctgagatgtggaggagcgcctctggcctcggcgccccggtctgggcatgtgaggagccgcctcatgccctggagcgaccccgatcatgggaactgaggagctgtctctgccggaagcggacagccgtgttactgggaggtgaggacgcgtctcacgcacgagtgcgccccaggctgagaagtgaggagcccctctgaccagctagcctgactccgcatgctggggaacgttgacggagcccctgtcgccagaacgagccctaaccgcgaggcactgcgacgttgagagcagccgcgtaccggccctggacagacaagacgaacgaagcaaggtgggaaaggcagaccccaacgcccaacaacagctgcagaaccgcgcaccaacggagcagcacacagacacgcgcgcactaacagagcaacagaaagagc

SEQ ID NO: 529019 - DNA, 973 bp, Homo sapiens
  misc_feature (2)..(2): n is a, c, g, or t
  misc_feature (92)..(92): n is a, c, g, or t
  misc_feature (166)..(166): n is a, c, g, or t
  misc_feature (219)..(219): n is a, c, g, or t
  misc_feature (222)..(222): n is a, c, g, or t
  misc_feature (232)..(232): n is a, c, g, or t
  misc_feature (242)..(242): n is a, c, g, or t
  misc_feature (246)..(246): n is a, c, g, or t
  misc_feature (248)..(248): n is a, c, g, or t
  misc_feature (255)..(255): n is a, c, g, or t
  misc_feature (323)..(323): n is a, c, g, or t
  misc_feature (380)..(380): n is a, c, g, or t
  misc_feature (504)..(504): n is a, c, g, or t
  misc_feature (507)..(507): n is a, c, g, or t
  misc_feature (775)..(775): n is a, c, g, or t
  misc_feature (800)..(800): n is a, c, g, or t
  misc_feature (969)..(969): n is a, c, g, or t
cnagagcgggcactgggtggggggttgggaaaactgcccaggagccaggtctctcttctcgcctgcgggcgttgcgaggagcggcagcgccngctggcggcgagtgcgtcgaggccctgcgagaggactgtgcggcccaggcacagcgggcgcagcggggccgaanagctgctgcagctgcaggtgttccagctgcgagcgggagaggcggcggttgcnggncgacttgggncagctgctgngggngngcgaacngctggagcggcgctgcgccaccttggtgcgcggagcagcgggagctcgggccgaggcttggggagacnaagtgggaggtgtgccagatgtcaggcgagatctccctgctgtagcagcagcgtgtnagggtctcaggcagagctggtgcggaagggcggcgagctggtggtcgtctgcgggtggcgctgcggggggcccgtgctacgctgcgggtcagtgagggcgcgtgcgcggggtctacggggggcngcncgggctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcggagagtgatgaggccaaagtgcagcgggcagcagccggggttgggggcagcttgcgggcccaggtggagcgattgcgggtggagctgcagcgcgagcgtcgggcgnggtgaggagcagcgggacagctttnagggggagcggctggcctggcaggcagagaaggagcaggtgatccgctaccagaagcagctgcagcacaactacatccagatgtaccggcgcaaccggcagctagagcaggagctgcagcagctcagcctggagctggaaggccgggagctcgctgacctggggctggncgag

SEQ ID NO: 529020 - DNA, 539 bp, Homo sapiens
  misc_feature (162)..(162): n is a, c, g, or t
  misc_feature (198)..(198): n is a, c, g, or t
  misc_feature (223)..(223): n is a, c, g, or t
  misc_feature (241)..(241): n is a, c, g, or t
  misc_feature (273)..(273): n is a, c, g, or t
  misc_feature (291)..(291): n is a, c, g, or t
  misc_feature (294)..(294): n is a, c, g, or t
  misc_feature (301)..(301): n is a, c, g, or t
  misc_feature (307)..(307): n is a, c, g, or t
  misc_feature (377)..(377): n is a, c, g, or t
  misc_feature (391)..(391): n is a, c, g, or t
  misc_feature (412)..(412): n is a, c, g, or t
  misc_feature (450)..(450): n is a, c, g, or t
  misc_feature (470)..(470): n is a, c, g, or t
  misc_feature (490)..(490): n is a, c, g, or t
  misc_feature (525)..(525): n is a, c, g, or t
aatctgcgtaaatcttttcaacactagataggccttttgtcaagctttatgacctaggaatatcttcctcaaggaactgaaatgtaaacagcaaggtagacagcacccatatctcccagtttctgtgggagggtagaagcctaatttggggccgggcgcggnggctcaagcctgtaatcccaccactttgggaggctnaggcgggcggatcacctgaggtcangagttggtgaccagcctnaacatgggaaaccccatctctactaaaaaatntaaaaattagccgggctntgnggcatgngcctgnaatccagctatttggcaggctgaggcatgagaatcgcttgaacccaggaggtggagggtacagggagctnagagtgcccactgnacttcagcctgggtgacagancgagactttgtccaaaacaaaatagtgaggggatagcnaatgcacttaaggtcaagantggagtttaatgctcttttnacttaattaaatggcaggacctgatagaggaccgntttacactggatgt

SEQ ID NO: 529021 - DNA, 208 bp, Homo sapiens
gcgcaccaaggtttccccacatccttcccagcacccttgaaggcccaggcaggcctggaaagcagcggacctggctgttctgtgttgaaggagtttgccagtgcccttgcagggacctgtgagagccacctcacaggcagagccccaccaggcagggcaaggagactcctctcactcccacgccagctggcacagactaccttcttca

SEQ ID NO: 529022 - DNA, 427 bp, Homo sapiens
aagtgtatctcacgtctatcttattgtcattatttgaaaacagctctgtgggtacaccaagctgtggttttgtaaaaagtatacatatttggaggacatctgaaataagatttctattatttattatctttagagtttcataagtaatttctgaaaataattttttcttgtgaatttccaatctggaaaatttctgtagtctatgaaaaagcaaagtatgctaaaactccataagagtttgttgtaattgattattataaagctactgatggtttcttagtgttttcatactataaataatgtgccatggccaggcacagtggctcatgcctgtagtcccagcactttgggaggccaaggtgggcggatcaccaggtcacgagatcaagaccatcctggctaacacggtgaaaccccctctctacta

SEQ ID NO: 529023 - DNA, 491 bp, Homo sapiens
  misc_feature (233)..(233): n is a, c, g, or t
tgggtgcagggaacacagcaggaagctggcctagaagaagggggtcagggtcagtggagatgctcctaccttcaggtaaatgccctcatttgttagggccagtttgagcgagctttctgtcatttaccaccaaaagaatcctagaaaataaatacacagggatctacccccaaacactggagacaataaagaaaaaggaagcagccagggccagtagctggaaggaaattcanccggaggagaggaggcgcggggctgtggtgggagggaggcaatgcttcctgaatcttacttccctggtctttccatcggcctgagcccgtgccagtctggggatctgccggccagccagcacaactgcgtctcccccaggggcctgactcgttgaaggaatgaatgaatgaatgattttgcagggatgggaggctgggagactgagaggtttcattaaacggaaacgctcagatctggtgtttcacaacgtaaaaaaa

SEQ ID NO: 529024 - DNA, 179 bp, Homo sapiens
tggtccgcgtgtcagaagcgatctgaaactggattgagtacgcgggcgcatgccgcccgacaaccggaatgccggtcttggacgcccctcggggcgtccttttttttggttttacggcggctctccgatgcgatacaacagcacttcaagcgtgctcagggaaatccgcagcgagatga

SEQ ID NO: 529025 - DNA, 432 bp, Homo sapiens
gggtccctctgattagaaaagaggctatatggcagatgataagtcatctgtgagaaattaggagtgtgtggaaataaatgtaaacagtggtcttgtgtcatgtaggacacttagataaaaaaaaaaaatgaaaagggatccagtccaccttcagaaaggaaaaaagggcccttccggtactaagggacaaggtaaccccttagagctagtaataaccaagcccctcgattctcgctagaacaaaagaggaacgtgtgaccttaggaatcacggggccggactgaaccctcgagtaaatatctgggttcgaggagaagtttacaaacgctctcctgagccactgtttcaaactttctatgatgaactgaatgtgccagtaccaggtggaaaagaaaagacagttcctagaggggctgagcatgtagactccac

SEQ ID NO: 529026 - DNA, 150 bp, Homo sapiens
cgtgtcgaagatcgggatgccctcgaaggcggtgccgcccttgcccggcgtcacgccggccaccatctgcgtgccgtactccttgcacgtcttcgtgtggaacggacccgtcgcgccggtgatgccctgcgtgacgaccttggtgttctt

SEQ ID NO: 529027 - DNA, 240 bp, Homo sapiens
cagtcataaggcacggggctccaagtcatccaagctctacaggatcttacactcttcatggtacataccaggcacttataaaatgtcaaatcaaattcctgtcaatatcagtgtcactagtagctttccccaaatatagctgttaactcacattaagcatacgtggattagtcatgaaattaaagacagtgccatagcactgagttgcttctcttttcctctctttcttctctttttttc

SEQ ID NO: 529028 - DNA, 786 bp, Homo sapiens
cagctggatgtctggatgaactactgaaagctgctgagtgtcctgcagcaggccatttccaatccagaggaagaccttctagaagaagtgatgggtgggagagtgctgacatactatgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaattaatccactcaaatgttggcaagtggagcagagtcccaggacggggtctcactctgtcacccaggctggagtgcaatggcatgatctcggctcgctgccgcctccgcctccagggttcaggcgattgtcctgcctcagcctcccgggtagctggagctgcagatataatacgtaagtttggaggtggatgctttcagccattaagttcaaaagtactgccacaagggccaggcatggtggctcacgcctgtaatcccaaccctttgggaggtcaaagcaagcagatcgcgggatcaggaaactgagaccatcctggccaacatggtggaatcccatctgtgctaagagtacagaggttggctgagtgtggtggtatgtgcctgtggtcccggctgcttgggaggctgaggcgggaggattgcttgggcccgggaggcggaggttgccggtgaagtcgggattgcgccattgcagcgcagctggttaacagagtgagatcc

SEQ ID NO: 529029 - DNA, 1863 bp, Homo sapiens
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 529030 - DNA, 1157 bp, Homo sapiens
  misc_feature (983)..(983): n is a, c, g, or t
  misc_feature (990)..(991): n is a, c, g, or t
  misc_feature (994)..(994): n is a, c, g, or t
  misc_feature (998)..(998): n is a, c, g, or t
  misc_feature (1000)..(1000): n is a, c, g, or t
  misc_feature (1005)..(1005): n is a, c, g, or t
  misc_feature (1007)..(1007): n is a, c, g, or t
  misc_feature (1010)..(1010): n is a, c, g, or t
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgctggnatccggnncanggcngnacgancnggncacgggtccgggccagtcccacaggagggcaaccatcagcgcccaagagacacactagcgggaccacaaaggagggcacagcccccgaggacacctcgccgcaaaggagggcacacacgccacactgcgaaaagagagtgaccaaat

SEQ ID NO: 529031 - DNA, 210 bp, Homo sapiens
aacaaccccccgggggaagaagaagggggggggggggggggggaaaaaaaagcagaacggggggggggaagagcggtggggggggggggggggggaaaaaacacacgaggggggggagaaaaggaggggcgggggggggaggggaacaacttttcatgcgagggtattggaagttagtatagggggggggggagggaaatattaaagggg

SEQ ID NO: 529032 - DNA, 360 bp, Homo sapiens
cgttatttaatggtatctcatgttcttgcatgtaagcattggttgaggaggaattcaacgtgaacgtttggttctgtgcatgtactatgtgactgtgtcaagcaatgatatgtactataattacttataactaaatacttggttctaaaagcatctcactctcattgagtatgaaatggctcaactagagctatgcatgcattttcaaacacaagtaaactgaacttgagactgtcttccaataatgatctaaattgctcttatagatggattcacaaatgcacggttcaaaaagggtactgactctagctgagctgcccaaccttgaagtaaagaaggccgggcctttgcccagttcgc

SEQ ID NO: 529033 - DNA, 1823 bp, Homo sapiens
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 529034 - DNA, 125 bp, Homo sapiens
gtatgtgcttttctcatgcaatgggtcatgcatgcctactcatggtcccaatgctccctcactgccaccggagactgtgtggcccccatgtctccccatctacctctacccttaacctgtattct

SEQ ID NO: 529035 - DNA, 1765 bp, Homo sapiens
tcaggacgcgcgcccggcccgcagtagtcgctgtcgtccgcagagccagttcctagcgcagagccgcgcccgccatgagggagatcgtgcacatccaggcgggccagtgcgggaaccagatcggcatacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 529036 - DNA, 2120 bp, Homo sapiens
  misc_feature (496)..(498): n is a, c, g, or t
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttgaattacctctttaacatggaacaaccaggtcaaaatgtatatacatctttaaaattgaccagtagctactttgacttgcctaaaaacgtaccagtgcatctgctcagctgcaccgttggtgggtgcctgtttccccggcccctcnnnttggctaacagcacatcatggaatcacttcacaccctccttgtcggtgaccaagcatggtgatgcgcagccctttcctgtttaaacggcacgggactctctttgttgcaggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 529037 - DNA, 1752 bp, Homo sapiens
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtgccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 529038 - DNA, 1449 bp, Homo sapiens
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaaaaaaaaaa

SEQ ID NO: 529039 - DNA, 1306 bp, Homo sapiens
ctgcttcttttgcttcttcctggcgctgtttttgcctcctcttcgtttctgtctttgtctctgtgtgtttcacccttggctttgtgtcggctctcttttttgtgcgggctcttttgctcctgtgtctcagtctgtccgatctcctatacttgttgttacccattcgtccgtgtctcctttttggtgtactttctgtgtctatttgcgttctttttggggatgcctttgttcgtcttggttactcgtcctgttctgagggcgtttcctgtttgggctgcatggtgttcttttcgtggtcgtctctacttgggtccacgcctttgtcaggtttttcttacgtctgacggttcctcattcgcccttcttgtgttgactcttgtcgctatgcccccacttaccccgtccgcccagtcgtctttctatcatttggttgatcctttccagtctgtatcccctggtatggtatcgactctgggcatggttccctgatagtcttatcatctgcgtacctcttgtgaaacgaaccgctcaattgccgcgcttccctttcatttggcccgaagtcttgtgccttggtaagtattccccaagccttttataagcaggtgtgccaggatccctatttctcgtctactggcggacgtccccctgtctgtgcctggtgaaggaagggccatgcccacaagattcgtgaacgtcgcttgctgccagtatagccagagtagtgaaggtcccccgcccttggggtgactctgtgtgtgcacccgcttaagctctgggccccccatccctagttgtgcctcgcttctggccagggtgctgcacataatacgcacaaaaaggatacgaaaagtgatcgtaatcacgtggctccgactgaagaacagttggcacctttcgcagatggcccagtgtcacgcgtgataggtctgggtttgcaccctccacgggtctagggacgaacgaactctcttgcgggatgacatgtttcaccgtgacatcttttagtccatgttgtccattagaaggaaggcccacattgcactgcctgctggttgtacctctcgatacaggctctggcacactcgatggagcacactgctcgcatctcggcctctgtgtcaagaggtggcagccgcacctttctgatgagaacggaatctcgggttatttcagccccggcctgcagagtggaagcgcccagcggcctttcctcgctcaccagggaccagtcatcagggccatcaccgtatttcatactactacattaatgaaaaagtgtgaacgagtatagaatcctctctgt

SEQ ID NO: 529040 - DNA, 151 bp, Homo sapiens
tgctgaggtcactctagaggattcctatatgctgtctcataataaaaacaaaaatcaaatcaacaaaaaagaactttccctaggccagtgtggtggctcatacctgtaatcccagcactttgtggaggctgaatcgggaggattgcttgag

SEQ ID NO: 529041 - DNA, 2010 bp, Homo sapiens
  misc_feature (1893)..(1893): n is a, c, g, or t
  misc_feature (1940)..(1940): n is a, c, g, or t
  misc_feature (1998)..(1998): n is a, c, g, or t
ttttttttttgtgttcagaaaagtacagtgttgacattttattttttatgtaaagaagccatatttacataatacattcatatttttaagtatgttacagctcctgtagaaaaccattccattaagacagcaacaagtgatctggattcaatctttaaaatattaagtcaaattaaaatgttcttatcaagactccaatttaatttcacagcccatctgcacaggggaactgaggagaaacaggaatgaagagtgggcgacaaagagaaagcatcccttcccacacgccaagagtccagtgcaacgatccctgccacacggtcagccgaccccacttggtgccacagggtccagcctcggccactctgggctcaacctttccagcacgtctgggagcccaatgaggctatgggacagtgtgcatttccctcaaggcctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggacagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaagttcaaccatatcattcttatctaatacttctttttctaacaacagaagagcaaccttctccacgtcagctttcttttctgtgagaagagctactgttcttttataagcatcattaataagtattcgtacttcatcatctatcaatcttgcagtggcttcactgtaaggtttctccaataccatgtccccctgacgtgggaggtcaaaggagatttgcccaaccttttcattcatgccaaactgaacaatttgggcatatgcactctgagttacttttctcaagtcatcttgagcaccagttgtaattcttccaaagaagatttcttcagagactcgaccacctaaagtcatacacatcctatccaagagctgctctttggtatagaggtattgttcttttggtaaatactgagcataacctagtcctttgccacgtgggatgatggatacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccanaaactcagatccactaacggtgatgaaggggacattggcttctccgnctgtggccttagctagcagcgtcttcccagtgcctggaggaccagtgagaatggcacnctttggattttg

SEQ ID NO: 529042 - DNA, 1849 bp, Homo sapiens
  misc_feature (892)..(892): n is a, c, g, or t
ttttttttttgtgttcagaaaagtacagtgttgacattttattttttatgtaaagaagccatatttacataatacattcatatttttaagtatgttacagctcctgtagaaaaccattccattaagacagcaacaagtgatctggattcaatctttaaaatattaagtcaaattaaaatgttcttatcaagactccaatttaatttcacagcccatctgcacaggggaactgaggagaaacaggaatgaagagtgggcgacaaagagaaagcatcccttcccacacgccaagagtccagtgcaacgatccctgccacacggtcagccgaccccacttggtgccacagggtccagcctcggccactctgggctcaacctttccagcacgtctgggagcccaatgaggctatgggacagtgtgcatttccctcaaggcctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggacagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaagttcaaccatatcattcttatctaatacttctttttctaacaacagaagagcaacctgaaatatgaacaattttcattaaatacagttactcagcaangtctattcagaaatattaattttttatttacaggtgaccccattccaaaaaaggatttaagaccaatgaaaaagatgtctcatacataaggttgcatagttttagagtaagatgtgcaaaatatcaaagcaaccaatgtccatctgtaagggatacatttccatactagacatatttccactcatctgcacaatgaatgctgaccatctataatgaggaggaagctggccgggcgcggtagctcgcgcctgtaatcctagcacttcgggaggccgaggcgggtggatcacaaggtcaagaccatcctggccaacagggtgaaaccgtgtctctactaaaaatgcaaaaaaatagctgggcatggtggtgtagcgcctgctcgacccagcctacttgcggaggctcgacgcaggaggatcacttgaacccagaggaggcgcgaggtagcagctgagacaacgattgtgccacgtgacactccagcctgggcgcacagagccgagactccatacctcaacacacaacaccaaacacaaacaacacaccacggacgcgccccgacacacaaagaatcacctcgacgagcgccccaacaacagacacgccgtttccacacactatacactggtcccacacgacgcgcactcaaccgacgtaaccactaactcattatcaaacatagacaaccgcgccgcccgcatacacacagcgccaagcatctgaccaaaactgacataagactgagactatattgcgcaacaggacatccacactaacaggccacgactggcacctacgtggaccacaagatcaccatcgcagaccatcctaaacggcacgaccggataactacacgccgaatcaacggctagaaaaagaagcctcactgacaagcccacaaggcagcagcaatgcacttctgccttcccacacccgacccgacacgaagtcatcacg

SEQ ID NO: 529043 - DNA, 2151 bp, Homo sapiens
  misc_feature (2034)..(2034): n is a, c, g, or t
  misc_feature (2081)..(2081): n is a, c, g, or t
  misc_feature (2139)..(2139): n is a, c, g, or t
tcaggacgcgcgcccggcccgcagtagtcgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggcccatctgcacaggggaactgaggagaaacaggaatgaagagtgggcgacaaagagaaagcatcccttcccacacgccaagagtccagtgcaacgatccctgccacacggtcagccgaccccacttggtgccacagggtccagcctcggccactctgggctcaacctttccagcacgtctgggagcccaatgaggctatgggacagtgtgcatttccctcaaggcctccggaaagtcacctgccacccactgtgacctctgaggctgaaaggactaaggactcctttccccatcatttcagctgggccagtggctggctaaaatcagcgcagcattcccattcttctgaaagccacagctgaaataatgcaccagctgaaaccacagtggacagactgagatggcctccctctgggcctctagttggcaactttctcacccgggggctcctctttctccttttcccgctccttgttccagtccttaaggccttctggaagtgaggtgtcctcatccaagctgccagtgccttccacaaattcttcataggtagatttttccgcaaatggtctggggcccaaaagttcaaccatatcattcttatctaatacttctttttctaacaacagaagagcaaccttctccacgtcagctttcttttctgtgagaagagctactgttcttttataagcatcattaataagtattcgtacttcatcatctatcaatcttgcagtggcttcactgtaaggtttctccaataccatgtccccctgacgtgggaggtcaaaggagatttgcccaaccttttcattcatgccaaactgaacaatttgggcatatgcactctgagttacttttctcaagtcatcttgagcaccagttgtaattcttccaaagaagatttcttcagagactcgaccacctaaagtcatacacatcctatccaagagctgctctttggtatagaggtattgttcttttggtaaatactgagcataacctagtcctttgccacgtgggatgatggatacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccanaaactcagatccactaacggtgatgaaggggacattggcttctccgnctgtggccttagctagcagcgtcttcccagtgcctggaggaccagtgagaatggcacnctttggattttg

SEQ ID NO: 529044 - DNA, 153 bp, Homo sapiens
ggaaccgagccacagccagaaaatgcctgacacaggcctgcaggtcagagaccttgaaggacactgcccctggtacttgagggcttgaaggttaatgaggcaggtactggagcctggaggctgaggagggcatggcctggctgtatggacagt

SEQ ID NO: 529045 - DNA, 265 bp, Homo sapiens
  misc_feature (9)..(9): n is a, c, g, or t
  misc_feature (16)..(16): n is a, c, g, or t
  misc_feature (34)..(34): n is a, c, g, or t
  misc_feature (240)..(240): n is a, c, g, or t
tacctttantagtagntagttatgtttttgttantttaccttttttttttttcttaagagatgtggtcctcaagcttggccaacatggtgaaaccccgtgtctattaaaaatataaaaattagccaggtgtggtgccacatatctgtagtcccagctactcgggaggttgaggtgggagaatcgcttgaatccgggaggcagaggttgcagtgagctgaaatcgtgacactacactctancctgggtggacagggtgagaccctg

SEQ ID NO: 529046 - DNA, 172 bp, Homo sapiens
gcgtatgcttatatgtatggggtgctttgaagcacacaatttctggcattaggggtgtcagcaagccatctggactgggcaagatggtggatgaccacgatggtggacccaccttctctaggcagattaacgaagggtagaggcacccttcttcttggagagtgattgagga

SEQ ID NO: 529047 - DNA, 636 bp, Homo sapiens
gggcttcggccggccctcatttgtggggccaccttccttccaacagaggactgggtgggggggggccccggtccttctcccgcgggaaagggggcgggaccctttcccccgggccattccttgttccaatgttgtttacccccggggcttccccgggccccgcccccctctccaaggggtggccgtgttggtttccaccccgagcgggccaagtttccccccggggtaaagcggcaggactggatggaactgttcatttacccctttaagttggtgcccagggacattgtgggggaccccgagaccccgttggccctttgataaagcccgggcccccgcccagcgggggtgggccctccctgcccccctagtttcccaggggtgcccccgacggggtggttttcagtgggggccaaagttttggatttggggtcagggggggtccagtccttccaggggttttggggcggctcccccccttttcccatgttgggggcccccgggtcccttgttggggggggtttttccagtttttcccccgttttccgggggccgctttttttttaagaccccgggtctttggtttttgggccccccccaggtccagaatgccctcgccggccccttttttcccca

SEQ ID NO: 529048 - DNA, 810 bp, Homo sapiens
gatgctgagtgccagcctgtgtgccctgcgcggacactttcagccccgagcctgctggcctgctcggtgtctggacccacgccgcagcttggcctggagatgcagctggggctgcctgcgctgtgcctgcgactgtggctctgcctgggactcctggacggcctggtgacgtggctactccatgacccttcccgaccttgaacatcacggaggagtcacgacgtcatcgacaccggtgacatgcctgtccaatgtcctgcattggtgacatgcaaacccctcgacgtggtgcttgtgccaggagctacagtgacggctgccatgccacgcggacgacaaaggagcatgcgatgggaccactgggtggtgtgtgtgcctgtgaaccttggcgcagcgtgccacgatgaccggccaagtgcccgtacttgccaacgcgttggttgcctcgacttggcgccgaagggttacacttgccaacctgaacacccagtgcaaggctaccgttcttggctcactaacaaggttacaatcccaggggccaccggccatttcggaagggcgccaacacgacgaggaacaggcaccaggcttcgcgtaaactggattgcttgccgggttggaaggatcgaacttttggaggaagacgcatggccacgaagtgctccacagttcgaaacccaaagagcgcattgggaaaagcatggccgacatgatggggtacaaaggcacgtgggacaatgggcactgcccgagttgttggcatgagtagcccccttggtacgtagtggttgttccccaatcagccacagg

SEQ ID NO: 529049 - DNA, 379 bp, Homo sapiens
ggtcagtacggcaccagtaaatgattgatcgccgtgcgatcagttgaaacagcaccagccaggtcaggccacgtaacagcatcccgctctccccctcaaaactcgcgcgcattataagcatgcccgccctatgctccggcattcgccaaaagcatgttgggttgaccaggctgattgcccatgatgatctacattggttctctgtaacccataaaaacgccccttatcaacgggcacataagtgatgaaccaaggagagacgcaatgccctatgtacccgtagcgcagctcaaagattacgtcggcaaggaactgggacgttccgaatggctcaccatcgaccaggcgcgtatcaacctgttcgcggaagccaccggcg

SEQ ID NO: 529050 - DNA, 957 bp, Homo sapiens
tggttccgcccgaaagccccggggtaggtgtggaaccccaaggggaaaacccgggggatatttgcggccgccgcccatgccgtctcccccgtctggcggttggggggggttgttgcctcagacccaccccaaacccgaacacatgtgagagggcgcaacaaccactcctctccaagcaacagagggagattactcagcgctccagatctcctgttgtggaaccaaggggcacctcaccgttgaacgctctccagagcaccagctctcccagaacaacggcccaaggtgttttattgatgttacaaacccacattatttgacccaagatgtgttccaacagtgatctcttctcttttaggagacataagaccaaagaaaacctctctatatccaccaagaatgtgcggtattattcacacatatttgtcgtgagcacacaaaacatcttagagaataatcttcaacccccgcggccaaagaaaaagatcatctccaaaacttctgtgccaaaaaacccccgtgtgtgtgagactctgtggaactccaccctcgaactgtgtgtccgaacagaaagaaggcagttgtgttttgtgacacccgaggtgtgtgtgtggacacagacactctttgaagatttctccagaagaaacagcgaggacacaacctgtgccacaacgccttgtagttacccgtggtgagtctcaaactgtgtgtggcaacctctcctcgaggggaacaccccccagaaagaggagtgagggccctccccccacggtggagggggggcgagtattactaccatcaacttcttagggagagaagccctctcgatgcccccaagttgtgttttattttccccggcccccacgcgggacacacacaaccagtgtggtcgaaacactggtaataacttcagaaccggagcctctgccttagccaagagagaaatctatccga

SEQ ID NO: 529051 - DNA, 689 bp, Homo sapiens
ggggagcggcgcaagcggcgacgggactggctgggtcggctgtgctgctggtgcgatgagccgcggggctgtgtctcggcggcaatggggacagcgcgtgggtggccgaggatgctgcggggcggtagctcctggcggcccctagctgggtgactcgcttgcgccgtgcctcacacagccgaggttgggttccggggcacaagatctgtctgctccggttgcgcgcgcgccgggttgagcgactccaagtgtgcttgacagacgactgatgatgatgctgcgtgccctctaggatgcaaggacgaattgtatttgaccaagattgtctcacaatgggttgtactatcacggaggacgaacgtttggaggaaggtttatcgacaggtagtgagaaattcattatctcaagtgacaagagcaaggtaaattcagtgtgcgctggaaattctgtttggacatgattgaagcacaattcctggtttaaacgaaaaggttctggctggtggatgaacagttgatacgctgttgtcgaatgagaacgatgagtcgataccggtagatttggggttggaatgggctgggcctaagacttctccattccggtccaccgtgtggcagaggctagcgtgggtgggacaaggatcggggagccgctacatgtgtgccttgtaggtgaccgtgcggttgtg

SEQ ID NO: 529052 - DNA, 137 bp, Homo sapiens
actgtttgagagatacgacggatgacagaaacagtagcctttgacctctggggccaggtaatccctggtcaccgtctccacagcatccccgaccagccccaaggtacttcccgcatgagcactctgcaagcacccag

SEQ ID NO: 529053 - DNA, 433 bp, Homo sapiens
  misc_feature (28)..(28): n is a, c, g, or t
ttaacagagtcccgggtctgaaaggtancgtggtagcacagatttttgagacagagtcttgcctctgtcaccaggctggagtgcagtggtgcaatctcggccactgcaacctctgccttccgggttcaagcaactctcctatctcagcctccctagtagctgggactacagtcacataccaacacacccagctaatttctatatttttagtcgagatggggtttcaccatagttggtcaggctggtctcgacactcctgacctcaggtgatccacccgactcggcctcccaaagtgctgggatcatcgccgtgagccacctacgcctggccgtaagtaattcttccacgtgctatcaagaaacttttcacctaacaatcacgttcccttggcttctaagccacccaatttattcatgttatacacactctttc

SEQ ID NO: 529054 - DNA, 289 bp, Homo sapiens
ggtctccgggatggtgctacaacatggtccgtgcctacaccactgggtccccgtggaagcctgagaggcccgggacagcctggagaggcactcggtggcatcgcgagtacacggagagcatgtgtctgctggagagcgagctggaggcacagctgggggagtttcatctccgaatgaaagggctggctgtcttcgcgaggctgtgtgtaggcgatcagtatgagatctgcatgaaattatgggcgtcaggggttgaaaactagggggccagaattgaggttagtggaaa

SEQ ID NO: 529055 - DNA, 435 bp, Homo sapiens
  misc_feature (24)..(24): n is a, c, g, or t
  misc_feature (43)..(43): n is a, c, g, or t
  misc_feature (95)..(95): n is a, c, g, or t
  misc_feature (252)..(252): n is a, c, g, or t
  misc_feature (346)..(346): n is a, c, g, or t
gggagggggggggggggagggganggggaggggggggggaganagggagggggggaggagggggggggggggggggggggggggggggggggggnggggggggggggggggagggggggggggggggggggggggggggggggggggagggggggggggagggggggagggagagggggggggggggggggggggggggggggggggaggggggaggggggggggggggggggggggggcgaggggagaggngggggggggggggggggcgggggggggggcgggggagaggggcagggggggggagatgggggagggggagagaggaagggggggggggaagagnggagagggaccgcattcgtccccacactcatgggccttaccagggtactcgtacgtatgggcccttttatacgaataaggttataaaaa

SEQ ID NO: 529056 - DNA, 855 bp, Homo sapiens
  misc_feature (38)..(38): n is a, c, g, or t
  misc_feature (51)..(51): n is a, c, g, or t
  misc_feature (57)..(58): n is a, c, g, or t
  misc_feature (88)..(88): n is a, c, g, or t
  misc_feature (92)..(92): n is a, c, g, or t
  misc_feature (97)..(98): n is a, c, g, or t
  misc_feature (100)..(101): n is a, c, g, or t
  misc_feature (109)..(109): n is a, c, g, or t
  misc_feature (113)..(113): n is a, c, g, or t
  misc_feature (144)..(144): n is a, c, g, or t
  misc_feature (172)..(172): n is a, c, g, or t
  misc_feature (174)..(175): n is a, c, g, or t
  misc_feature (180)..(180): n is a, c, g, or t
  misc_feature (187)..(187): n is a, c, g, or t
  misc_feature (189)..(189): n is a, c, g, or t
  misc_feature (224)..(224): n is a, c, g, or t
  misc_feature (226)..(226): n is a, c, g, or t
  misc_feature (249)..(249): n is a, c, g, or t
  misc_feature (251)..(251): n is a, c, g, or t
  misc_feature (308)..(308): n is a, c, g, or t
  misc_feature (326)..(326): n is a, c, g, or t
  misc_feature (329)..(329): n is a, c, g, or t
  misc_feature (334)..(334): n is a, c, g, or t
  misc_feature (341)..(341): n is a, c, g, or t
  misc_feature (351)..(351): n is a, c, g, or t
  misc_feature (356)..(356): n is a, c, g, or t
  misc_feature (392)..(392): n is a, c, g, or t
  misc_feature (400)..(400): n is a, c, g, or t
  misc_feature (402)..(402): n is a, c, g, or t
  misc_feature (455)..(455): n is a, c, g, or t
  misc_feature (546)..(546): n is a, c, g, or t
  misc_feature (575)..(575): n is a, c, g, or t
  misc_feature (642)..(642): n is a, c, g, or t
  misc_feature (733)..(733): n is a, c, g, or t
  misc_feature (740)..(740): n is a, c, g, or t
  misc_feature (778)..(778): n is a, c, g, or t
ccgggcctcttgcgtctggtaacgccgctgtctctaangccagcccttggngcccgnnccccgccaccgcagcgcccggaagtccgcngccnaaaanncnncccgcacncccnctccccgcaccgtacccggccgcctcgcgcnatggcggcccccggcagcgcccggcgantnntgctnctgctantncttttgctgctgctcggcctcatgcattgtgcgtnanagcaatgtttatggtgaaaaatnanaacgggaccgcgtgcataatggccaacttctctgctgccttctcagtgaactacganaccaagagtggccctaanaanatganctttganctgccatcanatgcnacagtggtgctcaaccgcagctcctgtggaaaaaanaacacttntnaacccagtctcgtgattgcttttggaagaggacataaactcactctcaatttnacgagaaatgcaacacgttacagcgtccagctcatgagttttgtttataacttgtcagacacacaccttttccccaatgcgagctccaaanaaatcaagactgtggaatctataactganatctagggcagatatagataaaaaatacagatgtgttagtggcacccaggtccacatgaacaacgtncccgtaacgctccatgatgccaccatccaggcgtacctttccaacagcagcttcagcaggggagagacacgctgtgaacaagacaggcctnccccaancacagcgccccctgtgccacccagcccctcggcctcanccgtgcccaagagcccctctgtggacaagtacaacgtgagcggcaccaacgggacctgcctgctggccagcatgggg

SEQ ID NO: 529057 - DNA, 282 bp, Homo sapiens
agagacttgctctgtcacacaggctggagtgcagcggctcgatctcaggtcactgcaacctctgcctcctgagttcaagcaattctccagcctcctgcttctactcacagaagcagagagtagaatggaggttaccgggggtgggaggcaggggtttggggagacggtgaaatcattctaaaaagcaattgctccggaggaattggattaagagattctttgcgcagcatgggaactgcaggaaccgtctcgtattctggagattcaagaaggggtttcacc

SEQ ID NO: 529058 - DNA, 309 bp, Homo sapiens
  misc_feature (16)..(16): n is a, c, g, or t
  misc_feature (18)..(18): n is a, c, g, or t
  misc_feature (31)..(31): n is a, c, g, or t
  misc_feature (56)..(56): n is a, c, g, or t
  misc_feature (59)..(59): n is a, c, g, or t
  misc_feature (61)..(61): n is a, c, g, or t
  misc_feature (68)..(68): n is a, c, g, or t
  misc_feature (76)..(76): n is a, c, g, or t
  misc_feature (118)..(118): n is a, c, g, or t
  misc_feature (120)..(120): n is a, c, g, or t
  misc_feature (129)..(129): n is a, c, g, or t
  misc_feature (146)..(146): n is a, c, g, or t
  misc_feature (153)..(153): n is a, c, g, or t
  misc_feature (174)..(174): n is a, c, g, or t
  misc_feature (179)..(179): n is a, c, g, or t
  misc_feature (219)..(219): n is a, c, g, or t
  misc_feature (227)..(227): n is a, c, g, or t
  misc_feature (240)..(240): n is a, c, g, or t
  misc_feature (245)..(245): n is a, c, g, or t
  misc_feature (260)..(260): n is a, c, g, or t
  misc_feature (262)..(262): n is a, c, g, or t
  misc_feature (283)..(283): n is a, c, g, or t
  misc_feature (292)..(292): n is a, c, g, or t
  misc_feature (300)..(300): n is a, c, g, or t
ggaagctgcatccccncngtggtccttaggnaccagttttcgttaaacaaaacccnccngnactatcncggttttntattctccgtctgaactctattcaaacgtatcttcgctctcncngggcttttnttttaccgtttcgtttngtttttntctaatcccgctttcatactngcccncgcggggaaaaggtacaatatgtcaaagagatgagagagngttatttntccggcaattttntattngcgtttcttatttcngncagttcttttatttacgtccncgcgacccnggtactcnggggggcag

SEQ ID NO: 529059 - DNA, 336 bp, Homo sapiens
agatcaaacagtgcctccaagagcggaaggcaggctcccagcccctcacctgcctcaggtacctgcttcagtgacacctagtgtgcaaactctagccctacctccacaagccctggaacctattagacctgcaccacaaaagagatttaaaatttaaaagctttcctaagggcattgtagctcacgcctgtaatcccagcactttgggggggccaagataggcatattgcttgagatcaggagttcgagaccggcctggacaacatggcaaaaccctgtctctattaaaaacaaaaaaaattagccctgcatggtggcgtgtgcctgtagtcccat

SEQ ID NO: 529060 - DNA, 118 bp, Homo sapiens
gatgcagagaaagtaagccagatgacagattttgatcggtttaaagttatgaaggcaagaaaatgaggaacagaataattcagaatgaaggtaagaaggttcaaaagggaggtcttct

SEQ ID NO: 529061 - DNA, 143 bp, Homo sapiens
acattagactccctgacccctctccccgacttccccagacagcataggatgaaggcaacatatacctcacaggatcatttgatcttgagagtccttcaaggctgacatccaagctcttcacatcccagaatactcatgccgct

SEQ ID NO: 529062 - DNA, 132 bp, Homo sapiens
gggctacagcagatgcacgctgcggcacgggtagttgcactgctttctcttgtagaatcctttgcggtcacaactgggcaggtacccagcacggggcaccatgcgtgggctggctttgagcaccagcacaat

SEQ ID NO: 529063 - DNA, 140 bp, Homo sapiens
cccgggttatgggaggctgaggcagaagcttacctgaaacaagtgatagtatgagacttgactgtagataattgaatccttaaagaaaaaggggaggctgggtgcactaggctcacgcctatcagtctcagtcacgtttg

SEQ ID NO: 529064 - DNA, 125 bp, Homo sapiens
ccggaagcccaggaagacaggcgactggaagtcaactacttccttaagatacatccaactatagggatagataatccggaaaggtttcataggtgggagcagacaatgtagggctccaagcagca

SEQ ID NO: 529065 - DNA, 399 bp, Homo sapiens
  misc_feature (162)..(162): n is a, c, g, or t
cagctcacacaagctcttctctgggaaaagggagagcttgtcctttgtttgtttgtttgttttaactgatggtttcgttttgtttttttttaagatggagtctcactctgtcgccaggctggagtgcagtggcgcaatctcggctcactgcaacctccgacntccctgttcaagcgattctcctgcctcagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggcc

SEQ ID NO: 529066 - DNA, 213 bp, Homo sapiens
ccctttccaaaaaaaagggaatgtgggtccaggacctgattatcccggggggtttttttattccggtcctccaactggttttatagaagaggtgggttttaaaaggttgccaaagttttttttttttttaaactggaagaaaaaaaattttgttgggtttcctacaggggttaggatgttttttccagaggttttttaaaaaatggaacctga

SEQ ID NO: 529067 - DNA, 856 bp, Homo sapiens
  misc_feature (329)..(329): n is a, c, g, or t
  misc_feature (367)..(367): n is a, c, g, or t
  misc_feature (388)..(388): n is a, c, g, or t
  misc_feature (400)..(400): n is a, c, g, or t
  misc_feature (403)..(403): n is a, c, g, or t
  misc_feature (407)..(407): n is a, c, g, or t
  misc_feature (410)..(410): n is a, c, g, or t
  misc_feature (416)..(416): n is a, c, g, or t
  misc_feature (418)..(418): n is a, c, g, or t
  misc_feature (424)..(424): n is a, c, g, or t
  misc_feature (447)..(447): n is a, c, g, or t
  misc_feature (451)..(451): n is a, c, g, or t
  misc_feature (458)..(458): n is a, c, g, or t
  misc_feature (472)..(472): n is a, c, g, or t
  misc_feature (477)..(477): n is a, c, g, or t
  misc_feature (485)..(485): n is a, c, g, or t
tggcaccactccatccagaatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtgggtgcgggagtgccacccccaggnccgtgtcactctctcttttctcctccatgggtgtgtgngtgtgtatctgtctctgagantcctcggggcgnccngggnatntcaggnangggaanggaggccgccctctctatcttgntgcncctcgtnggcactcaggggcnccttnccagtggnagcacgcagagccggggtggagggcgcttgctgggatgtgtggtgtgctggctggctgacggcagaggcgaggaaccccgcatgtctagaagagttgggtcatatttaagcagggagaaaagggagggggtctcccttttcttctcttcttcttctttttcccttttaaagggcccaaaagattccgggtcgttggcaaaaaagcttcctcgggggggcacccggggaagaacatgtgggagggggagtgggcgagggggcatatagggactctccaccatctcggggctcgtggagcgctgacccgtggcacaaaccccagagaggaggcgggggggtccccccgtggagacaagccgtgcgtgcgcggg

SEQ ID NO: 529068 - DNA, 349 bp, Homo sapiens
  misc_feature (1)..(1): n is a, c, g, or t
  misc_feature (3)..(3): n is a, c, g, or t
  misc_feature (319)..(319): n is a, c, g, or t
nanattcggcccgaggggtttttctggctattcttgcctgctggtttccacatgaacttccatgtcaactactgcataagacaatttgtaattttcaaaaattttgataacattacttttataaattcacccacttagaatttacctctttacatttttgagccatcctattcaaagatgattttccttttgttcctactacttttatttctttcagggagattttaaaggtttttaaaaattatatagagtttgcacagttcttactatgtttattcttaagtaggtatggtcatcttctttgggtgtaattgtacangggacttcatggctaaataacccctataat

SEQ ID NO: 529069 - DNA, 195 bp, Homo sapiens
agccgctgcgctgacctcgcctttaccccccactattaaccgtacggggagaacgctctgtgctagataaccacgttctcctgatcaaatttcactcgcctagttacaggatctcaacatactagttcattagcttctttcctgtggtcaaaatatttaccacaacacaatggggctcactcacccaccaccccc

SEQ ID NO: 529070 - DNA, 1191 bp, Homo sapiens
gaaatgatctgctgcatcctacttaaacacctatcagctatttttatctttaaccttatatctgtatgttatgaagtgtgtggggggtagtgtgtgtgtgtgaaagagcgagagaatgatgtcatctaaagttttttgcaagaattatttaggtattatcattagcattaagaattctatcactcccagctttgtatttcatttaaaaaaatatacaaagagctgagtaaatacaaccacatattaatattactccacccattctatttaactgtacagctattattagccacttatatatacttaaaatattcccatgaattatgtccagttcttcttggaaaaaactttggattgagaaatgaacctgcaaagcactcctgcagcgatgagcagctccatacaactggagctccgaaagcatcatactcaggcccaaagcggcctacacccgtgaatctcgtcttactccgccacagcatggtatagaggcgcagtactgtaaatcatagctagaggccatgtcagtgactgtagtagtaagtaggggtcaggtaggggggcatggatatatggcaaaacaaacaacttatggctaatatattatatttgttgccagggggtaaactgtaacctcattgtaagagtctgtgattacctcataggattgatctctctactctgataatactcattggccaagtatacaaccaaggaacaggcgcaatcaaggattacgagcggaagcactgagacacagcacggctcactaacgcaggaaactccaggaagacataaaaatcccggaacgcagagaacaccccacatactacccataccgagagaacagagcgaccctaaccacaacggacgccacacggggaccgaatcatgtcccaaaacaaaccggagggacaccaacgccccacaaaaaacaaaaaggggcgacgcagcaacaaatacccacccaagggacacagaaaacagaaccacaattctcagacaaaaggagccaagaagagagcataaacaaagaacgggaccaaagaaacagagagaacagacaacaaaagatgagaaaaaccgactggacgcgaacccagatacagaggacaaacaatcgtcaacatgagctgaataacaacaaaaaagcaacaacacaccaacacctaccaggaaagaccgaacaga

SEQ ID NO: 529071 - DNA, 252 bp, Homo sapiens
gtccctatgcagctcacagagtcatgagcaatcatggcttctggtggtttcacgcttctacttacggtgcaataggtaactgaaacagaccacaagggtgtgagcctgtggagggtgcatttcccacctgctgaagcttctcaagacattccttcacagctgccatctcctgaggacaggagctgtgcatgccacccgggtatgtctcgacctggaccctggcaggtgtgacaacagaccggagcttctcag

SEQ ID NO: 529072 - DNA, 132 bp, Homo sapiens
agcagtgctgggtcctttccaccatgggcacctgaggaaaggcgaaagtaggtagaggcccgggggcgcccaaacttctccaaacggtggtttcttcccgatggtttcgggagacaaggacccccgagagat

SEQ ID NO: 529073 - DNA, 80 bp, Homo sapiens
ggatttgctggtgcagtacaactaggcttaatagggacatggagcataataaaattaatttgacccaaatagagtaaaaa

SEQ ID NO: 529074 - DNA, 952 bp, Homo sapiens
agcgggcggcccggcggctgcgtactgtctgtgcggatgggaatgtgaatgccccagcgatgcggctgcagcggggccgtgaggagcacgccagcgggaggcggcggctgagtcgtgtgagcatgctgggaagagcaggaaccggggcggagcacctgcatggtctgctggtgcgtgtgcccatcatggcgattcgcaatgaaaagcaccaagtagccccccagttgctgagccacgaattcgtcctgcagaatcacgcggacatcgtctcctgtgtggcgatggtcttcctgctggggctccatgtttgagcataacggtaagagcttctatcattgtgtgttactcttcagtacaatgtcaccctcccagcaagcagaagaacaagctactgacatccagtgtccctttattactatggcatcaaacgatttggctaactgttttcttctacatgctagtggcgataatctattcgatgccgtaactttccaagagtactctgttggctaaaattaacaggcggattgcacttctccaaagactaaaatcacaggcaagttttaatgaattctggtcagccttagctgcggttctacctttttgcctgtgtttgggggcacatttctttctcatctctgaaaactacattttcagacccaattatcttattggacggggctttattccccattaccttgatgacattttcaacatttgacacgtttttcttacttattcaccaggcttggcttaacttggctttcctgctttttccttgaactctactttccagaaaacctaaaaacgaacgatattcctccgtcacctttgtctacattggccttaccttcttccacattgcttagaccttaccttttgaccctgcaatctctagcactgtcctcctgctgctcaccttaatttgttcgaactccttttcacttttccg

SEQ ID NO: 529075 - DNA, 383 bp, Homo sapiens
tatcgaaagtgtctgtacatgtgtgtacacgctaacagggacgttactacccgtgtgtaccaatgccacggagagcaactttatacgtctgagccaatgtcgctcacaagtcgaatctattcccatcacagcctgcttccggcacaggaagaagggatgtggacgatattccaaagaggcgatgctttctagtttctctattatttccaaaacaaaaaagccaaatctttctcccagttttgtttttcaaaataaaaagtaattataaccctgacttgctactaaatgcaggctggagctgtccttaagtaaaagcttttgataaccaattgcctgcactaaatgctattttactgctgcatcttgtctggttgctacccaca

SEQ ID NO: 529076 - DNA, 177 bp, Homo sapiens
ctgcttggactatatgaattgtggagtcggaggaatcttccccgatctctttggactgtgcatcgttatcatccctccatctgggaaaccaggtgactggcagcactctgcatacctccactctcacctaggatagcctgttctggagaggtgggaggggtgataacgatgcatagt

SEQ ID NO: 529077 - DNA, 842 bp, Homo sapiens
cgaagtcttctcccatcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcaaaaaaaaaaaaaaaaaaaaaaaa

SEQ ID NO: 529078 - DNA, 2295 bp, Homo sapiens
ggtattctttctaaagtgcaacagtgtaataaagattatttctagatctcaaggaggatctgaatgatggctataatgaagggcctatttaggtaacttttaagtttgaggaataagagaatggggttagtccacttagggtttccgtatttcctcatgttggccactgaccaagtatgaatatagccatctttaggggtgggcgcggtggctcatgcctgtaatccctgcactttgggaggccaaggtgggcggatcatctgaggtcgggagttcgagaccagcctggctaacatggtgaaaccccatctctactaaaaataaaaataaaaaattagctgggcatagtggtgcatgcctgtaatccagctactcaggaaactgagacaggagaatcacttgaatccgggaggcggaggttgtggtgagctgaaatcgcgccactgcactcccgcctgggcaacagagtaagactccatctcaaaaaattaaaattaatattaaaaaataaagccatctttagtatatgttcatttctttgggatgtgcatttctgtaactcatcaatgcaactgcagtgttctatggagcttcaatggtttccacgtattccagtacaagactcaaactcaccaagccctgcaggggacacccaaatcactctgtggatgtacagagggtatctcagccccctaacctatatacatttgacactggcaaacttttgtgtctcatattttcatttgtcaattgttgcttactctactgacaattctctagccaagatcttttccccgagcatcaggatttcctgtgctgaacccactttctagatggcacagggccccaacccttccatctgccctttctcctctttttagcagcaccaaaatacctatcatttggttttttaaaacctgtcacccttgccttctttcttccacataaatcccctatattaagttaaccacccagtcgtgaccatatcataatcactccacgtcttgatttctgcccttcttctccatcccactatcccacatatcaagtgctctcacttcctgcagttaaggccattcaaatgcgtcccactgccaatcactaggtatatagtgactgcaatctgactactgtcattctcttgccaaaaatctcctaacgatttttggagattttttcaatgggtctttatcacagaataagattttagatttgttttccagtcttgttttgggttcctaccagctttctacacattatcaactgtcagcctttgctcacggtgggcccactctgatcgtatctactccccgaaacagatatagctcatttgaagttgatacctaggtatttctacctccccaaatctctggacacactcactaagatagatactacttccccttttgttctgaatggtcgtctaatgctcccacctccaaacaagagcattctatgaaaatccttcccaactattgtatcttatatgcatttctctttgccgaactccctgtaacacacttatgttgggcaacaggtttcatgtgtaatccgtcaaggtaccaaagtatacctagcactactactgaactgtacacatagcaggtgattcttacagataatactagataacctcctgtcacacgatgctcccaaaactgataacaagatgtatgctttattgagaacaagattccaacacttattttgtattgtgtattcttgaatttttccttccgtctgcctctcaattcatgcatatgtaagtaaagtccaagttgactgctgaaaggtgctcctaccattattgatgtttgtcatcctttctttctcccttaagatcttttctgcattgtttcataattaatgtgctgtcttctaacatgtatcagttgtctggagttgctggaagacaggagcacctcatatctaccccacgctggctgtgtttatcttcgatggagcaaatccttgctggacggagcttatattccatgccacccagacctactgtagaatcaattattcctaatctatgactcgagcgtctactaactcagctcaagcaatctaggcccttcacaaatataacaatgacataatctcttgcaattaatttatggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcaaaaaaaaaaaaaaaaaaaaaaaa

SEQ ID NO: 529079 - DNA, 1520 bp, Homo sapiens
cgaagtcttctcccatcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggggcatatgggggggcgaccgaacaataagctcgcggcgatcccccccctttctttttagtaaaacaagggcgccacctaccaagtcgagtcgcgtttatcatacataatacaggaggcgaaggcggggccgttctaaaaccaatcgatggttggagaaaacacaccgctccgccgctgcattcttttgggaaagcacccacccctgtgggggtgagaacaacacagggcggcacccaacccaccaagaaatccttgagcgcggacaaatacaaccatgcggtgggttagctgacgacccccctcttaatcttgctcggaacgacaagcttgtcgtcgcgttttttctgcttctatcttttcggcggggctggctggtatacatacaggcgactagaaagatgactgagcagacatcgagatgaatgtcgatgtcgctcagagcatgctgacaggagagtgcagaggtacgtacacgaacgacgatacgagagtagcacgacagacatacacaagatagcaatcacactctacaacgaagcacgaacgaccgcacgcacagcaatgacagcatcaaagtaccaagccagtcatgtactt

SEQ ID NO: 529080 - DNA, 517 bp, Homo sapiens
ttgagcctcctctgtgatgaatcagcctgcaccgcttgttcacttggcatcatcttgaagtagctgaatagcccgcccccaacgcagcgccggcccagcacaacgcccccgactccactcagcatcttgctctgtgcagattcagactgtgctctccattccactgtgagagggctcgtcacgcttgggtgctccacttggcaggtgtaaacctctccacttcgaggaactgtttccagcatcaccagggtctggaaggtccagtctccattctgaatcaggcctgtggacaccaacccagccttctcttcctggctgttccggaaccacctgacttcaatgctgcctggatagaaaccattcacagagcagaccaggaggttgtggtgctgcagggtctgggtccttgcaggatacacagtcaccttaggctcaactcgccgctgcactgtgaagctctcaccaagcccgtagttgtgtctgcagtaggtgttcaccgcggcgcgcctgtcttcca

SEQ ID NO: 529081 - DNA, 944 bp, Homo sapiens
  misc_feature (909)..(909): n is a, c, g, or t
cgaagtcttctcccatcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcaaaaaaaaaaaaaaaaaaaaaaaatgcgggccgaattcgagctaactggccatttcgccctataggggtcgtataacattcactggccgcngtttacacggcggactggaaaccctgggttcccaa

SEQ ID NO: 529082 - DNA, 391 bp, Homo sapiens
tatctcaacagtcattacgtaaaataagcatctaccaagatcttgtactccagaccacttggcgtgttagctgtatttctaaaatacacatatcagaacaagatgtcaaaaaaatacccaaaaaacataaagtaaggaactaggggtgtttactatacctatatgtacgtgaaagctaccttttgggttgggcgcagtgggtcacgcctgcaatcccagcggctttggggaggcagaggcaaggtggatcactggaagtcacgagtttgagaccagcctggccaacaatagtgaaaccctgtctctattaaaaaaaaattaccaacaaattagctgggaatggtggcacacacctgtagtcccagctacttgggaggctgaggcaggagga

SEQ ID NO: 529083 - DNA, 236 bp, Homo sapiens
  misc_feature (23)..(23): n is a, c, g, or t
  misc_feature (29)..(29): n is a, c, g, or t
  misc_feature (178)..(178): n is a, c, g, or t
  misc_feature (218)..(218): n is a, c, g, or t
  misc_feature (235)..(235): n is a, c, g, or t
tagtcccagctacttgaggaggntgaggnaggagaacggcgtgaacccgggaggtggagcttgcagtgagccaagattgcgccactgcactccagcctgggctacagagcaagacgcgtctcaaaaaaatagatagatagatagataggtgatagatagatagataggaataaagaantgttaaagtgctttagcacaggacgtagcttcagtccatngctacctcccttctttnc

SEQ ID NO: 529084 - DNA, 380 bp, Homo sapiens
  misc_feature (21)..(21): n is a, c, g, or t
  misc_feature (165)..(165): n is a, c, g, or t
  misc_feature (177)..(177): n is a, c, g, or t
  misc_feature (181)..(181): n is a, c, g, or t
  misc_feature (273)..(273): n is a, c, g, or t
  misc_feature (294)..(294): n is a, c, g, or t
  misc_feature (299)..(299): n is a, c, g, or t
  misc_feature (307)..(307): n is a, c, g, or t
  misc_feature (310)..(310): n is a, c, g, or t
  misc_feature (375)..(375): n is a, c, g, or t
tccgccatctctgtggcccgnaccctgctggtctttgaagtgaagaagcccttcctcttcgtgctctgggaccagcagcacaagtccctgtcttcatggggcgagtatatgaccccagggcctgagacctgcaggatcaggttaggcgagcgctacctctccagnctcagctctcangtangccctgctgctgcctgcctggacttgcccctgccacctcctgcctcaggtgtccgctatccaccaaaagggctcctgagggtctgggaaggncctgcttctattagcccttcntcatncctccatnttntccaaaccactttttgcagctttctctagttcaagttcaccagactctataaataaaacctgacngacgg

SEQ ID NO: 529085 - DNA, 484 bp, Homo sapiens
tagccggtaccggtcacggcatgactgcactttgagtctgcttcagctgtccatatacaaatgcctaaaggtctagtgtctttggcttccatggaggaagcattctcactgccactgtcccacttaccccctttaaccacctaaggattgccacatgccccggcctgggcccaggccagcaggcattacagctggactgtgggctgtgataggaaggaagggccatggccgtgcatccacagttgaattctcactcctgggaccctgtcactgctgggacaggcccgaggatgccaactgcaggtgcaggaccccatagccatggctgggctcccctctccatgcacagggtggggcctctgccatctggccccagagtgtcagtgtacccagggggcctggacatccgtcagggtgggggcttggtgggcacctgggagctgccaggagacaggggagctctccttgacggtcgggggtccat

SEQ ID NO: 529086 - DNA, 231 bp, Homo sapiens
cctcagcctctggagtagcttggatacaggcgtgcaccaccatacccagctaatttttcatttttagtagtgatggagtttcaccatgtggccaggctggtctcgaattcctgacctcagatgatctgtctgccttggcctgccaaagtgctgggagtacagacgtgaggcactgcacccagccaaaatacatcttttattgaagtataaagcgttgaggggtaccgagct

SEQ ID NO: 529087 - DNA, 405 bp, Homo sapiens
  misc_feature (145)..(146): n is a, c, g, or t
  misc_feature (149)..(149): n is a, c, g, or t
  misc_feature (170)..(171): n is a, c, g, or t
  misc_feature (179)..(179): n is a, c, g, or t
  misc_feature (242)..(242): n is a, c, g, or t
  misc_feature (266)..(266): n is a, c, g, or t
  misc_feature (279)..(279): n is a, c, g, or t
catggcgatgctggtcctagtacccggacgagttatgcggcctctgggtggcaactttggcgcattcttgcctcgcggactcgagttttggggcccagcgaggggactgcgagagtcttgctgaggcagttctgcgcgcggcaannganggcgtgggcagtgcatcgggnncccatggntattgcatgggaaccggcccctcagcactgcgaggccgccacccccgtggtcagcagaagggncccggagactccacgcagccctcngaagcccgggccntgtttcctggaagtctttagcaatcacatttgctattggaaggagctttactggctggaatgaagcacgtcaaagaaagaaaaggcagagaagttagagaaggaacggcagcgacacatcggcaag

SEQ ID NO: 529088 - DNA, 996 bp, Homo sapiens
gcctgacaccaccgttgcttcgcgggctgggagtgcccggggtccccgggcgaacagaggctgcgtggtgggagctttcgctgggcgctgcagagctgtgtgcctgtgtgtggatgtgccggtgatggagcccctgcggatgtggacttgacgcctgcagtggtccgagctagcctggctcctgcgcctctcctgcgtggatccagactgcctcctgtgggctgctggcggcgggtctgaggctgtgcgcgtgccaatggctcacctcctgtgggatttgccaaccagcactctcgaagtggacccttgaggagctcttcaccaagctcgaaccgcattgggcaaggggctcgtattggggacggtcatacagaggggcacatcgataaggcacacaaaggaggctggtgcgccattcaagaatcatcggacctgggacgggaggccgaggcatgacgatcggaggcacatccaggcaggagattcacggtgtaccctacaaggtcagatgacgacaagaccccagtacattcagccctgctaacgtcttgggtccgtacgcgtacgactggagcaacgcaaagcttattgggattcaattcattgggaggttaccgtaggggcatggcagtgctacaacgcacactatggactttgctttacaacgcagagggtccccccttggcagcgaagaaccatacccatttggtccgacctgagtcccttggcgaggaaggatatcttgacatgggccatggcattccacttcttggggacgatcccggagacggccacaaggcactacgcgaccccggaagcgacccacttccgagacaggacttggccacaaccaggtgggctaaccagtccttcgggcaagcaccacgggggattgacggttggaaacgccctggacccggggaccgctgtctggaggggtacagaccagggggcgcacgcatcccagcaggaacagacgccgagcgattacccggg

SEQ ID NO: 529089 - DNA, 185 bp, Homo sapiens
ggtacggacccagtgatgaacggagtgctgcaagatgaatcccgtggccatggggatccggccttcgggaatcttagccgcggccactgctgtttcgattcgatgtggtctgcgggcagctgggcgggcgtggctagggggtgtggtcaaacgctcgcccgggcccagcggctctctcctcctcg

SEQ ID NO: 529090 - DNA, 519 bp, Homo sapiens
  misc_feature (107)..(107): n is a, c, g, or t
agtataataataataaaattaaaaaaaagaaaagaaaaaaaagaaaagattttaaggttggacacagtggctcatgcttgtaatccgaacactttgggaaggcaagntgggaggattacttcaagctcaggagttgcagatcatcctgggcaacatagtgagacatcatctctactaaaaatttcttaaaaattagctgggcgtggtggtgcacatctgtagacccagctacttgggtggggtgagggagtggactgaggtgggaggatctcttgagcctaggaggttgaggctgcagtgagccctgattgtgccactgcactctagcctgggcaacagagtgagacctcgtctcaaaaaaaagatttttaaaaggtgatgtatccatgcaatggaatagtattttgcaataaagaggaatgaagtacagtgtgtgatccctggtacaacatggatgaaacttgaaaatattatactaaagtgaaaggagacagtcacaaaagaccacatattgtgtgc

SEQ ID NO: 529091 - DNA, 458 bp, Homo sapiens
ttttcttatgagcatgccagtgtagggtcgacagagagggttataatgacggggaggttgattgttgtttaatctgctggaagatgttgctccagtgttggacctaacacaacctgaagcggggtgacaggtttggaaaaacctttttcaaacaggggccttttttttttttaacagagttggtaataaacaaaggtgaggagggcttttttttccacgggattgtcccctccagggaaagccgggctagaaaactttcctatttgggcttctggtgtaaaactactaaaaaaggtccttggaccactctttgagcaccgtagggcactgtgttcttcctcacaagctcccacgcgaactggaaaattacccggggattcaaaccaagatgtgtgcatatggaagatgccataagattgtgtcaggacgaccggttataccaggctagttaaggaacg

SEQ ID NO: 529092 - DNA, 230 bp, Homo sapiens
cgcggctgccgccgggaaggcacatactgggacagcgccctggccgggagatattcagaacgccaagtgggcttgctggttgaccacaccaccccgctccaccaaggccttgttagatgcttttgaagtttgcgcgtagagctcttgctagccagggcgtcagaactgcagaggcgtgccatgccgctctcggtatccgcagctgcagtcctctactaccaccaggctgt

SEQ ID NO: 529093 - DNA, 120 bp, Homo sapiens
ggttctcaatcaccatctcctaaggatgagtcagccagagccggcaagaaaatcccgtttctcagatccccacaaagagcgacttttgcaagagagaggaggcaattctcagatctcgga

SEQ ID NO: 529094 - DNA, 202 bp, Homo sapiens
tgatatgtgtctcacagacccacaggatgggggctaagtgtcaggacatcgcagctatcattctgaaacagctatgcagaccaggaacagtctcagcctgtgcttggaagctcattccttggtctagcttttttctttcctatagaacaaaagcagtttctggacaactcatctaggtttttgtttctgagacaggatatca

SEQ ID NO: 529095 - DNA, 585 bp, Homo sapiens
gggctagagtgaatagcatgatctcagctcactagaacctcggcttcccaggctcaagagattctcccacctcagcttccaggtagtgggactacaggcgtaaacaacaaatctggctaatttctggttttttgggtagagatgaggcctcacaaaatagcccaggctggtcttgagctcctgagatcaagcaatccacccgccttgagctcccaaagtgctggaattacaagtgtgagccatcgcacccggcccctttctttctttttcttaacattgcttaagtatcgtcctcctttctttatcttttatgtaataaccataaatattgcttctatatatgttataaactgaaaaatgcggtgttatacaatcttatgtcatttaaagaagatgagataaaagttctatggagtcatttatatctgccctcatatttattatatctggtcttctcacttcctcctgtgaactcaagtgatcatctagtgtcatttcctttcagcctgaagaacttccttcagtttttcttgtaaggcatgcctgatagccatttctctctgtctttgtgcccgtcagaacacc

SEQ ID NO: 529096 - DNA, 247 bp, Homo sapiens
  misc_feature (8)..(8): n is a, c, g, or t
taacgctnttatacttctcaacgctttatacttctcacagctttatacttcctcagggctttatactttctcaacgcttgagacttcctcaacgcttgctacttcctcaacgctgctacttcgtaccgggaaatgaaatgggaacgtactagcgcgttgaggagagtactaagagcgttgaggacagtactccacgcgttgacggggtaccgacgcacgaacttcgtaactcactggtcactacgct

SEQ ID NO: 529097 - DNA, 318 bp, Homo sapiens
ttctcaaactcctggctcgagtagatctagccacctcagcctcccaagagtgctgggataacaggcgtgagccagcgtacccgggccattctgtgtacagctttgccctaagttttactcgctgtctgcagtgcggatggagaggagccacagatgagagctcaggatcctttctcaggtctattctgagaatgtgctctgcactcagcagagatgccccttacacctggctgtgtaagtcccaagctgagcttggtgtagcaaatgagcacagagaaatgcagggtcaactgtggagagtcatgcctggaatcccag

SEQ ID NO: 529098 - DNA, 341 bp, Homo sapiens
tcccaaatccctgcaagaccttatgtcctaacttatactgctaatttatttatttagtttgtaaagagtgccctccaagttgtatcagcttcatgccaacaaaacctgaccctgaccctgtttactgccattttcagtcatcagttatctgctaactgattgtccagtttcagctttacccagggcaactcttgctctcagagtatagttaactattttcctagttgtctcccagttcgttttttgtttttgtttttttagctttgattttagaatcgggataaatgtgcagggtttgttacaaggcggtattgggtggatgctgggggttttgggtacaa

SEQ ID NO: 529099 - DNA, 213 bp, Homo sapiens
  misc_feature (1)..(1): n is a, c, g, or t
  misc_feature (14)..(14): n is a, c, g, or t
  misc_feature (54)..(54): n is a, c, g, or t
  misc_feature (60)..(60): n is a, c, g, or t
  misc_feature (64)..(64): n is a, c, g, or t
  misc_feature (71)..(71): n is a, c, g, or t
  misc_feature (76)..(76): n is a, c, g, or t
  misc_feature (85)..(85): n is a, c, g, or t
  misc_feature (101)..(101): n is a, c, g, or t
  misc_feature (108)..(108): n is a, c, g, or t
  misc_feature (117)..(117): n is a, c, g, or t
  misc_feature (122)..(122): n is a, c, g, or t
  misc_feature (149)..(149): n is a, c, g, or t
  misc_feature (157)..(157): n is a, c, g, or t
  misc_feature (196)..(196): n is a, c, g, or t
  misc_feature (199)..(199): n is a, c, g, or t
ncagtttttcaaantttttattagttacattggcaatttcaggttttaacattngttggnaaanttccaantggangaagcaaantcaggggttaagagangaaagancattttttngcctntgcctttattcccacaatttcgcaaangggcattnttattctcacgttccacgatgatgcactcgaaataattnggntatttatccccccc

SEQ ID NO: 529100 - DNA, 275 bp, Homo sapiens
tttgagccttaccctagtgacatgtaagcctcatgtcaagggagctcatgcagatagtagtgaaatcaggtctggaaatttaaaaataaaaggcatgagactaaggctatcttgcttccctttatgcccttgactggccgagggtgagggagtgagaggcaaggccgcacatgagggcatccgcagcataggacgttgggattgtgctgcagttgaggagaaatcccggtgaactgtatctgacacagaagattcttatttgcacttgtattgta

SEQ ID NO: 529101 - DNA, 333 bp, Homo sapiens
ccagttcctgcttcttgaaaagcccgatgagatccaagagagcccttctgagctaccacgcatcgaagatccatcgtcagagtcctaatatgaagaacccactgaacaacttgagaatcatgttgaagcttaacccatatgcaaagaccatgcgccggaacaccattcttcgccaggtcagtattcacaagctccgggtggactaggcagctgctgcatcatcggcactacaagccacttcagattagaaggcggcggttgcaggcgagaagcctgtggtaggttagaaaggatgtaacgctgctgttggtttcaagcaagcaggaactggcc

SEQ ID NO: 529102 - DNA, 463 bp, Homo sapiens
aggatgggaaaaaaaaaagtgcccacatggcgacaggcagggccccagtacatctctaccacccttaccctggacagtcctacattcccagaatcaccacacgccaccagacagctataagtactggcgtgggatctatacatcagcatcctccccctagtaacctctaccctccacagatccaccctgtgctcctctcctcacctctccccctccactacacattcttactcaagtctccaagaccttaaggctggatggtgccacaagagaggagggtcagtttccctcagggaaccaaaaaactggcttgcttggcacccaggaccagaagctgtttggctctccacccaataacaaaaaacaaatccctgccctttcccccaccccactagctaagcaagagcagagctgtgatgccgagccagtgccgggtggctggtgcccagggctgtacaccgtg

SEQ ID NO: 529103 - DNA, 313 bp, Homo sapiens
gctcccagaagaaatacatctaaaaagaaccatcctcagaagacatgccccacaagaactccacccacggactcatacagagaataaatgcatccgagaagcatcccagaaagttgccacggaagatggtggcattagactgtgagcatggtgggcacaggaccaaaggggcatgttagcttcccttggctcgaatgtagcatatgacaacatacaacggggaggaacggtctctctacttttaaccagtgaaattgacctgcccgtgaaaaggcgggcatgacagagcaagaagagaagaacctatggagct

SEQ ID NO: 529104 - DNA, 107 bp, Homo sapiens
gcggccgcctactactactactgctcgaattcaagcttctaacgatgtacggggacatgccactgcattccagtctgggcaacagagcaagacttggtctctaaaaa

SEQ ID NO: 529105 - DNA, 827 bp, Homo sapiens
acgttgctcaggctcatgtctgcgagccacggataccctgatccagagagaatgtcccctgatggcatggagcccgagggcgtgatcgaggagtagcgtggcatgagcatttgttgacacgcttggatggacatgaacctcttcggagtaccttctccgtggcgattctagcagcttatgattgggatgaatccctctgccgttccagcaacgacggcattctacctttgtctcaggggtgatgatgtgattgctcaagcccaatctgagactgggaaaacggccacatttgccatatcaattctgcagcagaattgaattagatctaaaagccacccaggctttgtgtcctagcaacccactcgagaattgggctcagcagataccagaaggtggtcatggcacttaggagactacatgggcgcctcttgtacgcctgtatcgggggcaccaaacgtgcatttgctggagggtgcggaaactgaagatggaaggctccccaaaatcatcgtgggtacccttgcccgtgtgtagatatgcttacctgaagatacttgtccgccaaaatacattcaagatgtttggtacccgacatgaagctgacgaaatgttaagcccgggatttccaggacagatctatgacatattcagaggtcacagaaacagcagggagtttggcggtcggccacatgctctgagtgtggaggtgacaaaagtcagaagacccaatcgttcttgcaggacgaaggtgcctgggggtacgcaatcacatcaggacacacactgactgacacttgttgtgtgacgcacacaggctttaaacgggg

SEQ ID NO: 529106 - DNA, 206 bp, Homo sapiens
gtgacccacgttcgacacatggcctgcggaggacctctgcggggcatctacgcttacggttttgaaaaccatcagcaatccagcaacgagcaatcaaggcaggatcatcaaaggggagagatgtcatcgcacagtctcagtcccggcacaggaaaaacagccaccttcagtatctcagtccccccagtttttgggatattcagggt

SEQ ID NO: 529107 - DNA, 620 bp, Homo sapiens
gcacgaggtggtgagcaggatggctttctacacccacctagcatgaaaagacatggaaggcaggaataataaattcaaagagagctccagagcagggccaaattcttcctcagctaagtccgtgctccattcccatctatcctactgagtgctttgttatttttctgcagcccagagcagaattcagtccttcactgttcagaattcacgaaacagaaaggttattgtatccaaattgtcaacagacagagctaatttcaacctcgccagcaactgggaaaacaaattatgacagagaaaagaaatggatatttgcagtttgcttttctaggctgttcctaatgtgggtctgatctgccatgagactgtcacacagctttccttgtggcacagaactgatcctatggatgaatgaagacatggctcagataacatttcatgggtctctaggcaatcccgttgcctacttgtcaccatgactagaaatatactggctgctagggtatgcctaacacctgaatgctccaggaacaaatgtccctctgatttggggctgacacttcattcattcaccactcatttattaggtgtctattaagtgtactgggtgctggggacac

SEQ ID NO: 529108 - DNA, 843 bp, Homo sapiens
attggttataggtttgtaacagacggtaagttacaatgaagtcattagggtgacccagtgtgactggtatccttatgaaatctagaaaaattcgcgacgatcgacatatacacaggggaagatgaatgtatgacgatatcacagtggagattgctcagtgctgaccctggaagacagaaagacttgaagctagtgagagtctgtaaggccaaggagactgcccaaagagtggatagttcccaccagaagaagctaggcagagtagccaaggtaagtgattgtactcagaatctcagaggttgcggtggccctactgagtaccttgtattttgggacgtgtagcctccaagaagcttagagacgaactagtgtctcttgtgtagggtaagccaccgagttgagtggtactttgtgatggcggatctgcctgagtagaaatgtatgaggaacatgattgcacgtggttctttaggactacttgatcacagaagttgtttaccgggaacaacatgagatatctcttagcatgggagtataggctcctcagcctattgtttcctgactgattattcctatatagcttctagcgaaaacaattctaaaggtccaacgattgaagtatcccccacataaatgcatgttctcaatctttgttttgatgatattgccttgccacatgacttttaggcagctttaaaacttttatggaggcgcaaggaaaggctcttattggaaagggcaataatctcactgggattaacggttaaagggccttgggttgacttagaatcgtccctgtggaacctttgtggcaaagatggagaaaaaggttctgcaaataat

SEQ ID NO: 529109 - DNA, 672 bp, Homo sapiens
ggctccttccgtataattagttttacatatacaaagttcacaacagttttcatccctctaccacgtttacctttacttactgtggctgtcttcagcctttcctctagggcagcggtgtcacgcggtagtgtgcgctgcaatcaccttgctaaacacagatgctgctggggcccacccaccagggcgcctgagccagcaggcctgggtgcagcctagacacctgcatttccgacaagctcccaggtggaggctggggccgctggtccaggagccacacttggagaacgatggatttctgtcaatagcaatttcagccctgctatgtcgttggttgctgtttgaaatgaattggtttggttctgacactgtttcggttctgtttgcttcctgaggtctgacatcttattttcatttcttagtcttatacgttgttgacatttattttattgaattcatgttcttatcaaactgttctcttaggcaaagcacaggaatattttctttttctgtccacgagctgtgcgtcctctgccttccgcatgtttatcttgcgcatgctggggtcccttctccagcactgagtcacgggtatctctgtgggacgtttgcttgtacttggcctccccttcctgctttccttctcttcagccgagggtctaatggtcccttttt

SEQ ID NO: 529110 - DNA, 807 bp, Homo sapiens
tgggctttgacccaggattaaaaactggaacggtgaaggtgacagcgtcggttggagcgacttcccccaaatttcacaatggtggccgaggacttggatggcacattggtggttttttttaatagtcattcccaaatatgagatgcgttgtacaggaagctcccttgccatcctaaaagccaccccatttctctctaaggagaagggcccagtcctctcccaagtccacacgggggaggtgatagcatggcttcgtgtaaattatgtattgcaaaattttttaatctcgcctataatacttttaatgggtctaatttggaatgatgagccttggggccccctttccccctttttggtcccccaatttgagatgtatgaagggctttgggtctcccgttgggagtgggtggaggcagccagggttaacctgtacactgacttgagacctgttgattaaagtgcccccctcaaaaaaaaaaaaaacaacaaaaaaaaaattttgttggggcgcccgccccaaaaaagttttaaaaccatctcgcgggcgcccggagccaagtagtgtaggacactgcgccgaagttgcgccagaggacccgggtcacgaactggccttgttcccccaaaaaacccagggacccggctgttggaccaccagggcttcgggtcacggtcacaccggccccgtcctatcccgcccggcgctggggaacaaccatgcaacaatacacacaagccgcaccagaccaccagcgacaaggcaccagacgagtagatccacggaccgagaggagcactccaggcgcg

SEQ ID NO: 529111 - DNA, 264 bp, Homo sapiens
  misc_feature (146)..(146): n is a, c, g, or t
  misc_feature (155)..(155): n is a, c, g, or t
  misc_feature (220)..(220): n is a, c, g, or t
aaaattgcaatgtctgagctgaaaaatatcactggatgagattaatggcagcatagaaattgcagaagaaaagactagtgagcttgaagacacagcagtggctcatgcctataatcccagcactttgggaggccaaagtgggaggntcacttgancccaggagttcaaaatcggcctgggcagcgtagtgagaccccgtctctacaggtaattttttaanttggccaggtgtgttggcgtgcacctgtggttcccagctaatct

SEQ ID NO: 529112 - DNA, 159 bp, Homo sapiens
  misc_feature (72)..(72): n is a, c, g, or t
  misc_feature (94)..(94): n is a, c, g, or t
  misc_feature (121)..(121): n is a, c, g, or t
cggcacgagagagagcgccggaagcggtccgagaatgaagaccttcaggagcacagcgggccgaggccttcntgagggccttcctgaagcgcanacgccccgcatgagcccgcagcccgcnaggaccagctgcagcgcaaggcggtggtcctggagtac

SEQ ID NO: 529113 - DNA, 379 bp, Homo sapiens
ggagctggtttactcagttggtgttttgagtgcagaggaagcagtgaaagatgagaggaagaatgtcagggatgtgaggggagtagagcgagagagagaagacacttggcaggaagaagtagttgaagtacccggggatgtttagcttgaagaatagagaatttggagtgaggcagacgaaaaggcaggaaactttaaaagcaggacgagaaagacctccaggttcccaaagggagcatggcaccttctcaagggggtgaggttgacagcattaaggagagagagggagagaaagggagagagagagagagaaagagagagagcgagagagttgtcaaggaagggaaggacccatggaggggagaaacacaggctccag

SEQ ID NO: 529114 - DNA, 292 bp, Homo sapiens
tggcgactctgaggatcccaccaagtgcaactggccatctgaggagatgacctacatcactcacgaatctgggagatgaccccgctagagcacgctgtgtaattccatagtttagtctcatctcctgtcagtttccacatcatgattgtcttatctcgagaggcggagaggatcatgtccgggatctgaggggtcctagcgatctgggttaccctgccgttgtggcccttgagggtgccacgaagggtcatctgctcagtcatcctcgtcgcgactgggacccaccctgggc

SEQ ID NO: 529115 - DNA, 1357 bp, Homo sapiens
ggtccagagcagagtcaagtgagcatgagctgaccgccagaagtccccttctcgctcctgctggggccccagctgtgaccccttccgcgagctggtagccgaatagcctgcctcttcggaccaggccgttcgaggtatgcctctggcgtctgtctcgtgatggagtggtcgcggatggattaggcggcctgtgcgtggactctggctactgtgcgggtcccctcgtgtcgcccgcgcccgtgcgactcggagaggcgccctgggagtgtgacgatgcccgctcttacgagtgctgcgcgctcaggtcgcgccaactcaggacaggacgtggggatcgtacgtgtagaatacgcaggcaagcaacgtagcgcgtaccctgccttgcgtcctctttgatcaaccattggaacttgttccactcactaacttcgactcgcccggtgtaacgtatgtcattgatcagagtacaaggacccaagggaattggccgcttggctggggagaattcacccgtgcaagggcacggaaggaagacgggccgagtgaactgagacagtggggctacagttctccccgggtggcttcacggcgcgcaatatacatcgtcctggtccccccccgtggtggttggatccccgccaggcgcaaagtttttcactacccttcccttgttcccccccttgagtgggcacaacctgcaacgcgtggaagcgtcccctcatgcccaaaagggttaagaccaacggcaagtccaaaccgaagatacaaccaatcccccaggtcaacactctcgaaggtcggcgggcccccaagctttggtggggcccagtaaaagcttgcaaaaaatcccgaattgagaactttgccggccaaggtaaaagacccttttaggcccggggaatgcccaacccccctggttgccggcccaccttggcttggtgcccttccccccgcgcacaacccttgttggtggtttcctttgtggattaacccattattattctctcttggtttttttccttccaaaatttaaacgggtgtccaaaaggcacagcccaaacccctttggttaagcaaatgacacgccatacaagaaagaagagcctctcggagcgaccactcaatatgttccgggggtgccggggacgaacaaagcagggcttcgtgcgagaaacggtgcggccacgtgtggctcacacataaggccggtgtttccctgtagaaccccgaggtttttcttttgtgtcccacacagggctgtgggtaaacaactgtggacgcgggatctcccccaataatggaggaagcgcacgtaataaaattttccagaataaagcgcagggtaaaactcgcatga

SEQ ID NO: 529116 - DNA, 319 bp, Homo sapiens
ctgagtagttagtcctacatgtcaggagcacatgtactatcagcgcaactgcaatcactagatatcacaacattctttgagtacacccttcatctgctgatgtaagagctgctactgggactagactagctgcggtctcagaaaacatggactgagtttcaatatcaaataagcaattttccttatatatatattaatggtcacttactccagcattgctgtcttttactctccagcctttggcccttcttatcaggatgaaaacgcttctgtttggtgtctgggccctgctggccttgatccttatgcccaggtgagg

SEQ ID NO: 529117 - DNA, 122 bp, Homo sapiens
ctctatatggaatgtataggaggagaagctatagctcattccatttatagatgtgaaatcactacctatcgacaggaccaattacgagttcatgtataagtgtgatggtgctttgtaaatga

SEQ ID NO: 529118 - DNA, 220 bp, Homo sapiens
accagatgaggttcaccgcgcctggctaagtctttgtgtttttgttggagatggggtttcgccatgttgagcaatcctccccacttagcctccccaagtgttgggattgcaggcatgagccactgtgccccgcctctaattctacttatttgaaatgccctagtggataaatctacagaatgccatgaaagtatgattcacggggttgcctagggtttgg

SEQ ID NO: 529119 - DNA, 306 bp, Homo sapiens
tgacatctccgcttaccattcagttgctacattcttttaaggcacctattctgtctccaattaagatagtacttaattagtaaggggattttaaattcagaagataaccggaaccattttttttaagggtaaatgctttagcacgggccataatagcaggcaatctagcacattgcctacattaaaggagccttgcccaaaggtgacacagtctctcccgagatccatttttcggggagccaggaggatcacacagctttaggaagtcagaggggaatcacacaaggcagagaagctaaggttgca

SEQ ID NO: 529120 - DNA, 81 bp, Homo sapiens
  misc_feature (42)..(42): n is a, c, g, or t
ggctctccgaggttaagggccacggcaagaaggtggccgacncgctgaccaacgccgtggcacgtggacgacatgcccaac

SEQ ID NO: 529121 - DNA, 180 bp, Homo sapiens
gcagtaccgtgatgctgatcaggataatactggaatccctgggagacggaggtgcagtgagccaagatcacaccaccccaccatactccagtcctaggcgacagagctagtactccatctcaacaaaaataaatacaaataaagataaaaaaccaaaaaaattccaacctcctggttggg

SEQ ID NO: 529122 - DNA, 197 bp, Homo sapiens
  misc_feature (84)..(84): n is a, c, g, or t
  misc_feature (88)..(88): n is a, c, g, or t
  misc_feature (99)..(99): n is a, c, g, or t
  misc_feature (102)..(102): n is a, c, g, or t
agatgtcgaagggaacgttcagctggaaactggagataaaataaactttgtaattgataaccattaaccatactggtgctgtangtgntcgcaacattntgntgttgaaaaggaaacaagccccttgtcaggggagtagttttgtgccatgaaggaggcatttggctttattgaaagaggtgatgttgtaaaagaga

SEQ ID NO: 529123 - DNA, 473 bp, Homo sapiens
  misc_feature (38)..(38): n is a, c, g, or t
  misc_feature (466)..(466): n is a, c, g, or t
tccaggactcacaattgctgctgtgcccccttacgggntgctgaaaaaagttaagtaagatcaaatgagtttgtatctggaaaacatcatgatgggaggttgaacttggtggtataagggtagaaaattgtgatatctttccttcccatagaaggcggacagctaacactcttaaagcacaagacaggttaacaaaagaaaagcataacaaatctatttaatcaaagttgtgtgtgacacaagagccttcagaagtgaaggtctaaagatccaggggaaactgtttttatgtttaggttggataaagaacggatagccatgtagaactgtgattggacaggttatgatctaatggtaatagactgaaggggaaaccccgcaagacctgtctgttcaggttcttcttggtctctctgcatagcattcctttcctgtccagtagaggttaggacacctgttacatatnacggtgc

SEQ ID NO: 529124 - DNA, 450 bp, Homo sapiens
ctcgtgcatgtcacatggaagcctttctccacttgctgaccttcttcgttctcgttggcctattcgctactatcaccatcgatctgcttctgcgggatgatccgccgcggtgccgccgttcggccgagtctgaggagatcgctcgtaaactcagagctgccagcatgcgaaggcttggcactgtgcgatcgatttgtcaagatagcacccatggtggtagtggacattgtgggctacgtggaaacccctcgaaggctccggaccatcaagactgtcttttgctgaacacatcagtgatgaatgcaagaggcgtttctatcagacttggcatacatctaagaagaaggcctttaccaagtactgcaagaaatggcaggatgaggatggcaagaagcagctggagaaggacttcagcagcatgaagaagtactgccaagtcatccgtgtcat

SEQ ID NO: 529125 - DNA, 387 bp, Homo sapiens
  misc_feature (317)..(317): n is a, c, g, or t
taaatctcgatagttgtgcattagagcatctctatttactaccatcagcacatttggtacttgtcacctttagtactaggcaaaagtcctaaaaatctatatatcatttcttctagggaaagtaaattgaaatgcacctggtttataagagactcattcttctaaggctcaggaaacaacactgcttcccatttattgcttcacacttcttttatatatagtgtcagaattattcccagtcctaaatcaaggaatattggaacattgttagtttctccaatgaatagtaagtaagcacactgattaagatgcatctnactctagtgaaaaatgtcctcaattgatgtctcttcttattgctattttttatttggcatttctgcctac

SEQ ID NO: 529126 - DNA, 428 bp, Homo sapiens
aagtgccaaggctatgcagatcatccttctctttgtggagcacatagtggggaaaacaattgaaagatatttgcacctatcaatcaataacactcattacaggggaagaatgtggtagtatagaaaatacctagcctaatttgagaaaggttgctttggagtcaggcatataaaccctccctgacgaagtatctattacactgagacagaacagacagattttagccagatattacaggcaaaaaaatgttgcaggttgaagaacaaacatcttgtatgatggcctagtgggaagtttggaaagtgaaagtccataggctaaatgtgaccttatgatgtttcatgtggcccatacactgtttcaaaaaataaaatcacttgaagaaaatcaagaaaattaacatcaatcagattcatggcttgtcttt

SEQ ID NO: 529127 - DNA, 466 bp, Homo sapiens
actggttgggtgagtgagataaccaccgcactccagcctggggtgacagagtgagattcatctcaaaaaaataaaaaataaaaaagtttagagcaggaatgaaaggaagcaaagtacactgggaagagggtcaagtgggcaacataagagatccaagtgccctgttcagccttgggctgggggttaaatacatgggcatggttccggggttggtgtttttcttcccttaattttccccttggggcaggctgtctgcatgcacagtgacctgccagcactggggaggggccgcatgtgcagtgcgtaaactgaagttgtgtgtatgctcgtcggaggcatttttctcttaccagtcaagcatccccagaggaaggtcatataccagttaaattcccatttggcctctcagcgcacatgtcggaaccgcctcgcctagctcctgagatctgatcaggaagctgctgat

SEQ ID NO: 529128 - DNA, 1324 bp, Homo sapiens
aacaatatgacctacatatgctagcgtatgggcgtcaaaaacacaccttgaagcaatcggaaagggcgagctggactcgatgtacgagccctctggattctagcttccagccttgatgcagccgagactcgtctctcgaggaggagcttgtcaaacccgacatgaatcatccagtagtatgttccgaaacgacctagttgcgatggagaattcgctcttgaggcataagatacttctgcgtcgtaggaggacatctggcccagattatctggccttcaagcacgtaggaaacctccgccgctttgggatgctgtgattagaatgccagtagacacactctttacgacgagcttcggaggccattgaggtatggtccacattggatgcacgttagactcccttagagggatcgaactcctagggctaaatactccgcccatttgagccctctggttttgtggcgcaaaatactgattgcataacttgggggtggtactttgtctgcgtaacgttgagggatgggactagccttttctggttatcccagtgttgccttgccttggttaacgcattggctattttctcaaggaaagccctttttcaattccacttctacatttgcgaccacggcgggcttggcggccctaatagttcgccctaccggacacagtcgctcggccagtggggagataggccaggaaatttttatcccatgaaattcccgacgggataacgtcgcccccgtttatgtaagttcaaggttaagttacccacagatgcccccttgtggcggaattggacactggcccttatgggaacacttggggggttgggggcacgtgacaccacggacacacgggccaaggagaagagacattttcacggcgttcgtgtctgcgggattagagacggccaggcataacggaaacagcagtagtcttgcttacaagataaattttgggccgccttacgtcggcgctatacaaaggaaaacttttggaacccctagggctgggaccatcagtctgcccacagaggctattaccaaggcggttcctagataccggagcccacgttcctcatggcaattcagcaacacttcctcagggggagtttattccgccaggagcaacagcgcaaatttgggtgcgacgcgactatgtaacacaacgcgagagagttgcttttgataccttaaaagcgaaccgttggtgcagcccccaggacgctcgagagtagacatttttgcggacatggatttggtgtagaatcatgcccccatgaccgtggggccctatataagcgacggtgtgatagcccccaa

SEQ ID NO: 529129 - DNA, 703 bp, Homo sapiens
  misc_feature (233)..(233): n is a, c, g, or t
ggccggtcttctgggctccatggacgggcgcctgctgtccctgcacagccctgccgcagaggtaatggctggcctctctgcagtcagagtgtctgagctctgccatgggtgataggtgtgtgtctttattacttgcagttttctctaacacctgtgtgggctacctggagtgtggtgcctgaatgcatgtgctgctgcatgcctgctgtgaatgtatccccatgtgaacatcncccaatgatggagctggaagaaatgcctcatccccagtctctgcatgtctccagtgatgtgacagcaacctggatgcttgggaactgttctgttttggcatgtgtggtgcgcccccttgtggccattggggtcctttgtgcccaatggcccctggactcgctttccttgtgtggcctctctccatgtgatgttcacgcccatggacccttgtggtgacatgtgatgtaccctggctggggcttgatgtgcaacgaatgggcactgtcatgtgggccgcagtcctggtgcccaatgccccagtgcagggcccatctgctgtgcccactgtcgaaggcacttcccttggctgggtggctctgtggcttcacacccgccggtgccatggcccggctgcccttgccctgccctgatgtgtggcgtcgctttcgccatgcccccttcttagcactgcacctgcaggtccatgctg

SEQ ID NO: 529130 - DNA, 524 bp, Homo sapiens
gagagagagagagagagagagagagagagagagagagagtgagagagagcgcggtgataaagaggctgctttgcagacccatgggtgggattgtcaacagcaagcttgctattcttctacttgcataagaccaggctaatgctcatagccatcactctttatttgatcttatgacctgcgttgggaggagaattgctaaacgtactctcacagatctagagaaagtttccttgtgtgaacaccgtgctgacgtctttttcgatcttaaggttaccgaaagcatagacgtcgggcacagttcccgattcagtttttatctggttggctggcacactcaatctacatgggggtcgtttgtagctattgtacttctagatgcgtaccaaatctaaactggtcgcctttttccccgttcggaatggggagtaattggataactccccggtactggactgttgccaattcatgcttctgcagattggttattgtggatgtggggaccgtccttatctatcttcccgcgg

SEQ ID NO: 529131 - DNA, 219 bp, Homo sapiens
acgagaacgaacattgctggatgggggcatggagatctgtgtgtgctgatgtgggccagactgtcgactgaccctacgccacttttgtcaagatgctgccagataaggactgcctgctatgccctctatgatgcaatctatgagaccaagttccccccaggcagcccagttgtgggggagcctgtattttttttaacaacatccccattcctcaccgtg

SEQ ID NO: 529132 - DNA, 375 bp, Homo sapiens
aaccctcggggattttcaacaggtaaaagctgtattgagctatgatcgtgaacactgtctccatcctgtcgcaacagagcaagaccctatctcttgggagaaaactagccgcactgctattcctcaagataagcggatagtcagtctttataaagactcaattagttattggatatctgaggaagcatgcatatcaggctcccaaaagatcattggttgaggcacacatgttaatagcttggaaatccagaatactcttctggtgaccagctcagacatagtcctgataatataggacctcatctaacatgactccctattttccagataagcatggattcctggttcattcttgttccgctcggcagtggtctg

SEQ ID NO: 529133 - DNA, 344 bp, Homo sapiens
tagagatcctcttattactggtgggaatgtgaaatggcatggacgtgggaaaatagtttggcagttcctcaaaaatatacagttaccatatgacccagtaattctactcctaggtatataatgagagaattgaaaacatatgttcacacaaaaacttgtacgcaactgttcatagcaccattgttcataatagccaaaaaccagagataatccaaatgcccaaatgatgtgtgaataaacaaaatggggtctatccatacagtggaatattattcagccagaaaaaggaacgcagtactgttatatgctgcaacatgaatgaaccctgaaaacccgctaagtga

SEQ ID NO: 529134 - DNA, 592 bp, Homo sapiens
  misc_feature (154)..(154): n is a, c, g, or t
  misc_feature (171)..(171): n is a, c, g, or t
  misc_feature (185)..(185): n is a, c, g, or t
  misc_feature (189)..(189): n is a, c, g, or t
  misc_feature (213)..(213): n is a, c, g, or t
  misc_feature (223)..(223): n is a, c, g, or t
  misc_feature (225)..(225): n is a, c, g, or t
  misc_feature (239)..(239): n is a, c, g, or t
  misc_feature (241)..(241): n is a, c, g, or t
  misc_feature (243)..(243): n is a, c, g, or t
  misc_feature (272)..(272): n is a, c, g, or t
  misc_feature (287)..(287): n is a, c, g, or t
  misc_feature (291)..(291): n is a, c, g, or t
  misc_feature (293)..(293): n is a, c, g, or t
  misc_feature (319)..(319): n is a, c, g, or t
  misc_feature (323)..(323): n is a, c, g, or t
  misc_feature (335)..(335): n is a, c, g, or t
  misc_feature (346)..(346): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (371)..(371): n is a, c, g, or t
  misc_feature (375)..(375): n is a, c, g, or t
  misc_feature (381)..(381): n is a, c, g, or t
  misc_feature (406)..(406): n is a, c, g, or t
  misc_feature (423)..(423): n is a, c, g, or t
  misc_feature (429)..(429): n is a, c, g, or t
  misc_feature (439)..(439): n is a, c, g, or t
  misc_feature (451)..(451): n is a, c, g, or t
  misc_feature (480)..(480): n is a, c, g, or t
  misc_feature (485)..(485): n is a, c, g, or t
  misc_feature (490)..(490): n is a, c, g, or t
  misc_feature (507)..(507): n is a, c, g, or t
  misc_feature (510)..(510): n is a, c, g, or t
  misc_feature (513)..(513): n is a, c, g, or t
  misc_feature (519)..(519): n is a, c, g, or t
  misc_feature (571)..(571): n is a, c, g, or t
ggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttnctgttcccacccatgtnaaaaccgaggtgtntgtntgagtgtgggatttgaccagtatnagtgcgattntncccggacaggattntntngagaaaactgctcaacaccggaatttttnacaagaataaaattntttntnaaacccactccaaacacagtgcactncatnctttcccacttnaagggattttngaacgttntgaatnacattnccttncttngaaatncaattatgagttatgtgttgacatncagattacatttgattnacagtncaccaacttncaatgctgactntggcttcaaaagctgggaagccttctctnacctntcctntttttcttgagcccttnctnctntgcctnatgattgcccgactcccttgggtgtcaaaggtaaaaagcagcttcctgattnaaatgagattgtggaaaaatt

SEQ ID NO: 529135 - DNA, 110 bp, Homo sapiens
aagcttgattgcccaaagtaatataatagtgttaagatgtgatatatactggggaaaaaaaaagtgtatatgacattcggaataaaccactttattccaaaaaaaaaaaa

SEQ ID NO: 529136 - DNA, 494 bp, Homo sapiens
ctgcacgaatggctccggctagccatgtgatctcctccactccataacgctcctcataccaggcctactaaccaagcacactaaccatataccaatgatggctgcgatgtcacacgagacaagcacataccaagggcaccacatcaccacctgtccaaaaatgccttcgatacgggataatcctatttattatctccagaagtttgcttcttcgcaggatttgttcttgagccttttaccactcctagcctaagccccttagcccgccgaattcatcgaggagctctggcccccaacatggcatcatcccgctagatcccctagaagtcccactcctaaacgcatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtct

SEQ ID NO: 529137 - DNA, 392 bp, Homo sapiens
agcatcttactctctctaaggcagatatgtaccctataatagatactgtatggctatcaaaatgatgcaggagggagggaaagagaaaggacgaaggataagattgattagaggtggactatctctatcagattgcttcttagttactctgttggactacctacgaccctttggaagacagcacgacgttccgcgacgctggtgaccttgagtacgactactgcagtatactttctacaaaatatgcacgattctttactgtttaccttatcaacttcgcaatcagtaagtagctctcagaagtaaacagtagctagtgtctgaatcctgtggggcaatgcaaacatgcctagtggtgcaaggacttaaatgtagtatgtgaacaaaggagt

SEQ ID NO: 529138 - DNA, 148 bp, Homo sapiens
attcgcggccgcgtcgactgtctctgaagacttctcgctcagtttcagtgaggacacacacaaagacgtgggtgaccatgttgtttgtggggtgcagagatgggaggggtgggtttcaccctgtaagaagtgactgtgtcacaacgag

SEQ ID NO: 529139 - DNA, 964 bp, Homo sapiens
cgggcgctggtgtgtgtacctcgcgttgcgtagttcgcgtgcgctgctgggcgccttgttactctgcgtctgtgggtcgcagtcctttgcctctgccggtccgcgttacccggtgctaacggcctagcagaccgggtgactttgttcccgcgccggtgacgcctcttcggcgccccgcggaggttgtttgtctacggtttaagcggccccgggtcccaagtcggcttagggtttccttgttgttgcacacgggggctaatgcgcccacgattatgggacccccccgctgtttgtccaaggtgcgggttcccggcggcactacagggggctcgtcaaggtcggtcccctgtattacacggagggtgtctcgcgggggccgccgtcgtccccctgcggggcaatggtggttccccccggcgggtgccgccgcaagggtgtggggttcgcaccgggagagtgttcctgctcggggggcgtgcgtcctcagaatggttccctgttgtcttgggcccccccatatctggggtacccccggcggggttcgctggacacacttatctttgtggcgcccacgtgtgcgcttgttcactcatatactgcctgggcccgttgttttatggggggggcccccctccctggcgctcgccagctgtgtttgcccggggcgcggaagtcttttttctcaccagctccacgcgtgtgagtatacccgatgtgttgttgcagaaccctggtgagtcaaagttttggtggtccgccctggtttccttccccttgggaagcccgggtttgtccttcccaacatccgctcttctcaggcgttggtgcccagactccgtcggtctaccgtcatctcctctttgggaccccccactgccataatatctttttttgtatagtgcgtttgtctggtagctaaaaaaaatattgccggtattgctttatccctggcccccccataaca

SEQ ID NO: 529140 - DNA, 223 bp, Homo sapiens
cgcgtgatagaggatccccggtaagcgcggtcgttcccactgtttcttgtatgtttatgtcatttttctaggcggaggatcaaacaggatgttgctgtgatttatgtcaaagagcattctgcctatgttttcctctaggagttttatagtgtctaaccttatatttaggtctttaatccattttatggtgttagatagtgttctgccttcattcttttacatg

SEQ ID NO: 529141 - DNA, 789 bp, Homo sapiens
gcagtggccatgggagcccatttgtccatatatgcgaccatatttgggttctctggcccctctttcccacgggtttggcacccgctttttattggacctggggcaccaatgacaggtcaagaatcttgccgcggggcaccgcgtgcaccacgattgggcgcggccccagaaaccaatgcttggcaaccctttccctgggctttgtgggcccaggctaccccccgagtaccaccccgcgcccatcagcgatgggcacaccgccacgtggcccaccggttcgttctatgaatcgactttgagcctgggaagcagccggttctcctggtctaaatgtgccgcatggagtgacactagaagccttcatcgggccccaatgcacctcccccgctttgctggggttatatttagagaaattggggttgggaagccagaacccgctgtttagcgcgggactactgttccccaaaggattcccaccggcccgcttgtttgtgaaacccaaaaagaggttcccctttcagatgtgagagacccaaattgggttttaaaaataaagtatacacttttgcacttgccctcgggttgtatttagtgtcttgaatgtaagacactgagcctccccctgtagtgtctgtaataccctagttttttccaccccgaagcttgtgaatttttggaccataacgtgaaaagaatgccagcaaccccgaaattttctgtttgaaatgcgggaccccaaatggttatttttcccctttgttaataaaaaaattttcccccaaaaccccc

SEQ ID NO: 529142 - DNA, 723 bp, Homo sapiens
ctctctccgaagtgttaatgctacttttgctttctttccgcaggtagtccccctctggctacatattagtcggccctcccccagagggcaatcggtcttctgtagctcttgccgctgcaactaagcaccttcttccctagtgtctcccccggcagaggtcgtagttgcgtcctccctcctcggtagcccccccccttttgttctcccccagcagtggtggcgacaaaacattttgggcagcaattgggggccccctattggcccgatcgacgcgagcagactactccatgtcctcctctctgcccgagagaagccctcttttgcagtgatagtggggtcttgtgggtatacccacgtggcggcttcaggacagaccacgggcaatatcagttcactctctttactaggtctcctttcggggtataattgggcatcccatatgtcgcgcgtccctggccacatttgggggggaccaccccgggtccacgaggctttaaggtgacaccctctgttgtcgccccctgtgttccctgctcccgaacgcattgggaataacaaacttgggaggcaccccaaaaaaaaagggcggccccccctttttttttttttttgcgcggtggcagtttttaagttattagtcttttaaatcagtactttttaatggaaaccacttgacccaaaatttgtcaccgaattttgagacccctttaaaaagttaaatga

SEQ ID NO: 529143 - DNA, 127 bp, Homo sapiens
aatcagtacatgcctggactggcagtacacagcatcatcccttggtcagaatctactaccttccacagcgggccagctccactgaaacaacactttacctgacaacaccacagccattgcactccgg

SEQ ID NO: 529144 - DNA, 199 bp, Homo sapiens
tctctgctcccagattcctgccagcttgaaaggggaggtcctgtagatattagcggaaattgatgagaagcccagttctgacctgaacaagacacgcctgcgttagtggttagttgccctcctgcagctcccagtctagtactgaggacccgaaggatgagcctgcgtgtagctaaaaccagattctgaggacttatcc

SEQ ID NO: 529145 - DNA, 198 bp, Homo sapiens
ttataactaggtatttacgaataggctaattcactagctctagttctatatcataaggttgtcgccccattcggtaaagcttagatgttgcaaaataataagctttgtccacaatgaacagcaggcacttgactaaaaacgctcttgtaaacctgtggttatcatctaagaaccatcgtctagggacacgaatgttca

SEQ ID NO: 529146 - DNA, 114 bp, Homo sapiens
gcagaacaagcagatgcgaagtatcagagaagtacaggcaggtcacctgtctcttcctcctgctggggggactctccccttcgctctcactacagctcctgctccttggccttg

SEQ ID NO: 529147 - DNA, 140 bp, Homo sapiens
ggctgactccagagtattccgatcggcattgcagcatgggaaactggcttgtgatgagctgaaagagatgcggaaaaacttgaccaacagaagccatcagtagagcatcagatggccaagactggtgggacccagactga

SEQ ID NO: 529148 - DNA, 723 bp, Homo sapiens
  misc_feature (526)..(526): n is a, c, g, or t
ccaattttacacttttagtagagacggggtttctccatgttcgtcaggccgatctcgaacccccaaccctcaggcgattcacccacctcggcctcccaaagtgctgggattacaagcatgagccaccatgcccggacatttttttttttttttggagactggatgtctcactctggtccacccaggctgggatgtggcattgggccgccatctcagttcatctggcaacctctggcctcccgggtgtctcaaggcgattctcctgcctcagcctcccgagtagcttgggtattacaggcgcgcacccaccacacccagctaaatttggtatttttaacgtaagaagacggggtttccaccattgttggccaggccggtctcgaactcctgacctccgtgattccaccttgcctcggcttccacaaagcgccggagaccacagggcattgagccaccccacctgggccaattttgattatagtttactagtgatcagcttggctgaacaacttacaacgattgcgcncttcctatagtaaattttcccccggggaaccaaaggtcaacggtgctttgacccctccaggaccaaccagtaccgcgccaaagcccccgtatatttagccacttggggggcaggaatcatttaacaacctcaaacagatgtccacacatttcaagtacacaatttgataaatcaatccactggtttcctaggacctt

SEQ ID NO: 529149 - DNA, 923 bp, Homo sapiens
gaagactaccccagttgtcgtggcgcatcaagttatttctacaccgcgctaacctgtggtctactgcgaagaaactagtcgcgagtcatagataagccccaggtcacctggtcaagatgggttctaaaactacacggcgccacaagtgtgacccccgcttcggtgtgggagacaccgcctacattttcgggtcaccaccacagatcgccccctagaggtgttggttcaccccgggccgcacgatatggtctcgcaaataagttgtatcccccggccgagcgtaaataactctcgtcgggtgatgatatggccgtcgtcatacgctgcagagaccttgcctggagttgcttattgggtgcttcggattcccaaaatagtgctgagtagctactatataatacctcccgctctcttgctcgaaagcggtccattgctcgaaataatggttaagcttactcgcccctagaagatagatgggacctgttctgtaagtatgagctattctatctctcgcgaagctccctgctctttgtaaagccagtaccgcgcgagctagcacacgctccccgcctgcttttagatcgctcctctcggggggaggtacacttcttctgttagggtagatagaccaccattgctctcccggcggcaagaaaggtcgcattgcgctagtctcagccgagtgtgccaccaactatttggtctcacacgccctcaataaagcccgcttgaacacagatttgtgccgccgctccgcctcactggggggtcatccgcatttcctcccaccacctgggccctaagacaataactccgcggattgtatcacccagggggtaacacccctatcagttcgtaccccgtccccccattttccccgttacccccacccccacatccatccggggtttccccctaaaaac

SEQ ID NO: 529150 - DNA, 304 bp, Homo sapiens
  misc_feature (248)..(248): n is a, c, g, or t
ctaaaaatacacccattcactaggcgtggagccacacctgtaatctcagctactccggagctgaggcagagaatcacttgaacccaggaggcagaggttgcagtgagctgagatcgtgccactgaccccagcctgggtgacagagcgagactctgcctcaaaataaaacaaagggtcaagcttcagactgggcttggttgatcattcctgtggtcctagcactttgggaggccgaggcaggcgggttngctgagctcaggagtttgagaccaacctgggcaacgtggcaaaaccccatctcttt

SEQ ID NO: 529151 - DNA, 174 bp, Homo sapiens
tttggggggggggaaaaaggggccccccccttttttgggggtttgggcccggggcccccccccccccccccccccttgggggggggtttttttggggggtttttttttttggggggggcccccctttgggggggggggggggggggggtttttttttgggggcccctgttggga

SEQ ID NO: 529152 - DNA, 120 bp, Homo sapiens
  misc_feature (2)..(2): n is a, c, g, or t
  misc_feature (56)..(56): n is a, c, g, or t
tnagtgatctcctgtcagcttccaaagtgttagaattataggcatagaccactgtngccatttaaaaaattacacacaatacacagaaacacacacacgtctataaggggctctttttgg

SEQ ID NO: 529153 - DNA, 801 bp, Homo sapiens
tgaggcccatttgagtatttggtttctcaattagggagatagtgggtattaggattaggattgtggtgaagtatagtacggatgctacttgtccaatgatggtaacaagggtagcttacgggttgtcctccgattcaggttacgaatgaggaggtctgcggctaggagtcaataaagtgatgggctaagggggcgaaatattatgcttggtgttcggatcatatggaggatgggcgatcattcgctaggatgaggcatgcgatagctaataggcgcaaggacgcctcctagtttggtccaggcgacggattcggcccaactcgtcgtaagcgccgaatacggacaattttcattccgggcgccttagacgtcggcggacgcggcgatgtcccaccagcgcgctccgcgcccaagcgcgactaaaccctcgccacggggcacgcccaaaacgaagggcctcgcctcaccacatcgtcggtccaatcggtcacctatcaccgcgagcacgaattgccacacaagaaaagtaccagccgcggacggcgggcgccaccacaccgagactcggtgctaacacaacgggggcttggcacagcggcagaacacctcacccgcaggaaccatgccggcagcggctgaacaccccactacaaagggggccgctagggtcagaagacccccccgggctcaccgccggccacacaacatacatcgcgcacgttgggccatcgcttgcggcctacgacggccctcggcaacccgacaacgacaacgcgcgcccaccacatacccaccgttgaa

SEQ ID NO: 529154 - DNA, 359 bp, Homo sapiens
tgctacctctgatctggccacgccaccgagcacagcgagggatggacgcccagttggccaaggtcaaggacccgtccctgacgccgtcggctcaggtgttggcagccatggctgagcgcaaggaaagctttgcgcagttctccctgcatcaaagcgaagtccatgccgaatacttccgcaaagaaccttcggcgcctgaggaacaagcgcactttgaagaactggcccgtgcgtcgctggcgcaacaggcagagctggagcagaacgaagtaggcgatttcgatgtgtttgtcggttcgtaccaggcaagccagcacccacattattctgccagcctgaaaacaggcttcgccatttcc

SEQ ID NO: 529155 - DNA, 708 bp, Homo sapiens
  misc_feature (67)..(67): n is a, c, g, or t
  misc_feature (92)..(92): n is a, c, g, or t
  misc_feature (127)..(127): n is a, c, g, or t
tctggcagggtgtgtgtgtgctataccttaagggggaaggggggtcgatatgcattatatgtgccgngtgtggaaaaaaaaaaagtcgggtnctcggtttggtaaaagtactttaaatggcctcagngatacagtataaagataaacagaaatgctgagataagcttagcactggagttggtacaagcagaacattggtacaaaatagatttaagggcaaacttctttacacggtggtggctccttggcaaactggtctgtcacaatagatagtggtcatgtggcaggttccaaggtaaattcacttgtacatatagacaaagggaaactttggccaaaagcgggagatctttactggaaagcagagagcagctggttatcgcacccatatggaaaattggtatagatgcttgggacagacccgggtaaatgggtgtgggccatgggtaaatggtgggaacacacaaggtcaccttgaattcccaagaatgctcacaaacctgcaggccatatcatgggcgtagggcactcattaaaagggttaagagcaccattaagaagagggaccatacctatgtaaaacaatcttgtggcagtggaggggtaagaatatgtagtgaaagtaggtagagtaaatcggggtctggcatctttgtagtagctacaattttagcacatggtacatacaattggcaaatccatctcacg

SEQ ID NO: 529156 - DNA, 156 bp, Homo sapiens
  misc_feature (80)..(80): n is a, c, g, or t
  misc_feature (107)..(107): n is a, c, g, or t
  misc_feature (112)..(112): n is a, c, g, or t
  misc_feature (115)..(115): n is a, c, g, or t
  misc_feature (147)..(147): n is a, c, g, or t
gatccggatgacgcatcagatactcgacccaccacacagccaactcgagtggcggcacaggattatctcggaagcgtttngagcgcagtctcatcgcttttgagtancgttngtnctcggcacctcgcgtatggcggataccaaacngtcggtggt

SEQ ID NO: 529157 - DNA, 1018 bp, Homo sapiens
ctcctccgcgctccgcccgtccccccatcccgtttccctccaggtgttgttgagggccatttggcgttcctctgcttgcatccccttccagctccctcccctgctcagaatctgataccaagagacagggcccgggcccaggcgagagcgaccacgccaggctcctcagccctctcttgccaaaagcacaagatgttgaggcgagcagtggctttttccccggggagggtgccagagttatctatgaatctattttcttcatactgaggccttttggtagtcggagcccccgcagtcgtcagctctccctgacgtctgccacccagtcgcccccaacgtcctcctcctttctttgctgtttgtcaatctaccagcgtgggtgatcctcacgacatcctctgccccttgggcctcccactcccatggctctgggcggtccataaggagcaggccctgggcctccactcgtctgtgcagggcacatgaaggctgggggtgcggggagatgagtggattccctccccaccctgtccccaacgcgagctccactgtccgctgtctccctcctgattctaaagtgtctcagtgcaatgccccccgtcccctctcgtttaccgagggacagccttgctcctgtcacaagcaaggctgtcggcggtcaagctggaaaggccaacagtcttccagtggcttctccaagcactcttggggaccaggtatattacacgctctaaaggggacttgtcccgagtctgacagtcagagcgttacaggggccagcggcctcccggcgatctgtgtctactctaggactggcctgggtggtttcctgcgccctgagtcagctagttagctctgccactgcaagggtttcgagccataggtggttctccctctggatatgtagtccggtctctccgctgttaaaaagggcccccgcacgggcgctcggttccacgtgtagcgggacggggttttagcaccacggtaggcacacacccgggaccctttggcccgc

SEQ ID NO: 529158 - DNA, 496 bp, Homo sapiens
tctgcatttggggaggcccccgagttcccacttgagcagtgtggtggcggtgagtgccagtgtgagcgtttgctagtctgccatctggacccggtctgcggaacgcagactctgtccacttatgtgtagtcaccgccagcagactgctcaagtgggaactcgggggcctccccatatgcagatgacgcccgacccccacccctgacatccattttgtgtccatcctgtgtcattcccacagtgagtcagcagcccgtgtgtccactggatccttcccaacacctcctgagcctcaatctgcatcaggcccgcgggaggccggtcaagctgtgaccggcaatggggtctcagccagaggcaccagcccagggcagggagaaggccgagaaggccgggagcgcggctgctgccccactgactctactgtctcctcaggatgtggcttctcctcacataacaacagagctttctccaaaatgggaaatttcagttttaa

SEQ ID NO: 529159 - DNA, 742 bp, Homo sapiens
gttgcaatagggtctcgctttgtcacccagccaggagtgcagtggtgtgatcgtggctcactgcagcctcagcctcctgggctcaaacggtcctcccgcctcggcctcctgattagctgggactacaggtgtgcaccaccgggccaagctaattctttaattatttttagtggagacggagtcttgctctgttgcccagtctgatctcagactcctggcctcaggtggtcctcctgtcttggcctcctgagtagctgggactacaggcatgctccaccatgcccagcttaatttaaaaaacattttttaaaatagatatgggtctcactatgttgcccaggtcagttttggactcctggcttcaggtgatcctcctgcctcggcctcccggagtgctgggattacaggcctgagtcaccagcctgggcgacagagcaagtctccgtctcaaaaaaaaaaaaaaagtgttcaccgggtcactgtaaccccaggagacgtttctgtccccttctcgatgggttaccatcagggtgtagacatagggactatgccgagagatgagttaggacgtgacctgtcaatggtaagctccagggtccagtttaacccaggcaaataggtgagcaggggacccatggtagatcacagggtgttaacacaccggttccaaccttaggggagactcgggttggcccttgtaggaaggaaccggacactcacagggattacccggcaaggccat

SEQ ID NO: 529160 - DNA, 185 bp, Homo sapiens
gctagaccctcccacagtagcctattatactttcagattgtctgtcaaatcaagcctctcattactatctgtctacctccattctgaagagggcggttttggtgtccctggtcctctggaaatagaagatccatttgtctttgtgtagagcaagcactgttttccacctcactgtggagtaaggg

SEQ ID NO: 529161 - DNA, 598 bp, Homo sapiens
tcgggtccagggtgtgtgctccccctcctcaattttttagggttgcctcttttccccccgggggggcccccgggctctccccttttttctatttccccgggtggtgttttttttaaaccagttccccctttattgctggccgcccctattatatttgccctgtgccttgggggggggagaaaagggtctcttttttctttcccccccaccggggtgtttccccccgggccgaaaattgggtgcccgcccccctttccttccccagggggcccttcccccattggtggttttttcccttttccccgcccccgggaaagggggctccggttttgggggggctttaaaccatattccccccccccccccccctgggggggtttgggcccgtttttttttaacccccccccccccgggggaagggggccccttttaaacttagggggaaaagttttttccaatgggtttccccccccccccgggggtggggggtttttttggggccccccccgggggaaaaaaaatggggttttggggtttttttttccctttttggcccccccccgggggggttttttttttttaccccccgggcccctta

SEQ ID NO: 529162 - DNA, 926 bp, Homo sapiens
aagatgccttgtgtgttcgccatcttagggcaaagatgtacatcagatcccgaatggcgcacctggacagcgggacgaaccccgttcaacacgccacatctgcagctggtgcacgatggtctcggggacctccgacagcagactccccagaggaccccacgggaccagccccgcgcgcacctcgcaagccatggacagaacgccgccgatggaagagtacaagtatcgtcgaatttaggctccagacgcaagatattatagcaacatagtagatgagctattagggtcggggtcatattacagcttcgtaggtcatcgacaacaacaacatagcatgtgggtatccaccatggaatttaggtagaaatagccgatatgcaaggtgagacccccaaaaacagatacgacaggtgcaatcatgtataacagcgaatatcatcgagattgtaccacatttaagaggacagagcattgagatcgtctcgatcgggattttcggcatacacaggcactgagagcatccgaacatttatcacatctgagacatacatcacaaatgacaacgcggcacctcatgacaaagatatataggcactctaatagttgacagctcattattaacaacgatcgtttgactaaatacgaccacaatacgttggacatctgagcacgacaggaacggaacaatcacaattagattacattcattggacaggcaaccaattaaccatcaatactcatgggacatgcacattcatgcaccaaaagtgaacgtgaaacaatatcatatgaggacatagaacccatttatggccccattggacactccactaactgagacaacgacatggcataaagaagtatacagcagaattacaacaagcaacaaagagcacacgagcgtacacctgcccacagcaaacatt

SEQ ID NO: 529163 - DNA, 280 bp, Homo sapiens
ccccccccccccttttttttgggggggggggggggggccccccccctttttttttcctggcccccctttttttttgggggaaaggggggggttttttccccccccccggtgtcccccccccgggggggggggggtttttttggggcccccctggtttttttttttgggggggggggggttttgggtttttttttttttacccccccctttttttgggggccccccccccccccattttttcccccgttttttggcccccccttaagggttttttggggga

SEQ ID NO: 529164 - DNA, 524 bp, Homo sapiens
  misc_feature (237)..(237): n is a, c, g, or t
ggtggctccccccggggggcgtttttcccctccccgggccccccggggggtcccttggggttggggccccctctctcggacccccccgtgcgggcgttgtggccttttttgttggggccccggttttcccccggcccccaaccccggggtttccccccaagcgtggtcttccgggggtgggttttcccggcccttaaaaccccccccaaagcccgcggggtgggggccccccttttnccggtgggttttttttgcacccccccccggggccaaggggttccccggggtgggatcccccctgggccgggggtggggggtttttttttttggggccgggccccggggccaggggccccccccccccaggggcctttttttcccggggggggggccccttgggcccggggccccccccccccccccccctggcccccctggggattttgtttttctgtttggggcccccgtttgggggcccccctttgtggggggccctttttttttttagggggggttttttttta

SEQ ID NO: 529165 - DNA, 118 bp, Homo sapiens
gccctccgttatggcagaaatttctctcctttcttccccctatgcaccaatctcatatagtggtgtgatatgatttggctctgtgtccccaaccaaagctcatcttgtagttcccata

SEQ ID NO: 529166 - DNA, 304 bp, Homo sapiens
actattccacggatggtactagtccacggttggctactagtccacggtttggctactagtcacggttggctgagtaaatgtcctctacttgacaatacatgatgtgtaataacaaatgatcaaatactatgaaaagtggagagacagattgcagaataaaggacagtgccttatattttggtatctttaatagcacctattttctgcttttttttttatttttaggaaacagagtctcgcccggttaaccggaggaggctggacaagtgcaggtgccccgatcctcagctcaggtgcaacctcc

SEQ ID NO: 529167 - DNA, 141 bp, Homo sapiens
ctctagagagtcccattctagtgctgatatacgtcgaaggattcatattaaaatatattgtccatcatgacgttccacgatatccagaactaggtatataactcataaatactggttaatgtcttagccggttatctcaac

SEQ ID NO: 529168 - DNA, 465 bp, Homo sapiens
  misc_feature (157)..(157): n is a, c, g, or t
  misc_feature (450)..(450): n is a, c, g, or t
tatccaaaatgtgtttattgagatggtttcccactcatcttgactcaaagtgctttaagtgctgcttcctcctgaaggaacatcctttctgtaagccttgctttttcctcctgtgttaggctggcagaggacaggtggagcagccaacacacaaaanctaccgcttgtgtgcagtggcttaaaagaccggtggttgatatttattagcactccgtagggcttttcacattccagtgaagataggaatgtgggggctctggcaccagggcgtattcttacttggtgtattcctcattctccttcttctggaagaagggaatgaaaggaagaatcccttgtggcgaagaaaggccaatgttttctacgagtgtgtgccgtataaggggttcgtttcacaaatattttattatatctcagaacaacaacttaacatgtgtgtgtctacacatntatctacgtgtgggg

SEQ ID NO: 529169 - DNA, 343 bp, Homo sapiens
  misc_feature (129)..(129): n is a, c, g, or t
attcattccttctttcattttccaactcagttattccagtttaaggtggtgggcgaccagagcctatcccaacagctcagtgtgcaaggcagggaccactctggacaggatgccctcccatcacagggnacactcaccccccacacacattcagactgcgaccagacaccaacaaacctcacctgcacatctttggggcgtgggaggaaaccagagtgcccagaaagctctccgaccgggaggacgtttagacggtgcacagacagtggccccagccgggaatcaatttttttctcaatgttataacaaaatgacattgaataaaacgatgctattcaaggaa

SEQ ID NO: 529170 - DNA, 225 bp, Homo sapiens
cctcctattcacagtgtcccccgccaatgtgtatcactgctcacacaggtctcagccaggctcggggataaacaggccagctctgcccctccagtgagctcagcgaaggcggggacagaacacgccaatgggccagccatcaggcacacatgccaaggtggtgacagcacaggtggccaggagtgggttcacaccatgacagggccctgacgagggaggcagcag

SEQ ID NO: 529171 - DNA, 340 bp, Homo sapiens
ccccggtcacttgctacacctagttttcagtgtacaggtcttttacttccctggttaaatttattcctaagaattttttttttggtagctattgtaaaagagattgttttcttgatttctttttcaggtagttttctgttagtatatagaaaactactaatttttgtgtgttgattttgtatcctgcaacttttactgtatttattaatcctcataatttttgatggagtctctagggttttctatgtataagatcatcagcaaacagcaactatctcacttcttctggccctatttggatgccttttatttatttctatggcctgactgctcttgcgat

SEQ ID NO: 529172 - DNA, 167 bp, Homo sapiens
catcaaaaatctataggaaaaaaatctaattacccatttttaatcagattatcttttaattgggtaattagatttttttcctatagatttgtttgagccccttagatattttggttatgaatcccttgtcagatggataatttgcaaatattttttcccgttctgtg

SEQ ID NO: 529173 - DNA, 427 bp, Homo sapiens
  misc_feature (21)..(21): n is a, c, g, or t
cgcggccgcgtcgacttttcntgcatcaggagacagtatggagccagtcattcctgatggtgcaactgtagctgttgatactggtaataagcgagttattgacggcgaactctacgccatcaaccagggagatctgaagcgcatcaagcaactttatcgcaaaccaggcggaaaaattctaatcagaagcattaatcgtgattatgacgacgaagaggccgatgaggcagatgtcgagataatcggttttgtgttctggtactcggtattgcgatatcgccgataattttagtggcctgaagagacgtttgggtgatgagagaatatctgatagtaggcgtggttactttgctctcggttgttgcgatcgtgcttatggtggcctgatgagacgttttggtgaaagcatgtcgacgcggccgcgaat

SEQ ID NO: 529174 - DNA, 91 bp, Homo sapiens
gcggccgcctactactactactgctcgaattcaagcttctaacgatgtacggggacatgctatctctagtaaatctaaaatcttgaaaccc

SEQ ID NO: 529175 - DNA, 675 bp, Homo sapiens
tgtctggacaatcagtcttatgatctctccacatgcacctgttaaccccttcttctgctgacgatagataaccgactcttgctgtaatttgccattacctacccagctcctggtaaaggccacagccttccccatctcccttcgctgactctcttttcggactcagcccacttgcacccaagtgaatacacagctttattgctcacacaaagcctgttcggtggtcccttcacggacgcgcgtgacacttatccagcggtacttcctgcagaaccctgaccttttacaaaaatccaccaattcaaaatgtattgtgtggatggcttcaggatggaagcagtctccactcctaagcttcgggggaggaagggctgaaagtgatcgcttaagccccctctaccccatccagctttcccttataaatgagatcctatgcagagttggataagctgttacagatccacgggtacacacgcctttacctggagctatagcatgtaaattgtaaggttttatttaattttacaggaaggcccttctttttcctttgctttcttttctttttgtccagtaccgtgtttctctctagcttatcattcatactgacagatcctgatatctacagtgacttggggaatttcaaaggccgcgctaaaactctgttggaggcggcgg

SEQ ID NO: 529176 - DNA, 115 bp, Homo sapiens
tcagttcaaggtcatctggtcatctgccatgtccaacatcttccacgtaggtggcatggtgcaacttttgcaagcaaccaacacaggcttttggcccaccagcaaacccacattg

SEQ ID NO: 529177 - DNA, 873 bp, Homo sapiens
cgctccagcctccaacgctcgtcacagccctctcatctcctggaaccatggccagcacagtcaccaccatcagtgatgccacagcagcagccgccggggtttcaggtgccaactcagccaggctccctggggtcatgccgctctgtgcttcagcagctatgtccgtgtcccgctccaggggcagtggtggcctggtgtggtgcatgtggaggagctggcatttggcagccgcagtctgtatggcctggggggctccaagaggatctccattggagggggcagctgtgccattcagtggcggctatggcaggcagagccggaggcagctatggctttggtggcgccgtccagtggacttcggtttcggtggtggatgccggcgttggcttgggtctgggtggtggacgccggccttgctggtaggctatagggggccctggagtttcgctgtgtgccccccttggagtgcatccaagagggtcaccgtggaatcagacgtctcctgagtccccatcaacctgcaagatttgaccccgtcgatccagcggtgatgcgggccgatggagcggtgcagcagattcagagaccctcaagaactgagtttgcctctcttcatcgacaaggtgtcagttccgtagaccgggagaacgaaggttctgggacaccaagtggacccttgactgcaaggagcagggcaccgagactgtgaggcagaacctggagccgtagtacgagcagtacatcaagaagctcaggaggcagctggacagcatcgtcagggaacggggccggctgggactcggagctgaaaaaactttgcacgaacctgggtggaaggaactccaagagcagattttgacggatgaaattgac

SEQ ID NO: 529178 - DNA, 200 bp, Homo sapiens
cttcttacggtataaagctgttgcttcctgaagaggctacaagcatccttccctaggacttctgtaagcttttgagcctctagcaaggagacatgccctcggggacgaaaagagtcggcgccgccgtaaatgcgaagaccgcaaaaggagaacccgcaaccaattcgcaaatcccaggcctcaaagggctcccgaagacc

SEQ ID NO: 529179 - DNA, 112 bp, Homo sapiens
gggcaaagtgggttttggtcgttattggggcctagatttgagaaacgatcctgatccgatcgggagacgatattactaactgacctgtgttcagctccgaactattttttgg

SEQ ID NO: 529180 - DNA, 173 bp, Homo sapiens
cttcaaaaagcaaagcaacatgtccatcatgctgccaagcatggcatgcaatccatcaagtgcaccattcatcactgcacacagcaatcaggcccaatcaaccacagcacagcaccattcacgttgtcatgcattcccacattcaccatgggagtcatctcacacagtcagtc

SEQ ID NO: 529181 - DNA, 215 bp, Homo sapiens
  misc_feature (162)..(162): n is a, c, g, or t
tcactgaggatcccgaaaccctgattacgatcaactgacacaggtagcgagtgatagatttgcaattggaaagccaaatttggtaattccaagcaccttaccttaggcttgatgtgagggttcttctaacttgtatgaaatatttgaagtaattgccattgnagtactaagtattactggttaaaatataattttggtctgcgtaattggggttt

SEQ ID NO: 529182 - DNA, 485 bp, Homo sapiens
  misc_feature (11)..(11): n is a, c, g, or t
  misc_feature (14)..(14): n is a, c, g, or t
  misc_feature (21)..(21): n is a, c, g, or t
  misc_feature (30)..(30): n is a, c, g, or t
  misc_feature (33)..(33): n is a, c, g, or t
  misc_feature (54)..(54): n is a, c, g, or t
  misc_feature (63)..(63): n is a, c, g, or t
aaggtcagtcnggnaagcacngtgaaacanaanccataaaaatgtaagtataangtccagtantcactgacagtatttttcattgttaatgaaaatgaaaaaatttatttcatatggtattctcatttcctgattaaaaatattaaaagcttttatgcaaggtattgaagacagtgttattttgcattataataaaataaattgcccaaatatccattgatagactaataagataaagttacatggaataatattatgcagctcttataaaaaatgtaaaaacctagccattgggaaagtctaatggtataaagttaagtgaaaatgaaaatgctgagttggatttatattgtgctttgcattcctgcagctaagaccaggaatatcagggggaaatagtccatagattggtttatggtttacaccactttttctggatttgctttagaactttatttttttatgattatatagttgttatttat

SEQ ID NO: 529183 - DNA, 1192 bp, Homo sapiens
  misc_feature (1092)..(1092): n is a, c, g, or t
tccggggcgcagttcctcatgtttcgcgggagttctcgcattgtgggccggcgtctctgtcctacggcgcggtgtagccccgggggatattcttgagttgttgttgcgcgccctctgggtagaggcgcttgtgtacgtcgtttgtccccagaagttcgttggtggggatgtttgctgggcgcccagctctggttttgttgccccgtgttccaggagagggcggtggactgacctgcccggtgtgttggcgacgcggggttctgttcctgtgctctggacaccactttggaaggtgggtccccgggtcgattttacccttggtgttagctctgtccctgaagggttggtgatcgtggctgcccaagcgttgtgtggggttttcatctcactgtgctccacagaggggtcggttctgggcacggcgctccgcgggcgagccatgtgcgagccagttgtctgtggtccctccggcagtttggggttcgttgtgtgggggttgggccctcattgcgcgagggcactcccttggcgcactctcatgctccggtctccatacgtttggggggctctgggtgcgctggcggtttctgtggctcactcactgttatcccacggggcgttcacgtggtgttttgtccccggttgcgcatagtggtcacagagggtgtatgctcggtgtagcaccctgtcggtgcggttctggcacggtctgtctgtcctgctgcggcttgtgggcgggcctctctgcgtgtctcatatggccagcccaccgcttgctagagggctacagcctctcgccactgagatgcctgcgcacgtcgtgagacactgtggcgtgtcgccgccagctgtgctcccgctcgcgtgtgcacgctgctgctgatggccctcgagacacctggctgttgatgtgtccccgtatgttctggagtggtgtttctgctcgtaggtgggggtgtgcacgagtggtgagtggccgccaccctgtgctgcgttctccacgagagctcacggcggctctggcacactgtctggcgctcacgtatccgccacgtaccacgacgaaaagggccttagcgccccacggagacncgggcccttgggaaagaagtactgaagtggagttccctgttactttagaatattccaaaattatatgtatgtaaccagtgataaagaagaaaaaagaaaa

SEQ ID NO: 529184 - DNA, 110 bp, Homo sapiens
aaacaaggatttgttggtgcagtacaactaggcttaatctcgaattcgaggctcgaattcgaggctcgaattcgagcctcgaattcgaggttagaagcttgaattcgagc

SEQ ID NO: 529185 - DNA, 301 bp, Homo sapiens
ggtttctgtctcctgctgccctgtgaagagattccctctgccaagattgtatgtttcctgaggcctttccagccatgcagaattgtgaatcaatctaacttattttctatataaattacccagtctcggtatttgtagcaatgtgagaacagactaataaagggggtcaataaagaaatgaagaaggaattgaaaattctgaacaataatggatggatatgaaacacactataccaaacctgtggatacagccaagcagtattaaagggagttacagctatatcatctcatcataagtaaa

SEQ ID NO: 529186 - DNA, 496 bp, Homo sapiens
  misc_feature (108)..(108): n is a, c, g, or t
  misc_feature (119)..(119): n is a, c, g, or t
ccaagtccttctctttatttcccaccagccccagatggcttgataatagatgaacatgcacgtgccataagtgatggaaaccccagtaatatgtgaagaacagggatnctgtgctgcgnagatcattacggaagcaacagtagcaggtggcctggccatacagggattccttactcgcagcagagaatgttgctgccactcaaagtcaccaggggctgaagagctcctgtggagacccacatcatctaacaacacacatactcaaaacagggaaatgtgcattttcgggagaggaagagacaaaccttttgtttagctaactggcatgacagagtgtgacatacatgtgctcctggaagaacggtgttgggtgtctgcactcaaaatcttgagcataggcaactggatgaagggctctgtggcattgattttcattgtgtgtgtgttaatatttacatttataattaaataaataatcgaaattatgctgaactga

SEQ ID NO: 529187 - DNA, 542 bp, Homo sapiens
agacagcctggctacgatggtgaaacccgtctctactaaaactacaaaaatcagtagggcgtggtggtgtgcacctataatcccagctactcgggaggctgagagaaaagaatcacttgaatccgggaggcagaggtcgcagaagagccaggatcgagccattgcactccatcctgggcgaaaagagtgaaactacctctcaaacaaaaaagagcaccctgggcaacatggtgcagccctgtatctgaaaaaaatacaaaacttcgccaggtatggtaggtagtatgcttgtagtcccaactcacttgggaagctgtggaaggaggatcacttgagcctgggaggcggcaggttagtaaagtgggctaagatcgcaactatatagcactctagcctcggtgacagagtaagcacactgtctcaacaaaaagaaaaagaaaagaacaagcgtacataccgcctgtaatcccagcacttagggaggacaacgcgggaagatcacttgagcccaggagtcaaaataagcctcggcgccccgaccg

SEQ ID NO: 529188 - DNA, 278 bp, Homo sapiens
  misc_feature (1)..(1): n is a, c, g, or t
nttcttgtaaaaccgctagaaactgcagagacctgaaattctgccatcctgaactcaatgagtggagaatacttgggctgatccatgtatgcgatgctatttggtgcagtgactatgtgattgttctgggacgctcggtgggagagactgcgaaggcctgccagcttggcatcaaggagatcttcaggaagtacaggattgccgtagctaaacgtgaaaaccaacatccatgtactctccaaaccaaacgtgttacttctcagcactagaatctgtcc

SEQ ID NO: 529189 - DNA, 239 bp, Homo sapiens
tctttgagacaaaggtcttgctttgtcattcaggctggaatgcagtggtgtgatcaaggctcactgcagccttgaccgcctgagctcaagaaatcctcctgcctcagcctcttgaatgtcagctgggacaacaggcacataccactgcacccagcaaatttttagtgtttttttgttttttaacgagagacggagtcttactcatgtttgccccgactgggtctcaaacttcctgggct

SEQ ID NO: 529190 - DNA, 165 bp, Homo sapiens
gaaggaaggaaggaaaagaaataaacaagtaaagaaaaaagaacctctcttctaccagtttttacagaatgtctctctgctgggtcacttctgaatgcttaggcaacttacctctgccttagcgttcactttctgctttcactgagcccagaggttagcaaaagg

SEQ ID NO: 529191 - DNA, 500 bp, Homo sapiens
  misc_feature (117)..(118): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (142)..(142): n is a, c, g, or t
  misc_feature (145)..(145): n is a, c, g, or t
  misc_feature (155)..(155): n is a, c, g, or t
gatcgggtactttctattttgtttctaaacgagcaattttgaggatgaaatgggaagatatcattgcttcctttttgcacctattgggtatgtacactctgccgaagggggggttgnnccccnccntcntaaaatttggggntgnttaaagtttncaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 529192 - DNA, 574 bp, Homo sapiens
  misc_feature (70)..(70): n is a, c, g, or t
  misc_feature (109)..(110): n is a, c, g, or t
tgtatccatccacctatccatccatctacccatccttccacccatccatcaattcatccgtccatccgtncatgcatgattcatctgtattagtctgttcttgcattgnnataaagaagtacctgagactggatgatttataaagaaaagaggtttaattggctcatggttctgcaagctgtacaggaagcagagcagcttctgcttctggggaggcctcaggaaacttacaatcatgatggaaggtgaagtggaagccagcacgtcttaatggctagagcaggagcaagagtggaggggaggtgctgtgcacttttaaacaaccagatcttgcgggaactcattcatggtcacaagaacatcaccaaggggatggcgctaacccattcgtgagaaatccacctccatgatcccatcacctctccccaggccactcctccaacactgcggattacaattcaacatgagatttgggtggggacacagatctaaattatatcaccacctcgcaagccagtgatctcaatagaatgctgatgttcatgttgctagtggctataagccttttttctca

SEQ ID NO: 529193 - DNA, 966 bp, Homo sapiens
gtgacgctaagcctgagttatgcctgaagtggactgtacatatggatgtgagaccaataggggattcgactgaatctctgccactgttgcctcatgctgtccggataagcttagggagatactcattatagtgggagttggattgttacgatatggtctaggatcatatggtatcaacataggaggctttaggcatcacttgtttagccatagaaggtacaccattgtgtatctcaccaacagtccgcattgcttgtcggatccacagcggagcggcgtacactcttgttacccatcacgttgtggtgagctggttggaggataagtggtcccatgacccaagtagtgcttaaatggcgcgtaaactgttcgagtagaaaagatcagggaagttacgattgacacacttagtgctagttatacaagaacggtagatgccctgctgatcacgtttgctagctccccgagccgagtactgctctttcccataggttacccattgttaaaggagcgacgtcgcccatacataggtttagcctaaactaggggaccgcacgacagccaatcggtctggagctgagggatagtcgaacatctcttactatgggcacttaaaaagtaagcattcttggtgtactaagtatattccggtacgggagccatgggtggcgtattggccttggtcgggcacgggacacggcatgcgcggcacactatcctcgagcagtcttagtgacttatcacctgaaacttggggggcataccatttcagtcaaacaaattcccaagaagctttatcataattcaaaattaattcatattgcgtgttatgcacatcacccaccggtcccggcacaacatcactcttcatcgacctacccttaactaacatggacttctgagaccaacgatgcactcacctgagtaatatgtcactcattggtcgacagtttcggccccttggaa

SEQ ID NO: 529194 - DNA, 157 bp, Homo sapiens
cgctgtgttgactctagcggatcccgtcccctcctgcaggtcttgtcaggggcccagcctctgggcccggtaactcagctactctttgtggctttcttcatggctttttgtgtgggctgccacgcctatctttatcacctagatgtgaggctcctcc

SEQ ID NO: 529195 - DNA, 228 bp, Homo sapiens
tggctagctgcagttgtctgtgagtgtctgtgcgaggctgagtgagagggtagaaaatacttgttgctagtggaagaaccaggagactggggcagtgcatggtgagggggcactgctgtcctgcacaactagggtgtatacacacacacaccacacacacacttaacacacacacctaacatataccagacacatactatacacacacacattctcacgacaactgca

SEQ ID NO: 529196 - DNA, 296 bp, Homo sapiens
aggaccagtgtcatctctgtcatcatgataaaggcaaagtctgggcatacaccagctgtcctgcggcattgtgccctatggtgcaacagcagaggggtctccagcaggcaaagctcagagacgtggcctaccaaggtttataacccacgtggtggagtgggttgttcacagcaaagggagtaactaactccagacacgattcccactcttgcttggtaacaataatgctgagctgatctttcccatacacaaaactccgaatgacgggtgatttcttttgaagagggaggcagaaa

SEQ ID NO: 529197 - DNA, 317 bp, Homo sapiens
gggggggaaaaattaaacgctttggggaaggggggttttaaaaaaaaaggggcccaaaagggatttttttaaaggggggtttttcaccccccccccctggaaaattttttttggggttttttttttaggggcccctggccccgggtttggcccccccccccccccgggttttaaatttttgggttttttttagggaaggggggttggttttttaaattttcccccttttcccaaaaaaaaaccccccctcctttggggggcccctttttttgggggggggtttttttttttttttttttagggtttttggcccttga

SEQ ID NO: 529198 - DNA, 236 bp, Homo sapiens
aagtatggcgatcactttaagcttgtctccagctggcacactaatggaggcaccacaatcagccactggggcgaggatgggcacgatggccaggttcccaagagctcaggtgagtacacagtggacggcccaggggccctcaccccgctcagcttgtggctctaacattccagaagctgaggcctctggtatccctgctcttatccccaaggatattccatttcagacaatccgtt

SEQ ID NO: 529199 - DNA, 345 bp, Homo sapiens
gagcaaggaaagccagactgaattccccaaactgaagaatttggagtccagtgtcgaagggcaggaagcatccagcacaggagaaagatgtaggctggaaggctagccagtctctccatttcatgtttttctgcctgctttgtattcattgacagctgattagattgtgcccaccagattaaaggtggatctgccttctccagcccattttctgcctgctttgtattcattgatagctgattagattgtgcacaccagattaaaggtggatctgccttccccagcccactgactcaaatgttaatctcttttggcaacaccctaacagacacacccagtcgacgc

SEQ ID NO: 529200 - DNA, 774 bp, Homo sapiens
  misc_feature (376)..(376): n is a, c, g, or t
cccaaaaccactccatcttactaccagacaagcttatctcaaaccatttacccagataaagtatatggcgatgagaagatttgaaacctgagtgcaatgagatataagtaccgcgaacgggaacagatgaacaacttataatgcaacgcagtaatatacgctaaggcactgaaccccctatataccttcctgcataagtgcaattgagactaggaagataaactttagcaagggaggagccacacgctaaagagtccccagaacacccagacgacgctaaccgtaacgaacagtgtagaaacgagcactacccagtcatatggtatgcaagagataagtgggaaggatattataaggttagaagggcgagcaaatncctacccgtagccctgtgtgataagcatggtatgtcccaagataagaaatcttaagttcaagctcttaatattttggcccatcagaatccctcctataatcacccgttggtaacattctagactgtgttgtcccacaagagtgaaccagctctgttgggacagctagtgataaaaaacccttggtagcagagcagtaataaccatttgaactaccctattagatagggccgtaataagcgaggcgaccaatttaatgaaagcggtgcaagcctcaaaaaagcaactatcttgtgaaattcgcaaaacataataactgaaatacttcagagccccattggagcaatctagtagcctatagaactcatggtagtgtaagtacatgggttttctccggtgc

SEQ ID NO: 529201 - DNA, 306 bp, Homo sapiens
gaaacaatcagctcggtaccgctagcggcattatgtgaacgggggagagcctggcccagcgagagctagaggctctggacgtggagctcctccacaagcgtgttcccgagggggcgccctgtaggtatgaacccaggacgtggtcccaggtggtgacacctggggtccaggcgtgggcatgtaccacatagggggcttatggggtcacagagccctaagctggccccagacaataggcagacatcaagggaggggccctgcagcccggtgccagggtgagggtccgttcacttaatgccgctagcg

SEQ ID NO: 529202 - DNA, 509 bp, Homo sapiens
agtaaatggtctgatctatattgctacacctgaactacaagggatatccgaagtaatctgacatatacgttctcctagaaataacgtcacttcccagtaatttcagacatagaaaagggctcatattggtacatatcctcaatagtaattgcaaacgtgcactgttagccccaacaagattattctctctctccagcgtgtccacaaaaattctccgagatgacttactcacttagacgagagctgcactctattgaaactaaatggagaagccgcttgggcaggtgacacaggagagtcggtggtagtgctgactttcgctggtgagttacaagaagatccggcactgctgctgtttccatcaagggtatccgaagatacacacacaccaggatctgacagctgtgcaacgtcagaagaaagcatgttggtgatgccctggaaaaatctctttggctgatattcagtttccatttcacattttcttttcaatggtccaagaacacttg

SEQ ID NO: 529203 - DNA, 195 bp, Homo sapiens
  misc_feature (91)..(91): n is a, c, g, or t
  misc_feature (129)..(130): n is a, c, g, or t
gctcacgcccgtgccccgccgtcctccttcccgcggccgtgtaggagagcgatacggacgctagcgactggcagtttacagaatgtctganggggacagtgtgggagaatccgtccatgggaaaccttnngtggtgtacagatttttcacaagacttggacagatttatcagtcctggctagacaagtccacacc

SEQ ID NO: 529204 - DNA, 124 bp, Homo sapiens
gtaactacagtttctgcagcatagtttaaatcctgacaaagaaaccctatgtgttttcatatactaacactagtaaagcaagctgagtttgtcttcaagtgtgggtgggggggtgggggggggg

SEQ ID NO: 529205 - DNA, 290 bp, Homo sapiens
gaaaaggaattagcttgggaaaaagagaaacatgaactcggcctaatgaagctaaagaatcgatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtgggagtgttaccatacaagaagaatcaaa

SEQ ID NO: 529206 - DNA, 1069 bp, Homo sapiens
tgagcagagacaggatttcaccatgctggtcaggcgggtctcaaactcctcaggtgatgcgcctgcctcggcctcccaaagtgctgggattacgggcatgagccaccgcaccgggccaaatattggattttaaattcccatggttactggattaaaaaaaaaaaatctgggaccagttaaccgggagatttagaggctatagacacaatttaacatccatacgggccggggaacttcaggcagagaacaaacaaacaaacaaaaactctaattcagagtctctcatttcagcttagccaacactttgggcagacttaggggccagttctagaagctgggtttaacctctagactcggaggggcaggccctgtcaccgagggggggaaaactcttctgggctgtcagcccggattggaagccacttcgtttccccgggccccagctttccgtggactcattttcacccggtgtttgacacgggggcaaaccacacaaccactcaaagtgagcaaacaattccagaaaaaagaatccgagataaagaataaccaagtaggaagtcttcccatgggtagtatcacggctaaaaacaaaacaaagaaacacacgaacaaaagacagaaaaacaaaaaaggggggggggcgcaaaaaaaaatcacaccaggaggggggccacagttataagaggagccccagagtttattgtgaccaaagaggggggcaccccaaaagagagaggcagcaaatataaacaaacaacaacaggggaggccccggggaaaaaacaccacggaggagatagtagggaaaagaacatctgttaatagcggggagaacacaagagaggaaggagacacccaataaatgtagcggggcggcgacaaacattgttggggacaaactcacatccagagagaaagttagtaacgagccacgccgagagggcaaatataaacaccaataagagagtgtttgattagtcggtggtaaccacgaagcgggataatatatggcggcagacagaaaaaaaattgggaccagagcgaaactaattatcggagaaattta

SEQ ID NO: 529207 - DNA, 373 bp, Homo sapiens
ttataacctgcagaatgcaaactgtagtgcgatggagacaataaactaaactgaaggttcatgagcaagatctgacacgccgtgacgatcgactatgaaagggtttgccaggagaggactgtgactgaccaggatatcacgcggttccggaactctctgaaagagctgcagctgcagaagcagaaggtggaaggggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggc

SEQ ID NO: 529208 - DNA, 124 bp, Homo sapiens
aagcagttatacagactcaatgaagcagagtgatgcatgacatggaggaagacgatgatcagaaagctgtgaagggatgaacggtaatacgcaaagccagacccgggcgctgccgagacccctc

SEQ ID NO: 529209 - DNA, 293 bp, Homo sapiens
  misc_feature (32)..(32): n is a, c, g, or t
  misc_feature (59)..(59): n is a, c, g, or t
cgaacagacagactacaccttatccatccacntcccttggaggctgccccgttacggcngccaaatggccattatcgagattcacaaaaacatagcctcatcatccccaccatcatgccacatcacctccttaactctattctactagcctatctatccactcaatcacatatccccatatctaacacgtaaaataaatgacagtttgaacatacaaacccaccccattcctccccacatcatcgccttaccacgctactcctactatctcccttttatactaataatcttgt

SEQ ID NO: 529210 - DNA, 269 bp, Homo sapiens
  misc_feature (4)..(4): n is a, c, g, or t
  misc_feature (8)..(8): n is a, c, g, or t
  misc_feature (42)..(42): n is a, c, g, or t
  misc_feature (86)..(86): n is a, c, g, or t
  misc_feature (204)..(204): n is a, c, g, or t
  misc_feature (219)..(219): n is a, c, g, or t
cggnggcnacctacgtcctgatcgacatggttctcaacaagntggccaaaggtgctaaagagattgatatcgcagcgaccctggancacttgagggaccagagacccggcatggtccagacgaaggagcagtttgagttcgcgctgacagccgtggtgagcgaggtgaacgccatcctcaaggcccttccccagtgagcggcanacctcagtgaggccnccggacacaaggcacgtttggcatttctctttgagagagtttatcattgg

SEQ ID NO: 529211 - DNA, 518 bp, Homo sapiens
agcgggttggtcgtcgtcctggatgctggcgagatagatgttatcttccagaggaagaggaggaggcggcgaagcgtttcccagcctcagtctctctttcgttttccttttcccttcccccaacctccgccttctctaaatcagcggcttccttgactcagtgacccgtctggcccgccaccctcgtgagtagatatcccgccgtgaggtaaagcgacggtggaaacctagagccccgcggaagagcagaacggtattgggagtgtgcagctccctgggcccggatcaggccccgatcgcacggagagcacaggcgccaggggagcgctcagcgagtgggagtactccggaaccctgccaccacgtcgactcgcgacgtacacttccacggacatatggaccataccagtacatccacccgacgcgggattcggggactactgggcacacagcaggagtggcacagccaaccgggaaccactccataggtcgaccggcgggcgacgcctcccgccacg

SEQ ID NO: 529212 - DNA, 175 bp, Homo sapiens
ccttcgtgctgatctgactttatccctaagggcagtggggagaacctattgaagggttttaaggtggggaataacttgggaaatgcagtttaagaagctctgcaagtgaattcacctacttctgtggcttccaaagtgacttttatatagctacaattctgtgtgtgtgtgtttt

SEQ ID NO: 529213 - DNA, 339 bp, Homo sapiens
agctgttatcttagtgcagcaaagcccttagaaggtataaccaggcacccataggctgtgaaagtaccttagaggagtgtgcttagagtagagtgatggcagaggagaaaggcaatcagaagtgtttggaaagctcaggaggctgaggcaggagagaattgcttgcacctgggaggtggaggttgcagtgagctgacatcaagcccctgcactccaacctgggtaagagagtgagactccatctaaaaaaaaaagcttggaaagttacagcggtaagatctgctaaaggatttgatgagatgggtatgagataaagaagatttaaaattgtcttctaga

SEQ ID NO: 529214 - DNA, 795 bp, Homo sapiens
ggggaatacatgtggaggtcagagtggtagtaggtgtgagatgggtcagcagaagtgaaacatggctgtcatagtgtttgatgtcattgtcaatgtttgggctgttcttagttgttgcaggaggcgtggtgaactctgccttactataatgtggatgctgcgaacatagtatgtccatctttgacctgatccgtgcgcatgtgcaggacgacttgtaggtagtgggcagggactcattttctcatcccgtgggtttctgaaatcaattattttatgactgccgttctcgatccacgtaatgtgccagtcatctacgtggtagcaaacgatttacgagaatgtcaacatcagcactgcgcatcctcttccggtcctgtcgccagccagcttcctcgcgtcttcaccagacatcggagaggactatgatgagcgtgtgcttgcgtccatcacaactgagatcctcaagtccgtggtggctcgctttgatgctggagaactaatcacccagagagagctggtctccaggcaggtgagcgacggagcttacatgagcgagccggccagctttgggctcatcctggatgacgtgtccttgtacacatctgaccttcgggaacggagttcacagaagcggtggaagccaaacaggtggctcagcaggaacgcgagagggccagattgtgtggtggcaaaggctgagcaacagacaaccaggcggccatcattctctgctgagggcgactccaatgcagcctgagctgattggccaactcactggccactgcaaggggatgg

SEQ ID NO: 529215 - DNA, 948 bp, Homo sapiens
gctgagattgctggaactataggtgtgtgtcaccatgccggcctaatgcaatccagttgatgtgtaaagatgaggtctcactatgttgcccaggctggtctcacagatcctgggggcgtcatagtgatcttcaacagtctcataactcccgaaagtattagagctctgcgaggtgtggagccgatcgctgcacacctacctggatttaagataagtgctcgttcttagaataactaggtgtgatcaagtttgtcatccaaggtgatatgacttcaaatagctcacaactcttataggagcattgtttgcagaatgccaagtgattttagtggtagtgcaaaaaaggcaacgtctgtaacatatgtgtattatatgtatacataggtgtcgcagtttcaatgattcttattctctaaaaaagcagcagtgaggtctccactgtgtttgtgccaggctccgtcttggacactcctagggctcaagcactccttcgacctcaaactctcccaaagtgctggggatgaccaggtcgtgagccacatgccgtggcttatggcgatatgcaagagagattggttctgagccacatgtgaatggcatgacccatgaacaactcaggaggtcctgagatcatgtgaccaggtggtttgggtgatagcttgaattttactaccttctgagggtggccgcagtgcgggcaacgcgcactaccatttgggtgtgcctgtgttgggccggaagaggggactcccaggtgaacagtacacgtccatgggcagaaacaatctcggaggactgggggagacggggaaaaaccgtacaccggacacacggggcgggaaaaacccggcacaaagctcaagaagaatataaggccaagcgaacagacctcaagaagagaaacaccacaagagcaagaggacggcagcgcaaaagcgaggccaccaa

SEQ ID NO: 529216 - DNA, 913 bp, Homo sapiens
aaggaggagcagccgccagtgccctcgtcgcccacagaggaggaggaggaggaggaggaggaggaagaagaggctgaagaagaggaggaggaggaggattcctgaggtgcagtggggatgctgcccaaggatggccccacctgccactgtcaccccctgcagcctggccagccgctgctgagtgaagacaataatgcctgacctacgactgagcagactgcagtgccttcatctgaatgctgcccgaggaggccctgcaacagagttcggaggagtgccgagctggtctgcttgaagtgacgatggagcgagtcccatcatgtgaaccttggatgcaaggacgattctctcttttgcacttttggccgccaaactgggagagtactgacttacgctgtagcagaccagatgcatacgatgcatcactcacacaactgaactactgatctacacgcgctcgtgccaccatatcaatgctatgtcgtcagcatgacaacccgaaactcgagggagcatcatccgcacacagcaccttgcgcagccatggggactcactggacttggcgccctgaccacagacagagtaacagatgccattgcaacgtatgcaggccatagacaccgggactgcttggctagaggcccctaaaacgcatacgaccaagcgctagcgcgtccatgtgacggcgaaagacgaccatcggtgatcatgcaaccaacagaggccgagacgactgagaaggtaccatcatgcacgcttgatgacgacccagccggactggcccgggaagccaaccgccatgaagcacaccagcggaagacgaatcaatgacgagactctaacatcgataggacgcagcagacctccagcaaggcatgaaagccagccacagagaggccgaacaccgcacct

SEQ ID NO: 529217 - DNA, 310 bp, Homo sapiens
actctagaggttaacgctgatccgcttaagggcgggcggtatgagagtcaggcccagtgctgtggctcccacctctaatcccagcactttgggaggcagggcagaaagatcacttgagctggtctcaaactcctgggctcaagtgatcctcctgcctcggcctcccaaagtcttgggattacaggtttgagccaccatgctcaactggaatcttttaatgtaagaccttttatatatatatatatttatatttatatttaaagagatggggtctcactatgttgcctaggttgtagtgcagttgctattc

SEQ ID NO: 529218 - DNA, 110 bp, Homo sapiens
tggagatgtattgagagcagggtgaattgtggttacgggcactgtaactgtgcagttacatgatagtgaagatgggacgtgacacagtggtcacgtctgcagtcccagta

SEQ ID NO: 529219 - DNA, 590 bp, Homo sapiens
gatcacctggggtcaggagttcgagaccagcctggccaacatatagacaacatatatgttacaacatatataatggccaacatataatacaaaaattagctatgcatggtggtgggcgcctgtaatcccagctactcaggaggctgaggcaggaaaattgcttgaatccgggaggcagaggttgcagtgagccaaaatggcaccactgcactccagcctgggtgacaaagtgagactctgcctcaaaaaaaaaaagaaagaaaaaggctgggtgcggtggcttatgcctgtaatcccagcacttggggaggccaaggcaggcggatcacgaggtcaggagattgagaccatcctggctaacacggtgaagccccgtctctactaaaaatacaaaaaattagctgggtgcggtggtgggcgcctgtggtcccagctactcaggaggctgaggcaggagaatgggcgtgaacctgggaggcggagctggcagtgagccgagatcgcgccactgcactccagcctgggcgacagagcgagactccgtctaggaaacaaagaccgcaacgaaagaacaaaacacaaaaaggggg

SEQ ID NO: 529220 - DNA, 456 bp, Homo sapiens
  misc_feature (34)..(34): n is a, c, g, or t
  misc_feature (37)..(38): n is a, c, g, or t
  misc_feature (282)..(282): n is a, c, g, or t
  misc_feature (372)..(372): n is a, c, g, or t
tgaagcgctcaaagaccaaggtttggttatgaangcnnaggcggctccgtttattgtatattggcattgtcggtgatactgggcgtttcatgtacagtatggatcaagaaactttccgcgtggtatcagaattatttggttatgatttcgactacgaagctgttttgcaccatatgtcaacatttcggaaaatgctgctaaattgtcgggttatgtgctgcaaaacctcacgattttaccatcaggatttgcctatgtggtcttaaccaaagcactcttggnacaatttgatctgcaagattcaggcacggcgtttgttgtgccattgccggcgacaatcgacaaggttaaggcatgggcgatttttgagancaagatgaaggcattatcgtgtgcggctccgtcacggcgattgtcattaacaaattgcgaccaatttagggtggggcatccaat

SEQ ID NO: 529221 - DNA, 453 bp, Homo sapiens
  misc_feature (224)..(224): n is a, c, g, or t
  misc_feature (243)..(244): n is a, c, g, or t
  misc_feature (254)..(254): n is a, c, g, or t
  misc_feature (256)..(257): n is a, c, g, or t
  misc_feature (272)..(272): n is a, c, g, or t
  misc_feature (292)..(293): n is a, c, g, or t
gatggtatagcgatgagtagatttatgcaagttttccccaaatgttaaggcattaaatggacagattaatggtaggttgtatgtttcatcaagctgagcagttctttgtgttagatttgaatgccctggcctttttaaaacagctttattggagtaatattttcatccataatattcaccaattgtgttgctatctactgaaaatgtacaatttaatacttttntgtggaaatttcatagganngcagttaccnanntcatcactgtaaccntcaattttaggatattttcnnatcacctcaaaaagaattcctataagccattttgcagacagtctgcacttccagcccaaggcaaccactgatctgctttcattctctacacatttgccctttctggatatttcatataaataaaatcatacagtgtgtgtttgtgtgtattagtttacca

SEQ ID NO: 529222 - DNA, 258 bp, Homo sapiens
aaatagtatcactgtctgtggcaaagggtacactagtgaatgatattaatcagcctccctgtaattgtagctttccagataagctcagttgattggaaagtggtactattttcttctaacaactccccgacttaataggactttaaaagtagcaaagctgttctttgggataagtgttttcttctgggtgctattgtctggtttaatagaattcaaagcctgcctaagctgtctggaaagcaaacttcaagcactgga

SEQ ID NO: 529223 - DNA, 762 bp, Homo sapiens
  misc_feature (3)..(3): n is a, c, g, or t
  misc_feature (103)..(103): n is a, c, g, or t
  misc_feature (127)..(127): n is a, c, g, or t
  misc_feature (192)..(192): n is a, c, g, or t
  misc_feature (201)..(201): n is a, c, g, or t
  misc_feature (215)..(215): n is a, c, g, or t
  misc_feature (219)..(219): n is a, c, g, or t
  misc_feature (233)..(233): n is a, c, g, or t
  misc_feature (249)..(249): n is a, c, g, or t
  misc_feature (318)..(318): n is a, c, g, or t
  misc_feature (320)..(320): n is a, c, g, or t
  misc_feature (347)..(347): n is a, c, g, or t
  misc_feature (364)..(364): n is a, c, g, or t
  misc_feature (374)..(374): n is a, c, g, or t
  misc_feature (381)..(381): n is a, c, g, or t
  misc_feature (383)..(383): n is a, c, g, or t
  misc_feature (387)..(387): n is a, c, g, or t
  misc_feature (392)..(392): n is a, c, g, or t
  misc_feature (411)..(411): n is a, c, g, or t
  misc_feature (413)..(413): n is a, c, g, or t
  misc_feature (419)..(419): n is a, c, g, or t
  misc_feature (421)..(421): n is a, c, g, or t
  misc_feature (444)..(444): n is a, c, g, or t
  misc_feature (449)..(449): n is a, c, g, or t
  misc_feature (455)..(456): n is a, c, g, or t
  misc_feature (458)..(458): n is a, c, g, or t
  misc_feature (477)..(477): n is a, c, g, or t
  misc_feature (490)..(490): n is a, c, g, or t
  misc_feature (521)..(521): n is a, c, g, or t
  misc_feature (524)..(524): n is a, c, g, or t
  misc_feature (529)..(529): n is a, c, g, or t
  misc_feature (540)..(540): n is a, c, g, or t
  misc_feature (544)..(544): n is a, c, g, or t
  misc_feature (549)..(549): n is a, c, g, or t
  misc_feature (565)..(565): n is a, c, g, or t
  misc_feature (627)..(627): n is a, c, g, or t
  misc_feature (661)..(661): n is a, c, g, or t
  misc_feature (674)..(674): n is a, c, g, or t
  misc_feature (684)..(684): n is a, c, g, or t
  misc_feature (694)..(694): n is a, c, g, or t
  misc_feature (755)..(755): n is a, c, g, or t
gtngtgggctcagggcagaaatttttggggcactgagacataggactgctcccaagtgtgttccagttactgctgggtttggaggggctctttaaaggtcccnagattcaaatgttcttgtagcagntgaagagctcttggctggacggatggttccagtgggggcctcctccttccccactcagttctttncttccccgnggcgcactgggcgnaggnagtggccagctgcngcgcctcctgcaggcngccaacgttcttgcctgtggcctgtgcagacacatccttgccaccaccttttccgtccatcaagcctgncncctgctgcacccactcgctggcttttnagccccgattggctgcnttctgggggncttgacncnggcncgtgntcttgccagcctcattgtncnccgtgnanagcatggcagatgtctgaggggngtgcntcttgnngngcttcaaggcttcattcanggccttggctgangcgccgctctccatctccaggatgacaagangcnagttngggttgctgtngaanaaatncttcgtcttctctaanactcgtttctggacatcggctttgctggctcggtccaagtcatccatgaccttctttagggntttgagagtctcccgcaattcatccttctgccantgggggatgactncagtggccanggcctctccnaagtcagcgatctccctctgcacatccttgtttggagcagtctgagcttcactttggcttncatgaca

SEQ ID NO: 529224 - DNA, 883 bp, Homo sapiens
gattaaacggttgcaggcgtagcagagtggtcgatgtctttctaggtctcagacggtcgtcgacgatcgttcagcacgctcgtctctgaggctcctgaatgcgcgaaacctagctagactttctctctcttcccggctgccgtgtagacggacgttgtagccactccgacaacatgttcgaggcgccgccggggtccagggctccaatccgtcaagaaggatgtaggaggcaggtcaaggacctcgagtcatacgtaggcctgctgggatattatgcttccaggcggatgtaaaccttgcaagagcaatggacttcgtcccgacgtctctttggtgcatgctcaccctgaggtctgagggctgcgacaatcctacactgatgcgatcggcaaccctggccaatggactgtgaaccgtcaccagtatgtcctacagatacgtaaagatgcggcgcaggagacaggaaagatatcagttagcacgtaaagggccgaagataatcgcggatacacttggacgctagtatttgaaagctaccaaaacctagggagaaatgttacagagctgagtgaaatgaagtaggagtggactttacgatgttgagacaaacttggaatattcagagacaggagtacaggcatgaggtagctacaagaatgcgcgttcctggttgcacatggcggctaccgtgaatattgaccgaggactcatcaaggactactactgggcacagaacggctgggcaggtcaatacccgtggggcgcagcaccacagggaagggaaaaatggacggggcacgtggcacgacacgaagggaacatgggcagacatgtagaaagtggtaacacaagaactgggacaggagtagaataacgggaggag

SEQ ID NO: 529225 - DNA, 791 bp, Homo sapiens
  misc_feature (89)..(89): n is a, c, g, or t
tggggaccccgaaaattctgcacattatagggcggggcatctgaccgcgtgctctctaacgggggagagggggaacagtacggctctcnctccaaacaacagagcgcacccacgacgcgagtgagatattacctcgccggcgaacgtcatatgcagcgcgcacacctctccctccacatcctaaaccgagggagcaagacagagcaagaaggaagaaaccacaacgaaaccaaaatacggcccatatgtcgcggtggtggtggggtgtgttggtgtggtttcaggggtcacaaaatgacgctgtaaaagaaatgtagggggtaggaagttggagagacagtctggttgtatttatatttttttatataacggaagattgtttaaagagatgttagggttgggagtgattgttaggagaattatacacaataataaaaagtttaacaacgtgagggcgaagaaggaggaggtaacgaagggctagacacctcgatacatccacgattgtcagtatggccgagcgagggcgtgtgtgtagcatagttatgttcgatgtgctaggccaccacactctattcgtcagatgcacatgatcagtgttacggtcggggactgagtcgagtcaacctgtcaggccggttagcgcgtagaacggtgaggagtagatagacggagagtattgatatgtccccgacatttagaaccgggatgcgaatccatggagggcactgtaaggagggaagagaggacgatatacgagtaagaatcagagtatagaggaaatgattggt

SEQ ID NO: 529226 - DNA, 1111 bp, Homo sapiens
ttgggggggggcgtctcaccgagaaggcccccctacatagtgttaatgaagtcgttgctgccgggtattgcgcgctttctcgctaaagagggttctccccgcggcgggtgatcgtcctcactacagagggggcggttgtccgcaccgacagtggattgtgtctccacaggggttgtgtagtgccccacaataaacgagaaaggcgccggctttgagagaatttgtgtcgcgcgcggtttaaatagacttgatcagcggtgttctataatacctgtacaaacaaaatggcgtgtttcccccctcgcgggttcacaccttagggtctctttctagagggggcccaccgcttatgtgatatggcgccacttttggttgcatactgtgtgggtcccgctgccctcggggttgggggagaagtagaaagaacacactttgccgagtagtttgtccccgttacatactcgttggagacatgggtggcccacataagaagacaccacgcgggttatataaggtgttgtagaacgataacacacgaatatgtctctttggagaatttttagacccgctgttttttttgtttggtgcacaaagacactcgagagcacacttcctctcctcgcctcgaaagggtgttcttatagtcgtaatgtcccccgaggtggactcggtcccttcctaactctctataaggtcactctatacctctttataaggtgggatattatatgagaaggccacgcgtgtattcaaaagggagtaatgtagcccacgctgtggggtgaaaactcacacaagtataaaaaaggtgacaaagagatttgctttgggaataaactggtggttcttcttagagggatattttagagagtccacacgttggagggcttcttttcccccctcccacatgagagcttcttggtattcacgaggctcccagaattagacctcgggcttaccaaacactaggggaccaaggtagggaaaacctgataacaagagcttgtgacagagaattggacaattggggaaaggcccttttatgccttatgggtagctttttacccggtaccctttttacacgtggtaaattaaaggaacgtgttgtcca

SEQ ID NO: 529227 - DNA, 878 bp, Homo sapiens
taacccctctttagcttaatgcgctcaaaaaccaatttaaaccccccccccttttaacagggggggcaggtgacaaaaggcaaagaacgcacagaagccagccttggaggaccaccaggttcctgtgccccccgccatttaattcgccctgtgattgggattttggtttatcattcttgctcccgtgtggctggggtgagattgtagaggggggagacgccttctctgggggggcgcatctgggccatctggagccccctcttggagaagacagtgtcacacagaggggagattggggaagacaggcgccatctgtgtccggggctcgaggtctttctggggggaccatgtggctttggtgtccccacagagatatgttctctgagaggggcgcgggacgggggcgggtgtctgggcgacagggggtctcccctctcacaagagttttgtacagaggagagggagtgcgctccagagagggcgccaaaagagaaagggggagagcccccactagaggctgggcctcaaagaagagatgggcccccagacagggggagacaggcgggacataaaccagtgtgtgtgttgttacaaacaagagggggtcacacaaacaaggaagccagggaggacgacaatgtgtgggcgacgtggcaattctcgcgcgcaaccacgtttgagagagagaaacgacctttcaccactattatcacccttaggaggagaaacattctttgtgcccccgagccccacttataaagacaccccgtgagacactttgtgtcttctccagagagaagttgctctcaagaaaagcacttgtgaggagaacaccctgcttggagaggagcccaataaggagtgggaataaaaggcag

SEQ ID NO: 529228 - DNA, 463 bp, Homo sapiens
atgagagcccagaggtaacagacaggctccgggttatcgaaataccaatgttaaggaacttctttctcagtcatgcataaatatgcagtgatagggcagaagcccccagagcagatgcagagacccattttgtgaatggattggattatttaataccattcccttactgtggaggaaggattgtaaaaaaaagccctttgagccagtttttaagctttttaatggttgtttctttcaaggggtcttggtaagagggaaaaagcatcccttctttgaaaatgttaaatttgtaagtttcaggggacagggggaccccttttttaagatttttctcaaagttttgaaaagctattagccgggatcagggggtaataagacaaaacgttttccctttaaaaaaatttaagggggggggtagagttaaaaagctgttgtccatttatgatttaataaaatattttta

SEQ ID NO: 529229 - DNA, 289 bp, Homo sapiens
  misc_feature (249)..(249): n is a, c, g, or t
ccgaggattccaagcttagcgaggatctggctgtgcgttagagactggaaactgtgtttaaagaatggataagcaaaagaacttcagccaagagaagctgcatagatacacataatgcctgctctgcatttactaatttgttcagtttaaatagtaaactttttactcctgtggaaattttgccaaacgtttcaatacactatagattactatatcttaaaactaacactgcacagagaaagacaaagnctacttctttttttttttttgggaattccaagtttctcct

SEQ ID NO: 529230 - DNA, 176 bp, Homo sapiens
gcgtgccgcttgacttctgctggtcgtctcttcgacggtctcccgcccggtctgtgggtcgaccgcgggacgactgggtgcctcgctcgtccgtcggctgggccgcctccgggctgctgctccttgtgcgggggtgtgctttgctgcgctgtcccccccggggtctcgcgctctcc

SEQ ID NO: 529231 - DNA, 789 bp, Homo sapiens
gcgcgcctgaatcccggtcccgaaggccgttgagaggactaccaaaagaagtgggcgccacaacccccgcggcggcaataaataacccgagaagcgtggaagcccctcccccagaagaatggtgttgcgcgaaagaaatcttgagcgaggtttacagagaggtgtcctaggcgccgcaaaagggcggaggaactcccccccgtacatagggccctgttgtgtctccccccaggtcccccgcaccagtgaaggtcccgggggaacaatatccgggccaaaaaagggcccacccaagctatccccgggaaatatattatgtgtggtctgtagagaaacccaagaggcgacgtcgcttctttctctaattgcagcgcaccatttctctggcggtacactccccctgaagaacgaggatatttcttttctccagcaagcaagtctgcttctgaggctcctgttgttgtaaaagcccccacacacatgtaggcgacgaccacaacttctaaaccatcgggagtattcaaaaaccaaaagagcgagcacaacatctgctaggacactctacggggtaatacatcacaagagtatgcggcaggaaaatgatcggatagaagatcaatacatgatccaaccgccccccccgtgacaggcgccccagtggtcccccgccgccggtaaataaggccccttctttccaaaaagcaaaacaaaaaggggcaacacgagaagatggaaacaaagcccacttctgtttccccttttcattttctacccagggcccacataaca

SEQ ID NO: 529232 - DNA, 288 bp, Homo sapiens
cgcacgtatgtgtcaggcggctgtgatgcctctatcaagctgcgggaagtgcgggattccatgtgccgaccgaccttcatcgggcatgaatccgacatcaatgcagtggctttcttccccaacggctacgccttcaccaccggctctaacgacgccacgtgccggctctttaacctgcgggccgatcaggagctcctcatgtactcccatgacaaaatcatctgtgacatcacctctgttgccttctcgcgcagggaacggatgctgctcgctggcctacagcaaatg

SEQ ID NO: 529233 - DNA, 131 bp, Homo sapiens
aggaaggagttaattaaaatgattttattttggtctgaaggatgtttttttaaaggaaaattttttttttgaaccctcagcccacttttttgagggccggaaaagggcttgtaaatcttttttttttttta

SEQ ID NO: 529234 - DNA, 433 bp, Homo sapiens
cttgtaaagctagagaacgttgcctgtgggggattgagatgcaggattttttcaaccctctccttggggactcaagaggcctcgggcatttttttttgcaagggcccctgaatgggtttgggttccggttagcaaaatgtgagggggtggaaagacggccccccccggggtccccggtgaccccggtccccacattgacctgggttccctccccgattttttttcctgttccaaaaggggggggggggaggttcccatttttgtttcaaattcagggggcactggggggccccttctttacttccctaaagaggttaagaccctgaaaataaatttgggttttcaaatttttggtatgaggggttggggggttaattaaataggtcaattcctagaggttgggggggcaaataaagccctgggacccttccca

SEQ ID NO: 529235 - DNA, 105 bp, Homo sapiens
gctagaggacccgacttaagtctacgtctgatcgacactcgtgagcgtcggtccccacaccttctataccaccagtgagtcctaggttctggatggacactcttg

SEQ ID NO: 529236 - DNA, 287 bp, Homo sapiens
  misc_feature (124)..(124): n is a, c, g, or t
  misc_feature (143)..(143): n is a, c, g, or t
  misc_feature (212)..(212): n is a, c, g, or t
  misc_feature (265)..(265): n is a, c, g, or t
gaattttacagaccgggagcggtgactcatgcctgtagtctcagcactgtgggaggctgaggcaggaggatcgcttgagaccaggagtttgagaccggcctgggcaacatggcaagagcccgtntctataagaagtgaaaganttggctgagtgtggtggctggcacctgtagtcccagctactcggcggggtggggcagaaagatcgcttnggccagggaatttgaggctgcggtgagccatgatcgcattactctctaccctncagcctgggtaacagagcacgg

SEQ ID NO: 529237 - DNA, 625 bp, Homo sapiens
agttaactttaaaacaatgtcaggcaggtccttcaggaagtattccagaagaaggcattgttaccacaggagtgatagctctatgagtgtcactgcccccaaagaccctccagggggacaaaacgtggaggtggaaacaatgatactgatgatcctgaccctggttaggcctagcctaatgtgcgtgtccgtttttaacaaaaaagcttaaaaagtaaaataaaaaaatttaaaaatagaaaaaagctatagaataaagataataaaaagcatttttgtacatctatcaaatgcgtttgttttgagctaagtgttattacaaaagaatcaaaaattaaaaaaataaaagtttataaagtaaaagttataataaggtaagattaatttattttgaagaaagaactattgtttaaataaaattagtgtagcctaagtgtacagtgtttataaagtctacagtagtgcacaataattctagaccttcacattcacttatggttactcactcactcgcccagagccatttccaggctccattcatagtgcccctagacgggtgacccattttttttctgtttccctcaccttattttttctggacttttttttgttagaaacaaaaaac

SEQ ID NO: 529238 - DNA, 1618 bp, Homo sapiens
tattaatgagtccccggaaaaaagtggttgctttcctataatatgaccatactggaacgcctggcagtctggttccccgtttaagaattaagaatatgtattttgagaaaatatgtcaacaaaaaaatggtaacacattctgtgaaaggatcaccttctggtggacactatgtaattctcttaacacgctgggtgtggcccttttctcaagtgtgtgttccttttattttaaacgcttggcgtattattattttaatctttaaaatattggattttcactggaaatattcaatataacttcacacctgtgtgtacatggaacatgtgtgtgtgttttaaagaactcaagaggggaaactcgttgtgagagacacacgagaagacacccgagaaagagagagttaaacaccctttttctatgacacgagggggctgccagacacaacaataactcagagcccacatatctctgtggcctaaatattctcaaacaaacactaacccgagtggtctctttatagtgtgggggtgcagaacaccctgtgagatctcccagaagtggccagtggagtgtgcccccctatgtgggggaccatcacccgtgtgaagggcagtgtggtgggtggaccccccatatattatgtgcaattttcctttaatcagggaagatggggttccaagacaatgggcgccacacactgtgttttcacccaaaaatgtgtgtgcgccacactttaactattggggaactcatattacacgcgtgttccatctcatataaagcggggggcactacagtgagtgtgtctatattcacaaacacaacaacaccccgaggggaccctgttaaggagaccacaaatttggggccccctgtaaggtggctccacacccttgtgggagagccccccgttcacaacttaatacttctgtggggccccgtggggagccatacaacttaggggggacgagtgtgggagcagaggacccacttatgcggttgtatttacacggagaacaacaaaaacgcagtttgtactacgtggtatagcgaggtttcggcttcataacaccgacttatcaaacaagtcgcgcgttttataaaccactctcacacaaaacagaaacacacaaaacgaatcaaacagacgaccaaccacaacaacaccaaaggggggggggggccgactcactcaaaaaagaaattaccacccaacgaagggaagggagccaccaccaccatcttaatcccagatccacccaccggtagtttgtttggtaacacaaaggggggccccccccactacagagggcgggcacgcatattactataaccacatagcgaacagagcgccgccccccgtactcaccaacgcgcccctgtccgcgtgggacaaccaaaccaccaacctatgagaaggcaaatattgacaggcgcgaccaccacaccaaccgggagcggcgcaccacactaagcggccacaaccccaccacaacagagtaagatacaccgagtgcgacaaaaaaactacgaggaaatcgatgaaacacccaacgacattggctgctcgtagaaagtagcgcagaaaagcaacacacagcaacgcacaaggacagc

SEQ ID NO: 529239 - DNA, 1081 bp, Homo sapiens
tatgatctatttgggacccaaaaaatgttgcattcaatttaacaaatatggcagatttttcagtaactaacgtcttaacggtcttctaaaaggaagctggttacccttctgtcttgtaacttaccacttacattgacaactgtggttttaacgagatacaactttcaggcactagtttctagtagtacttaacttgacattacattgaacactgtcgttcttacacgacgactaccaactcttcatgcactacttttactactacttaaaaaaccaaacaaacggacttacggtacttgacagccagttgggcccaaaagggtacactacttacctacccatgttagaactgttatagttcaaatttgtcccacttcacccagaattttagaaactagaagtctgggaggtactatatcagctgtagttgggtaattccaagtgctgatagtactattcatctttttcattatggtgtcagatgaaacaaatgccaaagttgcaaaatatgcagatttttattatataatggtatcaggcataaattattaacaagccatgccttatgtgttacatcttatattttactttcagaactaaactataacagattctcggacaatgactctgacttgcttgctcacttgattgacttgggtccgcatactctgaatgatggtattacctagattctaattccttggatacctagattatcatcactacataactattagcactttgcaccacttatggtaggagcacttaactggtacactctacatgtccgtaccctcacatacaatgaccacacttacacactatgaactgcgcacgcaggaatcgagaaataaagagatacagcaccacagcagagcagcgaacaagagcacaacgaattaacatgcccccaacaaggacatcaaatacacgaacagcgacacgtagagcggcgaaccgcagcactgtggaaccagcatacagagacaagcgcagagcaaacagacaaagcggaacaagacacaacgcacaggaaagaacacacacaacacaagtgagccacacctccggaccaacaaac

SEQ ID NO: 529240 - DNA, 193 bp, Homo sapiens
cctgttgtacgatcacgattctgagactatggtcgttacctatcaagggttgccgtagcatgtcccagactctgctcgtaatcaggaggctatcagctgtacttaagacgccagcttatgcgccgaataataggtgtagtgttccaatgtcttgactggtagaaccctagcgtcaacggtcggcgaacatcag

SEQ ID NO: 529241 - DNA, 238 bp, Homo sapiens
gggggggtttttttcccccccccccgggggggggtttggggggggccccccccccccccgggtttttccccccaagggggggggggggttttttttcccctcccccccccttttctttttttggggggggttttttccccccctttttgggggggttttttttccccccttttgggggggggttttttttttttggccccccccccttccctttaaaaaggggggggggggggcccca

SEQ ID NO: 529242 - DNA, 908 bp, Homo sapiens
  misc_feature (100)..(100): n is a, c, g, or t
  misc_feature (121)..(121): n is a, c, g, or t
  misc_feature (422)..(422): n is a, c, g, or t
  misc_feature (452)..(452): n is a, c, g, or t
cccaggacagacccagccgcatgccagtcgagtgagggaaaagtcacaagaaatgttctctccagaacccttttctcgggaaggaggaagttcaccaaanggagcagggaagagagtcttntgggattcaggaagcaagggtgtctcaacagcagggcgctagggagggtctcgggggcaagaggctgggtacatttgctcgcatagcgtggcccagagaggcagctgatgaggcagtgaggtcccgggaggccaggggtggtccagggccagggtcagagctgtgggctgacacagccagggcctccctgtctgctagcctccatgcttggccacgggaaggggaggtgggtgggcggcgaagaccacgcacacaggccacctgggatccaggtagggagggggcagtaggttccttgggngggctctgatcagctgggaggacaccgtgnaaggcacggtgtggaaccagaggatctggaccctgttggctcgaggtcctgcagccacggaaggagggggatgtgtctcagcgacactggaacctcagagggccgagtgtgagagcccttgggatggacctcagaggtctgagtataggagcctctgggacagaccaactcagggagtggaggcccacgctctggctgggaaatgacaggtggaggtgagggacccctggggcggtggacagtttggagaccaagtgcagagctgctcctggcagctcagagcctggggcagaggagggtgatgtcccaggaaggaagctccacgcaggcctgtagagcacagcagggtctggctcctgtgggcagggtgggacctggtctccctagacgctggaccagccctgcctcctcccggtgcccatcatcctgcaggctggacctgggccctgccttttg

SEQ ID NO: 529243 - DNA, 445 bp, Homo sapiens
cacattgcccagaggaagtgctggtgccggtccagtaccacggcaactcggtccacgacaaaaaggtcatgaacgccggcagctcatcgccggacgcctggcgcatcaggtacattcccatggcataaccgcccagcgcaaagaaccagtccgtgcccgagggacaacatcccggcataaccccacaccaggtccaagcccagggcgacgatggcgtagcacagaatcttgcccaccaacgtcagggtataggcggaaacgtgcagcggattttccggtgacaacagcgagaacaacgcagcgccagcagcaggatcagcaccactgcaccgaccgcgacggtcaccttggggcggccttttgcgcggccgtaagcatcaatggctggttcatcagtcgatcacccgtcctttcagtgcgaagagtcttgcggcgtttctggatg

SEQ ID NO: 529244 - DNA, 305 bp, Homo sapiens
accgcccacgtctacgcccgtcccacctccaaggatctatccttcattacagagtggtgtttccacatgtctttcatctgcataaacttcaggtcccttctcccgttcctctattaaacttctatttatcctttaaaagctaagtaagacatcctctcctgcaggaagttttctctgataccctcctactcaccgtcagattccccatcctttatatggtgtccaaatagtcattgtttcaaaaaaacatttaaaagataggaagtttctcttcatctcaatgcagtgaggtgggaggagaggaa

SEQ ID NO: 529245 - DNA, 180 bp, Homo sapiens
catacctaggctggaacgcgtgctatgatcttggctaactgcacctcagcctcccaggttcacgccattctcctgtctcagcctcccgagtcgctgggactacaggcgcccgccactgtgcctggctaatttttttttttttttttttgggttattttaaagtataaagacagggtttaa

SEQ ID NO: 529246 - DNA, 690 bp, Homo sapiens
agcgtggggggtgagcgaagcttgtccggttcggcaatggacggaatcgtcactgaggttgcagttggcgtgaagagaggatctgacgaactactctcaggcagtgttctcagtagtccgaagtctaatatgagcagcatggtagtggagggggggagggtaatgatagtaagaaaatttaaaggagaagataaaatggcatggtgctccttctcggtgtacttcatattcgaaaattacctggggaagtaacagaaactgaagttattgtttaggcttacgcgttttggtaaggtgaccaacatccttatgctgaaaggaaaagactcaggcatttccggaactagacaaccgaggaagcgagctattactatggttaattactattctgcgtgtgacacctcatcgttcggtaaccaaccaatatatatccagtactcgaatcgacaaagaactacgagacagatcaatacattaaagcaacgtgctcaggcaggtcttccaaggctgtgacagctgtccagacagcaaatactcctcttagtggcaccacagttgagcgagagtgcagtgactccagcccagagtccagtacttagaataattattgaccacatgtactaaccctgtaacacttgattgtacttcaccaaaatatcttcctaaaggttggtgctgtattcgacggat

SEQ ID NO: 529247 - DNA, 590 bp, Homo sapiens
  misc_feature (41)..(41): n is a, c, g, or t
  misc_feature (199)..(199): n is a, c, g, or t
  misc_feature (301)..(301): n is a, c, g, or t
  misc_feature (379)..(379): n is a, c, g, or t
  misc_feature (388)..(388): n is a, c, g, or t
  misc_feature (415)..(415): n is a, c, g, or t
  misc_feature (473)..(473): n is a, c, g, or t
  misc_feature (477)..(477): n is a, c, g, or t
  misc_feature (486)..(486): n is a, c, g, or t
  misc_feature (513)..(513): n is a, c, g, or t
  misc_feature (531)..(531): n is a, c, g, or t
  misc_feature (551)..(551): n is a, c, g, or t
  misc_feature (571)..(571): n is a, c, g, or t
  misc_feature (583)..(583): n is a, c, g, or t
gaattcggcacgagaacttatcatatgcaaaagcttaggtnatttgcatcatcttctggcccggaggctgtaaacattttaagaccttttcttcagaaaacttatttttctctaaaggtggttggtcaggagccaccctccaaaaaagcattagataaagttgcattcctacagagcaaaggtgtggtgggctataacnagaaaaagaattaactcaagggtcccaggttacaaacattaaagctactacttcaccaattatattaatcaatacactgccagggacacagcaggtaagggntatggaaacttagcagcaaacaatggcccaacaagtggaaaaccattcaccatacaatttctaatcatcttgtaactncttcaaagnatctgtgtttaggcagtttggaccatntcctgcctttcacagttgggggggtcttgaccattcccatgtgggcccggaaaacccntttntgggaaggnttgggggttcccaaagggggttttttngggtaaaccattttccancccgggggtttttaccttgnccttttggttactttttttnaggggggggtantgggggg

SEQ ID NO: 529248 - DNA, 645 bp, Homo sapiens
gaacaataggaaacgtcaaaatgggatagtcggcagttctggcccctgcagctggaggtcaccctgagttctgagggtcgtagtgctgtggtctggtattctcatcgcggtcagcctcgtaccggtgtggacgaaacgtaaagttggaaccagcttctccatggcctgggcaccagttcccggttgagccattttccttttgctaaaagtccccgcccagaggccaattcgtcgcggggcgagtggagatcgcaggtcgctcaggcttgtagatgggtcaagggttgtggagagtgggtcagaaaccagcaggtgcaaaagaaggctacagtgagcaagggtactcaccagagagcagagcaggagaatggtgtgagacaacatttctaaaagcaatcatcgtaaacaagtccagggaggcatggacaatatatcatctgtttgaaggacctgtggaattgatgaacttctcctggaagggttgtgcaaatccacttggggtcactgttcgatatacaataagaacccagctttaggatttcttttagaaaatggtatatgcagatggatgaaggcagcctcaacttaatggcaaccagatgagggagtgaaccatttttggtccaaggtatcctggatgattcg

SEQ ID NO: 529249 - DNA, 513 bp, Homo sapiens
gtcccagccgcggccggctctccgccccgctcctcctcctcctcttcctcctcctcctcctctctaggcacccccgtccctccttccagggtgagcctcagcccaactctccgcgcttactcctgggacgcgcgtctcgccccatcctttgcttccttccttccttccttcttccttcctcccctggctcccgcctccctctccaggtcgccctcccggggcccgatgtctcggtgcccgttccctgcccgcgccctgccccgttctcccttgcacttcctgagtcgcctgcgcgccgtcgcagacgtcgccgcgacggagccgccagtgctcagacccgagcccgagcagtgcacatggccccggtatccagattccaatgcccctacagtcctcgtggctgctccgtgcccgaggggagccccgggagccaccgcgggaacggtctccaggtggagcataggtcgcacatgcccagtccggtgcacatgacatggccggcccgcagagcac

SEQ ID NO: 529250 - DNA, 142 bp, Homo sapiens
actccccacccaccactagtaaatacctatacagtcctcaagagctacatgatagcgctaatgatagcatgctgaaaccttcctgaactaaaccctaccgctcctaaagcaggcttaagtcactactactactcgtaggagt

SEQ ID NO: 529251 - DNA, 117 bp, Homo sapiens
gtccgagaaggggtgggcggctcggtcaggctggcctcggtagggcttgcggccctgaagctcttgtccaccttgacgaagcccgcctcctccagcttgcgcaggtggacggacaga

SEQ ID NO: 529252 - DNA, 187 bp, Homo sapiens
taggattttaactcatctcaggttgccatactttcagttgtataatggaaagtcccgtgtccgaggaaccccttcaacactaagcaaactgggtccaattggtcacctatatagttggctgcactagggcactcaggatttccactgtgagactgatccctgcaagaggacgcgactgtaggacgtg

SEQ ID NO: 529253 - DNA, 430 bp, Homo sapiens
tgtgctctaggatatctctaaaaacctgtaactacctaaagaaaatacatgacaaattgatgtgcatgtgttatcccctctctaactttttgcaatccccttacaaacctaactaaaacctataattataggctccatcagttagtgtagggttccatgatcatcttttgtgttcagctttatggccaataatgagtataaactcatcaaaacttaacatgtgcgaaatcgaaaacttgacacatacaaatcgtgaactccctaacttattggctgatgtaatgatatgtattcaaaatctgggatgcaaataaatcctgcagtggcctattgtgattagttcctgacccatgcacgaagcccgtgcacgggcagtacagtgtaagggtgtcaggggcgcccaaaggggccccccggggccccttccaaa

SEQ ID NO: 529254 - DNA, 283 bp, Homo sapiens
acactggcctctgttccccgattaattttcggatatttaagcggatgacgagtatttgtttgactagccgaccgtatttcttggggttataccggcactggggtattcaacccagcccagcaatctctcgaatattccaggttccgggcactcaaacgacgcaggcgtgaaagcaaatcgcatctttactgacaaggcatcgcggcagttcacagcgatccggaaacgggcttggacgttgctgcacggcatgaacggtcggaggcaacggttgacgtcatct

SEQ ID NO: 529255 - DNA, 250 bp, Homo sapiens
ggatcgaggcttacctgtggagacgggtctcatgttaaataacaagtatgccagcgctaccagcatctacaaaatcctacatggatggatgggaagggctagccatgctgggggtacacagtacccagccccgaaggtcttggaggaggtctcatgtctgtgctggggctcgtggggctccctccatcctttgcgggtggctccaggaaaattggtgtgactgagggtgggttctacactgagtaggggg

SEQ ID NO: 529256 - DNA, 531 bp, Homo sapiens
  misc_feature (75)..(75): n is a, c, g, or t
  misc_feature (220)..(220): n is a, c, g, or t
  misc_feature (380)..(380): n is a, c, g, or t
  misc_feature (433)..(436): n is a, c, g, or t
  misc_feature (450)..(450): n is a, c, g, or t
  misc_feature (468)..(468): n is a, c, g, or t
  misc_feature (483)..(483): n is a, c, g, or t
  misc_feature (487)..(487): n is a, c, g, or t
  misc_feature (512)..(512): n is a, c, g, or t
  misc_feature (517)..(517): n is a, c, g, or t
gggtacatggccgggcttcctcgttgggggttgggcaccaattcccaagggccatggacagataaaacctattgncttaagcctcccgtatatggggcctgcaagctcttggacatggagctggaaatggctttttttgtaggccctggaaacagattgggagagccgatcccatttccaaggcccatgagcccatttttggaatggtccttatgaacgnctggagtgcccgacacattcaaaagtgggagtatgtccctctcgggccattccttgggaaaagttttgggacccctgtgaagtcatcataacagggttctgccagggggatggttacgcactcggctttggccagtgtgctggaaaagtgctgcctgctntcctgccatcatgagattttttttgcttttttggaaacaaagggctcaagccnnnntttcaacctgtgantggggtcctccctcgggntgtaggcctggtccnccantcagtgacaaataaagccattgtgntttgnggcctgccctgcca

SEQ ID NO: 529257 - DNA, 204 bp, Homo sapiens
tcaagaagagactgactgtgcgcatcagcagactcgtagttaagcgagagaatacctgctagcgacactcatgtacgagcggaccacttcctaggccccatctagctaaaatacctccaaactctgggcaggcgcctgcttactcaacacaggactacccttaacagcatgccggatacagcgacgggtaccgaagctcgaaat

SEQ ID NO: 529258 - DNA, 258 bp, Homo sapiens
gcaggtttgtaagcatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaggc

SEQ ID NO: 529259 - DNA, 345 bp, Homo sapiens
tgggaaagcacacccttgaggttaacctgccttagtgcaggagtgaaaataaggcttgccctgccatctctctcgatttgtagaacgcgaacctctctatagggcctactatattagaaataccatagctgtgcacatggagtagagatcttctttaaactcgggaccgtatatatctgctcagatcgcccaagcagtacatatgctcgactccatcaagtgtcaggccacattctatcagcacagcgagactgcctatcagtgacaatataggggagctctatgtggatccctcttaccctacctttgatatttatgacagcattatcataaaactccaatatt

SEQ ID NO: 529260 - DNA, 363 bp, Homo sapiens
acagggagcccccaccagtggcttcctggccctgtgctgggggtggggggaaactgggggcccatgtggcccttcccttttgagcagctcccagtgccagggcttttagactttcccccatgataaaaaaaaagggaggtccagaagttcccattccctttttattttgctggttgggatctgtaaatgtttaataaatatctgagcatgtttctatcccccccaagaatttcaaagtctccttccccaatatgaggcttttaggatgtttatattccttcacccctcttgtttcccaggttttgcagggaaaaaaagtctggaattataaatcccgcttattattaaatttgttcttgccta

SEQ ID NO: 529261 - DNA, 703 bp, Homo sapiens
  misc_feature (198)..(198): n is a, c, g, or t
ccggtgttccaggtccctctcctcttgttaccggtaaaaaattctccggtatcttgtcgaagtcttgtttttattaaaggctcgcccaagcaaatgggtgtattacaccccaccaggtccccctaatagtaatcaccaaggtccttttcttcacaaaaacaataaaagctgttctttgaaagaactttgacaccacantatttcatcatcttctgctcaccactgtgttatcaggagtgcgccccctggagtaacactatcaagtcagtccccgtgtggtttctgaaggagcacgcattttgactcactgctgaggtacgcacacgctagtagacagaatgcaccctcttccggccccgcgggcaatactctctctcctttcgcgggagcaactccttgctagtactcactccccgcccgccgcccaagtcctggctagtttgtgttctctcgatcaaactcgtcgccaaggacgcccgagtggtcgactccccctccacggacacaataggtataacatttaggaaaggccgcgaagtaccactctaattttgtttaaagcgccacaccaccactgtgtgaatcccccatttcaatggtaactcctctctctctccttgcctctttctattttttctatgtttctctccgaaataagacaccattccgtcatgtttagtcccgccaaactaaatatcaaaca

SEQ ID NO: 529262 - DNA, 230 bp, Homo sapiens
agactcatccgccaccaagccattcctctgggtatttataaagtgagaaaatatgaattaacatcctcatttacataatcatttttcataaccaagatgtcttaagcatccaaaaggttgaatgtgtctctgtgtgcataatagcttcaaatgatatatttggatttcttcttttgaaatgcttcattctcctttgacaaagcaaagctgcttgaatgaaggaagtctca

SEQ ID NO: 529263 - DNA, 617 bp, Homo sapiens
tatagattccttttagaaatggaattgaacaaatcccttgaaagcctccaaactgtctcatttcaatcagttcttttaagagctgaagtaagagtattcttagctccacttaattggtcgagctgatatactagctttttcttgatttttgtctgaagtaattaggttaagaaaagttagtttaacacatacatccctgaatagcagaaactgaatccaccacagatgtacttcttactcgtctgaagtcaaatgtggatgtttgtattcagagggcggccctctgacaagtgacgattcaggggctcagctcctttcatcttttggttctgccaccttcaacatatggcttctaaggccactgacatcatctgtgttgagctgtgaaaggagtggagcctgggaagttttttatggactaaatattcccaggaggaaaacggagtaggatttatgatcacttatccagaacctgctacaagatttctccttatctcatacttgcagtctgtcagcaaatcctgttggttttatctttgaaatatcccttgacttacccacttttctcccttgcccatgcaccccccagtcctggctggggccatcacttcccctgg

SEQ ID NO: 529264 - DNA, 551 bp, Homo sapiens
  misc_feature (428)..(428): n is a, c, g, or t
  misc_feature (434)..(434): n is a, c, g, or t
aagatggtcctcagctttggtcactgtggctgtgacacgcctgggtgtggttttcttggtgctgcctgcctggggtgtctgagcttctgcaaaagttttcagttcttatctcttcaaatatttttcctgtcttattctacccatacttccctactctaaccccaatttcatgtatgttgcccaacttggtaatatatgaagggtcttactttgttgcccaggctggagtgcagtggtatgaacacagctcactacagccttgacctcgcaggctcaggtgatcctcctgcctcagcctcctgagtagctaggattacaggtgtgcaacaccacgcccagctaatttttttgtattttttgtagagacaggattttgccattgttgcccaggctggtctcaaactcttgagctcaagcaatccgtctgnctcggnctcccaaggtgctgggattgcaagcgtgagccatcccgccctgacagtattttattttattttttagacggagactcattctgtgcgccaggctggagtgcattggcgcgatctccg

SEQ ID NO: 529265 - DNA, 421 bp, Homo sapiens
aaatgccaccagatggcgggttaggatgcagctccgtggaaggcgcggccccggtcccgaaccccgaggacaccccgtaacaagcccccacatcgggagatagacgacggagaactttggagggcgaataggctcgatggtcggctggcagcccgcgactgggcagactagagagatcgagctattagcagcgttactgttaaaacagctcttgtagtcgatacagacactttgcattacttccgactgcactgtgacaacggaccctctcacagacacatgatttactctcagaaacttaccacgtagtatcacagcgacttcaaactaactgtaaactatctagccccattatccgactgacttggcagctgagtcttgcaagcaaacacgaggtcacaggcaaaacagacaccagggg

SEQ ID NO: 529266 - DNA, 858 bp, Homo sapiens
  misc_feature (194)..(194): n is a, c, g, or t
  misc_feature (394)..(394): n is a, c, g, or t
acatgagccaccgaaaagggtggtgtcagggctgtgaggcttgcggactaatgccaggggatgcacggttgtgcgatgccggatggtgaacctgaaggaacgcgcccaaggtaacatgaaacacgtactgttccaagaattgaacgttaactgctttcagtgtaggaaacctgacggagtcagagactagtcanactaagcgagcctagctgcttctcacagcatcacccaacctgtgaacgaagcatcagcgaaggcacagacttcacacaagagccgtgaccttggctattctccggaagtgagcgacgagagggatagagcatgcaatcgagtatcgagtcttatcgaaggagtaggctagcatcataatggcgatggatcaggccccagntcacttcatctaggaaggatgcaaagacgtcgatgagagagcacagtgggtcattacgaagatcattagcaagagaacatagtttagagcgtagtgcttaggagaaacgaagatggagagcgaaagataatatagtcaaactggaggacatttggaaactaatgagctggatttcgtctgggaatagttgctcaaacgttcactgttgcagacgtctgcattcaagggttagaagatgatgctatgaagaccatatgcatcattggctacacttccattttgtctactgttgttactggacaagctttttgtaattgatgctttgtattcagataatataagcaaggaaaaactgtgtttccagaagctcactgatgtggcatagatagtggatgtatactatcccagttctttgggcctttactaaaaaatggacgcctggcaaccagtatcataccgttcac

SEQ ID NO: 529267 - DNA, 554 bp, Homo sapiens
actagagtagcatttggctcaattctggccaatggattataagcagagagtgtgcatgggacttctgggaaatctaaaaggggatttagtagatatttcatcttcactttctatccctgccgcctggcatgtagatgtgataacaagcgctcctgcagccaacttggaccacgaaaatcaaaggccacaccccaggagccaaaagctggaaggagctagggcttctgataattttgtagcaccaaaatcacagaactcaaccttgggactatctatttacctaagacagaaacagacagagtcatcatggcagtgagcggggccccggctggcatggaggcaacctggcatggacacggcaggccgggatgtgtctggcatgtgtcagaaaatcccatagatgtgtagaagataaatagcacaaattccaaggcacctgcaagcatgcacaggaggcaatgaccaacgggtgtggaagtgagcaaggcacagcaaataaactaggcacaacctgctctttgccaaggatagtctactgtggccacatggcaggc

SEQ ID NO: 529268 - DNA, 431 bp, Homo sapiens
tttcatgccccatccgtctcacaattcaattcccctcaaaacatctttgcaaatcagggccgtatttacctatagccacccctcccatccctacgcatcctttcacatcaaccagcacgcggtccaacgatccctcccttcaccatcaaatccaattggcccaccaatggtcactgaacctacgagtaccacgactcacggcggactaatcttcaactcctacatacttcccccattattcctagacacaggcgacctgcgactccttgcacgttgcaccatcgggtcatactcccgattgaaaccccattcgtataataattacatcacaagacgtcttgcactcatgagctgtccccacattaggcttaaaaacagatgcaattccccggacgtctacaacacaacactttcaccgctacacgcacggg

SEQ ID NO: 529269 - DNA, 299 bp, Homo sapiens
catttttagtagagacagcgtttcaccatgctagccaggctggtctcaaactcttgacctcagatgattcacctgccttggcctcccaaaatgctgcgattacaggtatgagccactgtgcccaaccaaaaaatttaaaaattagatggttgcagtagtgtgtctctgtggtcccagctattcaggaggctatggcaggaggatcccttgagcctaggagtttgaggtggcagtgagctatgatagcaccactacactccagcctgggtgacagtgtaagaccctgtctctaaaaaatg

SEQ ID NO: 529270 - DNA, 756 bp, Homo sapiens
cgcaccgggcccctactgcagttcctcgtcgatcctatggcaggccgaccctctgaccttcttctttccgccaccactgcccacagcctctgggacctcggtcccaggaacacatccagcctcctggctgttgacttcccctgctcttggaccccccatccaagagattccaagagattcctgccggcccgaggcggcgacacccccttatggctggggctctccgtggtgttctggaccccgcccctggagacacccttcacgttttactgctttgtagtgactcgtgctctcccacctgtcttcctgaaaacccaggcccccttcccccccctcttccctggggtgagacttgagccagaaccggggcttcccccagttgccccgaaagactgtctgggtgagaagccctggcccgagcttctccccggcaccggtgttgcacccgggacttctgcttcacagttttggggtaaagacccctggatcagactcccagggctgccctgagtctgggacttctgcctccctggctggtcatgagagccaaccgtagtcccctggagaccgcgactcccgagaacctcttgggagacagaagaggcatctgtgcacagctcgattttctacttgcctgtggggaggggaatgacaggtccacacaccaccctgggtcaccctgtcctggatgccttctgaagagagggacagaccgtcagaaactggagagtttctattaaaggtcatttaaaccca

SEQ ID NO: 529271 - DNA, 237 bp, Homo sapiens
  misc_feature (216)..(216): n is a, c, g, or t
caagattcagtggatgtgcagcgatggaaggtggtgtccaccgtacgagcaggtccgttcgcaccaagaagtgtgaggcgtgcccagcccgcggcagggcccaggaggcccccgtggtggtggacagcggattcccacctagaagagtcgccctcgtcctgccgcctaagcacgttcacacctggacccgtgcgttcaccctcacccccgtcctgngcaattcaaatacagcgttca

SEQ ID NO: 529272 - DNA, 880 bp, Homo sapiens
ggctgagtagagcggcgcccgtcgagagaagtggggccgagatcgcgccgtccagcccgcccgccgggtctgcgctgtccgggcccttacccctgctggcccttgcaaggcgcgacctggcggccatgcagcccccgggctgaggccgcccatgcaaagccgggcggtcccgggcgacgacgggcgcttgggagaaacttcccgtaaggtggcgctcccgaaaggaggccgccaacgcggtgttgccggggccagagggaagggcggccccgggggctttccgggccccctttcgaaaaacttgggggcgcgggccggcgggtcgcccattgggggggcccagaggaacgggccagcaaaagatccgggagaaacctttgagttggcttttcgggccgaccggccagagatttgccgcaaaccaaagcacaagggcgccaccaaattcggtcacatgacagcgggccgatgcgggcgagggaggcgccaccccacacccaaaaacgcccgggaccacgacgttggcccccaggagagaatccccttaagaagagggcggcccgcatatagaagggggcgcctgtcacacaccaatggggtccacacaggcggggtatgcacaccacaacaccggggaaagcagtataccgacagaggggtgtggtaggagcagagcagcccacccccggcgggtgcccccccacgcaggtggcccagacacgtctgggagaacccaggcccggatagaacaccgggcgattactaagacagccgttgcccgggccttcgcaaccataactttaccaagcgacccgcgaggacccgggaaagcccggtaaacaggcccggaaatcccattcggggtccctcgccccgacag

SEQ ID NO: 529273 - DNA, 456 bp, Homo sapiens
aaaaaaaaaaaaaaattttaattaactggacgtggtgttgcacactcatagtcccagcaactcaggaggctaacgtgtaaggattgcttaagcccaggaggtgaaggctgtagtgagctatggttgcaccactgcattccagtttgggcaacagtgagaccctgtctcaaaataataataataataataataataggctgtgctcagtggctcatgcctgttgtaatcctaccagccagattgcttgagcttaggagatcgagactagcctaagcaacatggtgaaatgccatctctacaaaaaatgcaacaattagccaggagtggtagggcacacctgtagtccagctacttgggaggctgagatgggaagatcgcttgagcccaggaggttgagattgcagtgagccaagatcatgcactctagcctgggtaacagactgagaccctgtctca

SEQ ID NO: 529274 - DNA, 159 bp, Homo sapiens
tccgtgatgcaggcctcctcccagtatgcgaacggtcaataccgactggggcgagcgcgtgcccacgcttgcgtatctcgctccgatcaggaccggctccagagcctcggcctgagttccagcgacgtgacccagcagcttcagtttctgttgaggggt

SEQ ID NO: 529275 - DNA, 665 bp, Homo sapiens
atcgcactaatttacactcacagcaccctcgggtgactaaacatactactactcactgtcactgtccaagaactatgaaactcctgagccaacaacttagtatgactagcttacacaatagcttatatgggaaagatacctatttacggactccacttatgacttcctaaagcccatgatgaagcccccattgctgggtcaatagtacttgccgcagtactcttaaaactaggcggatatggtgtaatacgcctcacactcattctcaagcccgtgacaaaacacatagcctaccccgttcttgtactatacctatgaggcacaattataacaagctccatctggctacgacgaacagagctaaaatcgctcactgcctactctttaatcagccacatagccctcgtagtaacagccattctcatgcgaaccacctgaaggttcaccggcgcagtcattctcataatcgcccacggacttacatcctcattactatattgcctagcagactcaaactacgaacgcactgacagacgcatcagaaacctctctcaaggacttcctctacttccactgatagctttttgatgacatctagcaagccttgctaacctcgccttaccccacactattaacctactgggagctctctgtgctagcacgtt

SEQ ID NO: 529276 - DNA, 281 bp, Homo sapiens
tatttgcgttgctgtgggttcttctccttctcggagggctccgagcggcctccgaattctcctctccgcttgcaacctccgtgaccatcgttctcgtgccatctcctgcttctgggacctgcccagtttacccgcttaaatgtggcttatgctcacttcattgcccaaatcaattcatcgagactctcatgattccgtcaagaaattattcacacccgaacgtggagagcaagccgatcaacaagcctggtcaattgtgtacctgaggaactcctaagact

SEQ ID NO: 529277 - DNA, 210 bp, Homo sapiens
ggtaccctcggattagggccactgtgagagtgagggagtctcacccaccgcgttaccccagccctcccctgggagacagagagagaaatcctcttcatgggccagagctctgcatccgtgtgagtgaggacagtccctggtgtgtccttttgatcttgaatctcatgccactgcaagtgccattcaccactgcgtccttggcttatcgag

SEQ ID NO: 529278 - DNA, 240 bp, Homo sapiens
cccgactagatcgacagccgactagcccgacagcccgactagcccgacagccagctccctctgcatcccttctccagcccggcggtcccaaagccccccattcacagcctcctcggccgggtactggcaaggtaagaaggggagggcgtgtttcctcggacaattggttctctttcatgggcggtttcagcggctcggtcggaatattccacgtgccacatccggtcgggctagtcgggg

SEQ ID NO: 529279 - DNA, 410 bp, Homo sapiens
ctgactctagagcatcccccgtatgcgatgtgcgcgggcaagccagcctggagccccgatgaggcggctcctcttcaagagtgggagggtgtgcagtgcctgtgagtgttgttggcagcctgggaacacctccgcttaatatggctgtggttagagacgaagagtggactcgctgtgcagcagccccatcctgaccgctcggagtgtactttccttgacatggcaaggctgtttggccagggctcgcttgacatactcctcctgcgcagccttcaggttctccttcttcccgccccaggccttcagggcagaggcctgcagggctcggccgtaggagaaggtcagggcccagggctacagcagggggcacttgttaatggcattgaggttgatggacgcctcctcctcac

SEQ ID NO: 529280 - DNA, 411 bp, Homo sapiens
cggatgtgctggcacatgcctgtagtcccagctacttgggaggctgaaggatcgcttcagcccaggagctcaaggctgcagtgagctataattgcaccactgcactccggcctgggtgacagagtgagaccctgtctccagttgaaaaaataagaggtaggtggctcatgcctgtaaatcccagcactttggaaagccgaggcgggtggatcaccgagttcaagagattgagaccatcgctggctaacaattggtgaaaacctgtttcttactagaaaaagaggaacacacgattagccagggcgtggtggcgggcacctgcagcctcccaagtagcttgggactacaggtgcacactggccatgcccagctaaatttgggtgatattacagtacgagacaggagtttcat

SEQ ID NO: 529281 - DNA, 195 bp, Homo sapiens
tagcaggatcttgtgtcatccccttcgtatgacctcccaccccatccgaagcagttgcctagagaagagttctggagccacagcacagcgagccagaggccctggggctaggttcactgggcatgctgagcagcagcaagtgggcctgcaatgagcagaggcgggtagagaagagcacgaagggggggatgggca

SEQ ID NO: 529282 - DNA, 247 bp, Homo sapiens
gtcgagtgtacctgacggagaggagacgagatgaacataaagcttcgcctttccagagcttatcctcgagaaataagcttcgtcttgacgttgatgaatctacacaaacactattttctgcagtcatccgaagaattgtgccattacttgtgctgcctctgaatgtggaggctgactctccctgtctctctgtccctcctaccccacggggccgcagtaaaagccatctcgtctcttctcttggggc

SEQ ID NO: 529283 - DNA, 690 bp, Homo sapiens
  misc_feature (690)..(690): n is a, c, g, or t
ggatggacaagccagacccaggtagctatacacgaatcgagagcatcactgcagtttgttgtaagtccttaaggcaacagacctgttggagagagatggcagcaatccttactagctggataccctatgatagtagcactttcattgtgactgaggggggcgtatagaactttgcattcaggagctccaaggaagtggtaagagcatagctatgctacacacccagatgcttgcctgcagcacctggaatgtgttccacaggatatattgagcctatatagccggacatatatgccatagaagtatgctgtaggagaaattacaagcctatgggggtgcttagctataagatacattaggtggactgttggatccttaaacttgatctcttgcacgatgggacgtagtcctccttactctgaagaaatcgaggctttttaaaactgtatactgggtgaattaaaggcacgcatggtggcgatacacacttcacagtccctatgtccaatactgtaggggcgtcgatgctgatatacaggatagattgaggggcgcttccctccagacaaggagaaaccagctgggagatcgaggctagtactgtgggccaatatactaacgtgccacctcagggtaatcctatatttttttcgattagtccttgctcataaggtttccatgctatatgan

SEQ ID NO: 529284 - DNA, 137 bp, Homo sapiens
tagggaagccccccggtccagggtttgggcccccccacttcagctttgcctcccgggttttggtttcccagaaaatcaaagggggcccattggtttgtttcccctatgatcctttttaaataacctcttttttttta

SEQ ID NO: 529285 - DNA, 291 bp, Homo sapiens
agaggatccgtgcaggatggttaggacatgaggaggatctgctagagtccagctgtgaagctatgtgagctttgggtggtggactctgctgttgttgcctggtacgtgactcgcgactgccctgtgggcgtgcttggagagtagctgggacagacaggcgagtccctgagggttggagataaagacgtgctggagactggggagtaactcagtgaaagtggtgggcttggtggtgatcccagggttcctggaactgacccgcgctgaaatgtgggcgtggttggagagtag

SEQ ID NO: 529286 - DNA, 468 bp, Homo sapiens
gaatccggcaggcacaaccaggtatcccatgatgtgtatgtacagccttggtagtgtcccacaactacaaaatttaaaaatggctatggtcaaaaaaaatattaaatatgaaggcgaatatgtggttccactttttttttccccacccttttggaactttccggtttcagtttgggaagtttctatggacacatcctcaagcggggggttccttcctcagcggtgtgcagtctaccagtaagcatcaaaagcattcttcatttctctaacagcattttttttctgagacagagtctcgctcggtggcccaggctggagtgcaggggcatgatctcagctcacggcaagctccacctccggggttcatgccattctccggcctcagcctcccaagtagctgggactacaggcatccgccaccaagcccggctaatttttgagtattttaagtagagacggggttcacca

SEQ ID NO: 529287 - DNA, 738 bp, Homo sapiens
  misc_feature (716)..(716): n is a, c, g, or t
tcaacctgagtttaaacaaaataaacaagatattttgtaaagaaagcataacatagtgtgtcttagcaaggacatgattcatatggaagcagaatgtgagaagttgtaaggtccttggtactcacttgtaaagatcaacaagacaaggaagaatttggtaaggggtttgtggaaaacaactaagtaccaccttaaaagttcaagtgatacagtttcagaaaatagggtgccttaaagtaattttgagaaagagtttaatccttcaagtcaaggcttaagaatgaagagagcgcttcttcttcccttggcttccccttctaccctctcaaaagttgagagtaaatagaatttggtttgaattccagggaaggggaaaaataaacacgaaggaattaaggaaccttttaataccttcccataccacaggatataagatgtgttgggaaaaaaaatggggtcccagcaaacctatcgagataatgtgaatacgataaacttcctaatggcaggatattcactctcaatcctgaagttaccggttcctgcagaattgagcttcagctgttactgttttgaagccgctgtaaattactgctttccccagttcccccactattttttttaagtgggcgggggcgcctgttaagatctaaaatagatatgttggattgatattctcacgtgttcggtgtggaaaacaaaacaagtacatgctntaccacaacgacaatgaatcct

SEQ ID NO: 529288 - DNA, 900 bp, Homo sapiens
  misc_feature (42)..(42): n is a, c, g, or t
  misc_feature (62)..(62): n is a, c, g, or t
  misc_feature (80)..(80): n is a, c, g, or t
  misc_feature (182)..(182): n is a, c, g, or t
gagagtgcatataggacggcggtggataaaggtgcagcgaanggagctgaccagccagctgncccctcacactcacctanccaccatggacatcgccatccaccacccctggatccgccgccccttctttcctttccactcccccagccgcctctttgaccagttcttcggagagcacctgntggagtctgatcttttcccgacgtctacttccctgagtcccttctaccttcgggcaccctccttcctgtggggcacccagcgtggggtgttgacactgggctctcatgcagatgcgcctggtgaaggaggagtgcgttctgttctgtcctggctgtgtgtcacggccttccctcccgagaggaactcaaagttaagggtgttggggacgatgtgatcgaggtcgctatggaaacacattgaagagcgccaggatgaaccattggtttcatctccagggagttccacaggaaaataccggatcccagctgatgtagaccctctcacattacttcattccctgtcaatctgatggggtcctcaactgtgaatggaccaaggaaacatggtctctggcctgagcgcaccaattcccatcacccgtgtaagcaggaagcctgctgttcaccggcagcccccaagaaattagatgcccttcttgaatggcattcttcttacaccaggaagtgcccccaacaagtgacttgacagtctggtgacttcgtggcggaagctattcagtgctcagggcaggccccaattacgagctattcaatatctgccgcacaaacgacaaaaacccctaaccacacacttgcgggcccgcccacagagatctatacacactggggcggcggcccgattttaacggacaacggtcctaggacgcgacgtagggac

SEQ ID NO: 529289 - DNA, 110 bp, Homo sapiens
  misc_feature (102)..(102): n is a, c, g, or t
tcatacccactagaacagaaggaagagccaagcactcatatcattcaaaatctgaatggcttcatgaaggatgaatgcctctgcaaaggaaaattctttaancccacagg

SEQ ID NO: 529290 - DNA, 387 bp, Homo sapiens
tcttattcacagccaaaatggaagatctaacaaccagagggtgatttggcaataagtatcaaaatcctttcaagtcttgtcccatctttgacctgccaaatctacttatattgatttagaataaggaaataattgggaagcagtcaaagttatatcacaggtttatacttgtgaaaaattgcaaataacgtaagcatccattagtctggactgaatcaagaaatagggtatgttcataaaaacaaaatctttttaggccttaaaaatgatatagggccgggtgctgtgctcatgcctgtaatcttagcactttggaaggcagaggcaggtagatcacttgagcccaggagtttgagaccaggctgggcaacatgacaaaaccccatc

SEQ ID NO: 529291 - DNA, 1697 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 529292 - DNA, 186 bp, Homo sapiens
atggcccggggcccaagaagcacttaaagcgtgttgcagcgcgaagcattggatgcttgacaaactaacgggtgtatttgcacctgtccatgacaggtccacaagcgagggaatgtcttccttgatgtttcctaggaatagataagtatggttgactggagatgaggtaagaagatatgtatgcaa

SEQ ID NO: 529293 - DNA, 2849 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacactggaatgtacagggcagatcttctatctcaccgggagactactggccatgtgaccctgtcactgccgtacactggccacaccatgactttacctgccttcctctggaaggcctgggtaccacgggacctttgcacctaacacatacactgacaggtgagactcccccaggggaccaaggaagagcctttcttacgcctctgattacatatatgcgacaaggtccagttaggaaaacggcgatgacatcagtatatgtctggctatataacccgtgagtgttcaagtgacaaaaagacacccaacactgctaatataccaaatggtgtgacgtaatcgtgcgtaggctgccccttcgagcgtgatcgtgcccgagacgaggcgacccttcttcacaatatgggaccccagcgagtatgggtgctagacattatgcatcagcgacacccacgttggatatatagcgtgacacattgcggggaggctgggccggacggactggagacgcccagatgacacccctccagactgccaggagaccagcagagactgtagacagcgcaagaaccacggcacatgggagccatgttgtcccactggaactggaactggtccacaggcgagcaccagtagacagcagacagcagcgaagaccacatttcacaccccaattgcaaagcaacaaaaggatctggaacgagacgatgatccaccaatggcgacagcacctctgtctccacagcacacagatggttagcacacttccaagtcacgagccaggagccgg

SEQ ID NO: 529294 - DNA, 1985 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 529295 - DNA, 641 bp, Homo sapiens
ctgggtgtggtggtttatgcctgtaatcccagcactttgagagtccgaggtgagatgattgcttgagctcaggagttcaagaccagcctggacaacatggtgaaaccactcatctctcctaaaaatacaaaaattagctgagcatggtggtgtgcccctgtggtcccagttactcagaaggctgaggtgggaggattacctgatccagggaggttgaggctgcagtgagctgtaattgcaccactgcactccagcctgggcaacagagtaagactctgtgtgaaaacaaaacaaaataaaaccctgcattcctgatgagagttcataaaccactgaaactgtatgaattatgtgtatgtgtgagaatgtgcatacattttaggaagaggatctatagatttaatccaaatccagaacaaattaagaatcactattcttaaacttcagttgcctggggactaggaattagtgacaatgttcccccaaatcaaagtattcattagaagaaaaataactaaggctaccactgcagccattcagagcataagcagcatcattcagcactggttttaccataagccgccgcctcaggaacaaattgaatcgcttttgccaggctgtgaaaccaccaattaaagaat

SEQ ID NO: 529296 - DNA, 456 bp, Homo sapiens
gccagttacaccagctgccaaataaaaataatctctgaattgagttaggaaatttagttcctgctacaactggggatttcctgtacaggaagaggaaggggtgggcaattacagaggattagggaacatccctttagagttcttcctgggatgacaatggtcgaatgagataatgtgagagtgctttgcagttggaaagtgctgtaggaaccctgaattcatctgaaactgtagcttagtgtttaaatgatgtctgttattacttttttgaatagtctggagtgcttgttaaagaaaaaattattctgtgatatttgttgaatgaagcacagtgaggaagactttactcagggcccttgtaatagctatagggaccactgcaatagggtcttgcagtgggggagagagaataggctcaattctgaatacatcatcatgggcaagtgggaattatag

SEQ ID NO: 529297 - DNA, 1296 bp, Homo sapiens
aagtttctgatccacattgaaagtgtagtcatccaccaggaagcacatgagcatcgggaggaacctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 529298 - DNA, 272 bp, Homo sapiens
tgcccagcctccgctgcctcatcccctgcatggagtctctcttcccagccgagtgtctatgactcctgttcttcttcatcgtcatcatcattgtgctgaacctcatctttgtggtaatcatcgacaccttcgctgacctgcgtagtgcgaatcccaagacggaggagattcttaagaggatatgcttcatctgtgttctggagagggacaagttttgaataacaacgacaggtgtcatttgaggaacacaatcaagctggagcacaacatgt

SEQ ID NO: 529299 - DNA, 1987 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgtgcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttg

SEQ ID NO: 529300 - DNA, 1864 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 529301 - DNA, 1734 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggccttggggaatcttcctccacctgttcccgggcacttgggctgtggcgagaatggcctgaggttcgggggccttcggaggtttcccccgcctccagggaggaggccgggacgcgggcccaaccg

SEQ ID NO: 529302 - DNA, 153 bp, Homo sapiens
aaaaatatcgagggtatgaggactttacttaactgggcgcattgccatggggctgttcgtggaacatgatggcaagttgtcttgggaactcttcagcatcgtgtgtggatcctgggattaaagcctagtagtggcggagccttgaaacctggg

SEQ ID NO: 529303 - DNA, 115 bp, Homo sapiens
ctcctacctcatctttcctacttactaaatacagatgattttattatgattattatcttcatcattggaaatggataagatagataagatatttcttgtttttgttattcgggag

SEQ ID NO: 529304 - DNA, 91 bp, Homo sapiens
aaaacaaaccaaccaactttttcgggtttttggttgacccccccaaaaggggtttttttcctttcaaaaaaaattccccccggctgggtga

SEQ ID NO: 529305 - DNA, 861 bp, Homo sapiens
gctccagcttagatggggccaccctggggtgcaggtgaatgaggagccgcagcgcgtgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaacgtgaaaaaaaaaaa

SEQ ID NO: 529306 - DNA, 219 bp, Homo sapiens
cgtggtctaccagaatgcatgaaagctcgagtctgtgcgaacgtaatggagtagctgcgcaggacagtagctcacacctgtaatcccagcactttgggaggccgaggtgggcggatcacctgaggtcaggagtttgagaccagcctggccaacatcgtgaaaccccatctctactaaaaatacaaaaattagctaggtgtggtggcgggcgtctgtaat

SEQ ID NO: 529307 - DNA, 1306 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgagaaggcagagccaggtgtacaggatggaacatgaaggcggacaaggagcgtgaccactgaagcacagcatcacagggagacggttaggcctctggataactgcgggcaggtctgactgatgtcaggccctccacaagaggtggaggagcagcagtctcttctctaaactacccccggggaaagggagactccctttgccctgtctgctaagtagcgggtgtgtgttccttcacatttttcgctaccgactagaccctggtccgcctggcaacgggcgtcttcccagatgctggcgtcaccgctagaccaaggagccctctcggtgaccctgtccaggcataacagaaggctcgcactcttgtcttctggtcacacctcactatgtcccctcagctccctatctctgtatggcctgtttttcccagattatgattgtagaaagccgcttgtatatttattggataag

SEQ ID NO: 529308 - DNA, 1065 bp, Homo sapiens
  misc_feature (379)..(379): n is a, c, g, or t
aaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagttcattccttcttccaacttacgtgattgtgacattagtggatctcactcaggttcaaacccttcacgtgcattacaggaattcccttaaaggggttccatatttataatatagcgctttgaggagaaggggacgactttatacaaagggccggtgttgtagacgtagaacattaggagattattacgccattatcaccacgggtggcncaggggaccttggacacgcggttcccaaattccttttattgggcagagcaagtgggggaacatcacaagaggggtgggcatatgcccaaaaagttctcaacacctcgaaggggccttgaaaggttttatccacacatatgtgtctcccaacaactcagaggccaaaaaagcccctgtggcacactgtgacaggggtgtggagaaagcccctctcagtgtggggaaccagaagtgagaccgaccactgtgtgttgtttgtgggaaacaggagagagaatctccccccttgttgtgtgtaaacaccgggtgtctctatggcgaggtgggcggggagtccctactccttttccacagtgtagacacttaaaagaggccctttcaattgtgcccccccccttttattttcacctggtgggcacctattgtagagacgcgtggtgatgaagaaaacatttgagggggagaaatgttggggcttgagcgagacgacaaatattatttccccgctgtgaaaaggagaagcgcccttttcttccccctttttgtgtggggcgcccccccccccggaaagcttttttattgtgggcccagagcccccccaaaacatacttctttctgtttctcacctccgtgggggcggagtgtggcaaaatccttctcactccgaggacaaaacggcggcaaac

SEQ ID NO: 529309 - DNA, 906 bp, Homo sapiens
ggcgtttccctgggggcctggttggcgtggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggtagggccctaaccctaaccctgatggcgtggaccgtccgcccactctcatgcccttggttagtggaagttccggtggccgcctagctccgggagcttcctgtgctgcctgcccaagtgctgtccatggtgagctctgtgctgacttctcccacatgagccgcgtggagaccgaaccttagcactggagttagggtgtggggcccctcctgggaaagagctgttggtatttagcatgtctgtctgacatgctggggccggggaaccagtcataggtgcctgtggggtggagcttag

SEQ ID NO: 529310 - DNA, 330 bp, Homo sapiens
  misc_feature (264)..(264): n is a, c, g, or t
  misc_feature (283)..(283): n is a, c, g, or t
aattacaggaaaagaattgaaataactttcagtagctgtgaggctgcaaccatttgaggaggggggaaaataaccacaagtaaaaaggcgaagagcgtgaactcatatttgaacttcgttcaccttacttgtttttatttggggtaaataaagcaaatatatggtatgtaaatatttgaacttcgtttaccttacttgtttttatttggggtaaataaagcaaatatatggcatgttgcagcaccgtttgcctaaccccctttnaaaagatggtcgaatagtngtttgctatacctttactgggagggcagggggagcacaaagttgaag

SEQ ID NO: 529311 - DNA, 989 bp, Homo sapiens
  misc_feature (989)..(989): n is a, c, g, or t
aaagctaacgatagccatgagccaggaatttcccttagggatagagttattattgaatgttttagaagtagtagctcccttcaagcactttaacaagcttagagaatttgttcagatgaagcttcctccaggcttacctgtaaaattagatatacctgtgtttcccacaatcacagccactgtgacttttcaggagtttcgatacgatgaatttgataggctccatctttactatacctgatgactacaaggaagacccaagccgttttcctgatctttaactgacgtggaacaggatgccgtctaaccaaggaaagaaaatacagagaccctagaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacatgaatcgacacatcagtaatacgatacagtgaaatgggtctctaatacgaatttcagcgagttttctgatgtgccattgtggtctttttaaaaatataccatattataaatgtaataggtctgaacattaatgaccctaagactgggatatgtgaagcagtatgagtgctgtggattgtctgaaaaagtgtcacaggtgctggtgccctatcctatgccataataagtatactctagcagccataccaaattaacacacgtccggagccttcaccgtcaatcaccgtctcagcagactggagcccttcaactgccactcagcacggtgacatatacaattccgtcgcgactggacacagtaacaagttacctgagctgcagaagaaggcgccccaagacacagagccctccgcaagacacaggacagaaggctgcaacacagcaaacaacacaaagaaaacacacaggaaagaggaggaacaacaccagcagacaccgtgctacaatacan

SEQ ID NO: 529312 - DNA, 376 bp, Homo sapiens
  misc_feature (229)..(229): n is a, c, g, or t
  misc_feature (266)..(266): n is a, c, g, or t
  misc_feature (276)..(276): n is a, c, g, or t
  misc_feature (328)..(328): n is a, c, g, or t
  misc_feature (370)..(370): n is a, c, g, or t
gatgactatagttaacaataatatatagtttcaaatagctagaaggagaatattgtacgttcccaatacaaagaaatgatgttcgagatgatgatatgctaattaccctgatctgatcactacacattatacagatcaaagcattactatgtactccatgaaaacgtataattattatttgtcaattgcaaaaataaaattttaatttagtttgttgaggcagggtctngctctttcacccaggctggagtgtactagcaccatcncagcacactngcagcctcaacctcccaggcttcaaacaatcctcccattctcagccttctgnagtagctggggaccacagacacacaccaccacattccagctngttttt

SEQ ID NO: 529313 - DNA, 353 bp, Homo sapiens
acacgcaatctcaatttctgccaaacagttttaaaacaacaaagataaaaaaagacaaagggcattacataatggtaaagggttcaattcaacaagatctaactattctaaatatatatatacccaacacaggaacacccagattcataaagcaagttcttagagaccctaatagaaacttaagactcccacacaataatagtgggagactttaacaccccactgacaatattagatcattgagacagaaaattaacaaagatactcaggacctgaactcagcactggatcaaatatatacacaacactggatcacagaatatacattcttctcattgccagattgcggtgtt

SEQ ID NO: 529314 - DNA, 1270 bp, Homo sapiens
tcgcagtgaccagtggtgtgtgaaccagaggactatgctggtggtgtccacggcagatgcagagctccgagcagctaaggacacctccattggcagaactagcacgccagttagccattgcaaggccattcaacatccatcaccggccaccacactcatgcatgacagccaacttctcaacgcattaatttccaggcacaaccagtcaccagccacaagagccgtcatctccagacatgacccattgcagcatcatggcaatgcacacccaaccatccagcaccccatgcccaagcatgctacaacacactgcccagccccaagcattcaccaatcaaccagattcatcaacatggcagccccatggcatttcatcacaactctgtgcagcatagcttctgcacacgccatgcgcaagctggctgacggcaacctcacaggcaggcattctaggctattcccagcccgcatgcctctcttcaaaccatgctcagcccagccaggctgctcgctgcttggcaattccacatcagatgacagatgaggccaacagctctgcactggcctcatcgcactctctatcacacacccctcacaccccatctcacgcggcacttatgcaacggagcaacgcaggggctgatcacgcatgtcttcactctggcgcatccagttagccattgtccaggactggatatgcagatggctaccaccctggcccaccacattcgtcccccacgagaccgctactcctggatgcgttctaacctggcccccagggactagcaaccacgcaacgccatagtaaccaacaactcggcgctcacacgcaacctgggcaactaactggagctcgcttccggaactgtgacgcaacttcttccacacacccacacctgccacacataccggtcgcaactccttccatcggcgaccacatatcagaccccagcagaccaactaacccggtatctcacccacacagtcacatcattcacaccggaccgcatccccacccagtaccacttgggccaatgttgtgctctgaaacctcattgcaacccacctaggggtcaccttacccccctcaccctgcgacctcaccacaaccgagtgcgcatacctgccaggtagagcgctaacaccgactttcaacgcatcgcttcatacagatgaaccactgtgatcaaccacacgcgttctaatatcatcgccacccactacacccgtctcagccacgcgtcacacaccccaccccgtccacacctcc

SEQ ID NO: 529315 - DNA, 310 bp, Homo sapiens
ggctgatttctgtaatcctcagcgctattagcggctgaggtgggaggtttgcctaaggggaggttttcgagaccagcctggcccccatggtgaaacctggtctctactaaaaatacattagctgggtgcggaggcacgcacctgtaatcccagctactcaggaggctgaggcaggagaatcgcttgaacctgggaggcggaggttgcagtgagctgagatcgcgccactacacttcagcctgggtgacagagcaagactccgtctcgaaagcgtcagtaaggacgaactcaagacatgtctgcccgaatt

SEQ ID NO: 529316 - DNA, 649 bp, Homo sapiens
  misc_feature (621)..(621): n is a, c, g, or t
cgtcgaacgcggcagcaacccctcgagcgcctcaccgtgcccatcgccggcagcttcgccaccaataacagcgaagccttgcgcgacgccgcactcaaccacctgggcatcgccctgctcccggacttcagcgcccaggcggcgctggccgctggcaaagtggtgcaggtattgaaggactggacactcaaaggcgcgtttgccgatgagatttacctcattcggccctactcgccccatgtgcccaagtcggtgaccgtactggtagggtatttgaaggaaaagctgtcaggcgggtttcaatttggtggctgctgatgaaggctcttgtaggagcgagcttgctcgcgaaaaaaccgagaaccccgcgttaaacctgatagcgcgcgttatcgttggcgatcttcgcgagcaagctcgctcctacagaggacagtgacccaatcctgttggattcttgcctgatcctctgaacttgagggcaatcggatagatagcccttgcgcgttggtctagagttcgacaatgggcgacttccattcgcaccgctcctataagaactcagcaccaccaaccgatgatcagcaggtgagcccgcatggaattacgtatcacccacangggattcatttgggggggatctctagag

SEQ ID NO: 529317 - DNA, 236 bp, Homo sapiens
gtttgcatgcaaagaacatcatccatagagacatgaaatccaacaatatatttctcatgaaggcttaacaagttaaaaatttggagatttttggttttgcaacagtaaaagtcacgttgagttgttctcagcaggttgaacaacctactggctctgtcctctggatgggccccagaggtgatccgcatgcaggtaacaaccccttcagtttccagtcggatgtctactcctctggc

SEQ ID NO: 529318 - DNA, 268 bp, Homo sapiens
taagagcggctccgcaccttatggttcctagtcggattcgttaaccactgagccacgacgggaactccacctatcatttcttgcatggttagtctgtgccgggcattgttctggatattgtgcacttattttctcatttaatcatcacagcaaggtgtgtactattattgccatcatttcacagatgagaaactttaggcacagaaaagttaagtatctttcccaaggtgacataaatagtgaagcgacagaaatgggatccagaccc

SEQ ID NO: 529319 - DNA, 886 bp, Homo sapiens
ccaagtggtagcaaggcaaatgagagaagaggaggaggaggaggaggaggagtgctgagtgcttggagagtgagtgctgtccccgaaggaagaatggccccactgtagtgcttgaacccccacccgagccttgtgctacaaggagatcctggaaatggctgagagtcggtcggaggctctggctgtggatggatgctgggaaggcctgggtggcttgatgtgatgtgctcatgtgacccctgaatgggaatgtggatgaacatggatgcactcccatgcagaaatgatggagtgatgtgatggtgatgatggcatgtgtgtccctgcaagggcctcttcctgtgggtgggaagagcggagaggctggatgcagggaggaggagctggctctccaaaggtgaggttggggaagtgactccagaactgcttggagcaatgattgggacccatgcttggcccaatggaatgcttgaccgtgcttgagaatgctgtgcttggatgtgggcatgggatgggaaggatggaggggacaaaccgggtggacagttccaatagaatggctctgcctttccggtgggcccgggggcctactgtggcttcaggggggcccctttggtgcctggcaagttagcgaacaggaggggttgagatgtgccaattccttcccccgggggaagggaccaggcctttgaagtgccgggggccttgcccctaccaagggtcccgaaaggctaacccccgaggaagaagaaacgagggaggtgggcagtgaaaaaccggagaccaagagggacaggggaggtggagaagcttggcctggccattgtcgagaagctggaaaatgtggcccaccaggttccgggcctaagtgggggttgagaacacg

SEQ ID NO: 529320 - DNA, 1003 bp, Homo sapiens
gtgtggctggacctcgtgtcgcgagctgccattgcccagtggatggaagaagaaagggctccgcgcaagcgccgatggcgcggcctcccagtgccctgcggcagcgactcggaggacgcgcgagtttgcagatccatgtgctggacagatgactgccctgggcccggaagctgggacctggaagacccctgcccaccttccccacctcggaatgcacctcgcgatgtggagcccggacacccgggcagatggctgcgtgcccagaacaagcaagacagaagaacgtctggcaggcttccagtccatgggccctgagctacccggtgttcaaaggcatcatgacacgaaggggtacaaggtgccaacacccatccagaggaagaccatcccggtgatcttggatggcaaggacgtggtggccatggcccggacgggcagtggcaagacatgctgcttcctcctcccaatgtccgagcggctcaagacccacagttgcccagacccggggccctgtgccctcatcctcttcgccgacccgagagctggcccttgcagaccctgaagttcactacggagctaggccagtcccttggcctcaagactgccctgatcctgggtggcgcccggatgcccacccgcctcgcagcccttgcaccgcaaatcccgacatacttttggcaggcccggaccgttggggcctgtgggctgtggcaattgagcctgcagctcccagttttgcgctccgtggtggtccgcgcaccctgccgcgctcttcgccccgcgttctcgctcatccccttccgtggcgctttccgccggcctccccgcgggggccccaccaccggcgggcgctccctgcgccggcctccccaccctgtcgtgctcggcgattgtccccggctgtgcctccggggggcggtggtcaccccggctgcgggcgactacacccctcgcgcctcagtgcccctcttcccccgggcgggaggacccacgccgcgtcgcc

SEQ ID NO: 529321 - DNA, 343 bp, Homo sapiens
attcgcggccgcgtcgactttttttttctttgagacagggtctcgctctgtcgcccaggctggagcacagtggcgtcatctcagctcactgcaacctccacctctcaggttcaagccattctcctgcctcagcctcccaagtagctaggatcacaggcgcctaccaccacgcctggctaatttttgtagttttagtagagacagggtttcaccatgttggccaggctggtctcgaaccccttgacctaaggtaatccacccaccttagcctcccaaagtgctgagattacaggcgtgacgacagtgctcggctgtctataaatacttactttaaaattaaaat

SEQ ID NO: 529322 - DNA, 719 bp, Homo sapiens
gtggagtagtatttatatgttcttccggaacacatgagcaagtaacagagccaggaaccctactgcagtaaactgaagacaagaactcttcccccaagaaaaagtgcacagacagctggcagtggagcctgctttatttagcaggggcctggaatgcaaacagccactggggcacaggcaccggagaccaacatgcacagggtaacaccccttgagcgcacacaaagaagcttgatattttttttatggccatagaaatacaagccaggccagtatttgagacgtttgctctggtacctggtgcatttattatatggaaccctctaacccctgacaccacgacgcattcctaattgcacgccgctacgacgcccgtctctttgcccctccgccgcgcccctcaacgcttacccaaaaccccaccccacccgcaccgcgccccaccccaccagcggcgaggcccgcgagcgcgcgtatacatatgcgagggcaccgagacgatgcggctaacaacgaacaggcccaaaatcccgcggcgcacgacacggggcatcgctctcagttcctccgcccgcctctggctcggcgcccgcgccgcagtaacgccgcctgacgcattaaccgcgccgccaaagaccccaaacgcgcaaacttgagccatccccgtattgtccgcccccacccacctgtcgatcgtccgcgaccgtcccagagcacat

SEQ ID NO: 529323 - DNA, 87 bp, Homo sapiens
gaaaattcaaaaatttattttgttttaatttgaaaggcccgttcagggttccttatgcaaaaaaataaaacaaattccggaattgga

SEQ ID NO: 529324 - DNA, 859 bp, Homo sapiens
gtatgagttttttttttttcccttggtacttttccatttaaatgtggtcagagaacatggttaatatgtgagtgtgatccttgggaatccattgggatttatggatggcctaccatatggcacatttttctaaagtatccggggtacagtgggtgagtgcaggtgatctatatgtgtccataaattcaaggttggctaatcattaaatggtcttagatccaatacttttctctgctgtaacactgttatatcttataatcttatgtgtctggtaaaatggcccaatagaatagtggattggtctacttttcctggttttaacttaaattattttaaagctagcttagtaggtgcactctagatggcaatggatatatttcctagtgatttaacaatatttatggggtgatttcctctagtagtaacttggagtctggtctcatttcatgtaagtacagcagcttatttggtagtactggcctggtacattttccctatttttcactgttcaggcatgccctttataaaggggtggaatgggctggctaagacttctttaaaaacattccctttgatagtttttttccccttggaatttgagagttcaatttctcacatgtattgtcactgggttaatccctatattggggctaattttgggctacatactttttacccaatctgggtctcggaattaaaaatttcttgggcacgagaaaaaatattctttgggaaaaaggccttgagagcgcccaggggtaaatctggccgaagtcggatatacggcgaatgccgccgagagaggaactcgtgcccctaatagaggtccacaatagtaagatgcatttcggtaacatcc

SEQ ID NO: 529325 - DNA, 174 bp, Homo sapiens
gttaacagctataaccatgcactgggccgtcgtttaacagttaacagctataaccatgcattggccgtcgttgaacagccaacagctataaccatgcatgggccgtcgttgaccagttaacagcttatgaccagtcatgggccgtcgttgaccactcaccagctataaccagtc

SEQ ID NO: 529326 - DNA, 735 bp, Homo sapiens
  misc_feature (225)..(225): n is a, c, g, or t
cccctggccttgtggccaatttccgccgctgtagtaccacggttgggaaccaccaggggttgttcacttctttgcagaaaatgttctcccaaggggggtggcaccaccctctgtgaggcccgccccctctttgagggggaagttggcaccccgcggtggtggtacacccacgcacgtggagaaatggatgcgggagaccccccccccgacgtttgtctttagganaacaccacccaattgtcggcagtagatgggcgggactaagtaatagaactgggtctcgcctttaggggcgttacacttgttgcgcacacacgcattttggttgccaacaactattaaatcattatttgttgtctaaacactgaacccccacttgcgcgcctaagaacaccttgtcgaccttcaccaggtttttctgatcagaaatatatatccggacactaatattggacacacctccttgggccgtctctgcctcagcaatttctttgtaatcttttcttcttactccgtcctgacaatccttgtggaactacatccgtcctcacccgccatacctgcttttataacgaccacaccacgtagatctctaactaccactctttactagagtgctctccactcatcctcccccgtaacagaccgcccccaccactgattcttttatgacgatgtaacctgccagcaaaacttcgttactaatcatacattaccccaacgcaaacacaaaca

SEQ ID NO: 529327 - DNA, 281 bp, Homo sapiens
gcccgtctgctccacgagatggatgggggcgtcacagtccaagttcaaatcaccatctgctggcgctggcgtgccaacgattgcacagctagaggagcaggtctgagcaggaggccagagagaaacaggcggcaccaagtctgctgaagcagaaagacaagaagctgaaggaaatcttgctgcagtgtggaggacgagcgcaagatgggcgagcagtacaaggagcaggcagagaaaggcaatgccagtgtcaagcagctttttgaggcagctggaggagg

SEQ ID NO: 529328 - DNA, 128 bp, Homo sapiens
gacaaaaagaagaaagataagaagaaaaagaaaggagaaaaggaagaaaaagagaaagagaggaaaaaaggccctagcaaagccactgttaaagctatgcaagaaactctggctaagcttaaagagga

SEQ ID NO: 529329 - DNA, 680 bp, Homo sapiens
  misc_feature (2)..(2): n is a, c, g, or t
  misc_feature (135)..(135): n is a, c, g, or t
  misc_feature (140)..(140): n is a, c, g, or t
  misc_feature (145)..(145): n is a, c, g, or t
  misc_feature (183)..(183): n is a, c, g, or t
  misc_feature (199)..(199): n is a, c, g, or t
  misc_feature (204)..(204): n is a, c, g, or t
  misc_feature (208)..(208): n is a, c, g, or t
  misc_feature (219)..(219): n is a, c, g, or t
  misc_feature (243)..(243): n is a, c, g, or t
  misc_feature (325)..(325): n is a, c, g, or t
  misc_feature (328)..(328): n is a, c, g, or t
  misc_feature (331)..(332): n is a, c, g, or t
  misc_feature (344)..(344): n is a, c, g, or t
  misc_feature (376)..(376): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (390)..(390): n is a, c, g, or t
  misc_feature (409)..(409): n is a, c, g, or t
  misc_feature (416)..(417): n is a, c, g, or t
  misc_feature (421)..(421): n is a, c, g, or t
  misc_feature (426)..(426): n is a, c, g, or t
  misc_feature (430)..(430): n is a, c, g, or t
  misc_feature (435)..(436): n is a, c, g, or t
  misc_feature (442)..(442): n is a, c, g, or t
  misc_feature (467)..(467): n is a, c, g, or t
  misc_feature (477)..(477): n is a, c, g, or t
  misc_feature (492)..(492): n is a, c, g, or t
  misc_feature (500)..(500): n is a, c, g, or t
  misc_feature (513)..(513): n is a, c, g, or t
  misc_feature (515)..(515): n is a, c, g, or t
  misc_feature (546)..(546): n is a, c, g, or t
  misc_feature (556)..(556): n is a, c, g, or t
  misc_feature (558)..(558): n is a, c, g, or t
  misc_feature (566)..(566): n is a, c, g, or t
  misc_feature (574)..(575): n is a, c, g, or t
  misc_feature (577)..(577): n is a, c, g, or t
  misc_feature (581)..(581): n is a, c, g, or t
  misc_feature (583)..(584): n is a, c, g, or t
  misc_feature (590)..(590): n is a, c, g, or t
  misc_feature (592)..(592): n is a, c, g, or t
  misc_feature (597)..(597): n is a, c, g, or t
  misc_feature (662)..(662): n is a, c, g, or t
tngaaagaggggccgtgaggtgagaaagtccgggagccgaccttgagatggcctgatatgaaggagtcacgcctcccgcctccggagctgccagtggctgccttgtccttcaagtgcaggagctggttaaatgtnaggantggangccactgtggtaaggggcttcccacgggcacggggtantggtgggacacggttngggtngctngggccttgctngaatgtactgtaaaaagttctganactctccattgagcactcccttttcttccagaggcccggaatttggagcaaggccaccgtttacattccctaccccctaaanaanaannaactaaaaaacnaggggcactttcaggaagttcattgtaagttncgccnttngnggtnacagagggacggggaaggnaaaggcnngggntaatncccnacacnncagctnacttgcctgctgccccttgccctgnaccctgcccncacattggactggcntttagccngcaagccgggttntncccttggggtgggctgggcccagggtgtgcngctgggccantngggcgganctggcccnncnactnannaattgncncattngtacttgtccccctcagcacattgctcttgttccctcaggttttgttggcaattccagtctcccncaaaaccttagcagaggc

SEQ ID NO: 529330 - DNA, 254 bp, Homo sapiens
  misc_feature (2)..(2): n is a, c, g, or t
  misc_feature (135)..(135): n is a, c, g, or t
  misc_feature (140)..(140): n is a, c, g, or t
  misc_feature (145)..(145): n is a, c, g, or t
  misc_feature (254)..(254): n is a, c, g, or t
tngaaagaggggccgtgaggtgagaaagtccgggagccgaccttgagatggcctgatatgaaggagtcacgcctcccgcctccggagctgccagtggctgccttgtccttcaagtgcaggagctggttaaatgtnaggantggangccactgtgaccatccaatctggcaaaacaggcaacatggggctgctcgagtgtagtaagagattggaccacctacccttgagccgtgtgcccggcgtcttgagacctn

SEQ ID NO: 529331 - DNA, 597 bp, Homo sapiens
gccctggtgtgattccgtcctgcacgattgtctctggagcaacgtctgtttatctccgtaacgccgttctctcctaactaagtgcgtgccgcatccgatgcgaagattcgttggacatggacatgagtccccctgcaggcccctagataactatctttacggttgtgtaccactacaggccgcccgcacacgattcattcacttttaaggttggataagtgatcgaataatgatcaccagttatcttctacagaacggtcaatctagggtgcggtatgcaaaggatgagtagcacatagttgaacgcgtaggcgattgcaataacgagaaaggcaagcctcgaaattaaagttaagcacttggcaaacgtttgagaagattgtcttgtacagagccaaacgtggttgaacttgagagggctgcaggaaatatcatccagacaagtcgttacttaaaaggtctggacttcgtaggtatcttaggccaggtgcatacttaagtgcgacatgcactttacttacgctgtgtgatggaaagattgcacaagtactagaagatcaagacgatggagggatttcaatactcttccataatatc

SEQ ID NO: 529332 - DNA, 153 bp, Homo sapiens
cagaggagcgtgccaagactcttagcacactgtgatacagctctacctctgaggacctggcgccactggctcgggctgacgactattaacaggtcaagaacgtggtcgattactacccggagtacaacgctgctcttcgagggtgcaaggtaa

SEQ ID NO: 529333 - DNA, 257 bp, Homo sapiens
  misc_feature (254)..(254): n is a, c, g, or t
gtgggtatttaaaaagttaatgtcagaggaagtacacttctgtggtctgcagtagggagctcaaacaaaaataagcaaggggattaattagttttacgttttttaattctgcagaactagttaagtaagtttggggttaaggatcctttcttactaacacagatgtacctgagcaaacagttttcccattggtgctctggtgtgtcagtcatgcaatctcccctcctagctcctcaggtaggagggtgtcaggnggc

SEQ ID NO: 529334 - DNA, 264 bp, Homo sapiens
tcgataagggccacaggcataattatgggcttgcagaaactcttatgtagatcaggatttgactaatagaagtctggacaaaactggtttataaaaggatcttgagaccagctgaggcttcatctgtctgctcagctgatggtgaccacagctggagctgccaccaggggtaggtgggtgaataaaggatagctctcatctccaccattccccgcccccaaaccaacacttcctggtgtggctcctggttggccccttatcgag

SEQ ID NO: 529335 - DNA, 303 bp, Homo sapiens
atcaattaaagctccttaaaccacacaaggtattcctgaagccccactttttatactgattcaaaaagctcagagtaagatctctaccctggatgagttatctctgttactgttaggggatactaaggcctgggatgggatgaagaaaagaagaaacaagctgacactttcattcacagtcaatcatatgcaaaagcagaaagctagagctcaagttcactcaatgcctaatgccactcctgattattgcaaattagttccgaaaaactgattacagactgagctaactgcataacagctaaa

SEQ ID NO: 529336 - DNA, 666 bp, Homo sapiens
  misc_feature (454)..(454): n is a, c, g, or t
  misc_feature (493)..(493): n is a, c, g, or t
  misc_feature (508)..(508): n is a, c, g, or t
  misc_feature (516)..(516): n is a, c, g, or t
  misc_feature (567)..(567): n is a, c, g, or t
  misc_feature (586)..(586): n is a, c, g, or t
  misc_feature (590)..(590): n is a, c, g, or t
  misc_feature (642)..(642): n is a, c, g, or t
  misc_feature (651)..(651): n is a, c, g, or t
tacatgatacgactcgaggtagtacccggagacacttacgaatcaggagagatgcaaagagtctagcaaattatttctagcataatcacacatttaacttcagactcagccttgtattataattccaaaaaaaaaaaaaattgagggccaaagaatacggtttacccagtatccaaggttttaacatttgggcagccgggttaaaaatagagcctaacctatttaacttacccactgccgggctgggatactaggtgggtatcaccaaagagaaatcccccttgggacaggagcaatataaattagccaggtattataaaatggcctggtataggtctaagcattcccactagggtgtcaccagggcacctaagagacctaaagctcatagtcctgaccttgaaaaactttatgatctagtggggatgattccaaaaggtttccatgggttttnaattgggcttaaaaactactgaatctggtctccaaacangctttccggggaagnccattaantaggtggagatcccccctttctagccatctccccaatgtcatggagtttanggacagagcagtgaatgtnccanttatctcatggataaggtcaaacatacacttgataggaaaaacacaacgtangtgtccccnggggaccctctgagt

SEQ ID NO: 529337 - DNA, 434 bp, Homo sapiens
cgtgtacagggttgctggttgcagtgagccaagatgcaccactgcactgcagcctgggtgacagagcaagactgtctcaaaaaaaaaaaaaaaaaaaaaaacttccccaaaatgggttcttttataaaaaaaaggggtttaggggggctcacagtcccacctggctttgggaggccccccattctgggtggagggcaaaccaggagtgagggcatggtttacataggcgacaggcacaaaatgtgtgtgcgggggacctggccgtttgtaagatcatcagatcttgtgagatttatccactatcttgagattagcttgggaaaaacccaccccaatgattcatttacctcccacgggttccttcccacaacccagggggttttggggagctatattccacgattgagatttggggtggggccacagccaaacaa

SEQ ID NO: 529338 - DNA, 148 bp, Homo sapiens
tatagaaacagaagacgtaccacatatgatgctcaaaatgtaccagcataagcacttacaaaataacacagttgaaaaggagtagccttgagaaactctcagttcattccattgaccaccatttaataaataaacactgtaccaggat

SEQ ID NO: 529339 - DNA, 191 bp, Homo sapiens
atgaccaccaatcacatgctatcatatagtaaaacccatgccatgatccctaacagtgtgcctctcagccctcctaatgaactcctggctagccatgtgatttcacttccactccataacgctcctcatactaggcctattaaacaatacactaaccctatatacaactgatggcgcggagtaacacgaga

SEQ ID NO: 529340 - DNA, 200 bp, Homo sapiens
cttgtgatgagcgatcgagtgctattatggctaggacgcctcctagtttgttacggacggatcggagaattgtgtaagtcaataggacatatcattctcggcttcatttgaggaggggtgtttaacgggttggctaaggtataattgtctgggtcgccttatgattgtctggcttagaatcctgtttatgtctttcagga

SEQ ID NO: 529341 - DNA, 205 bp, Homo sapiens
cccccggggaaaagaaaaggttttgtgaggttttgccccccggaatttttaggtatttccaaaaaaattttgccaagtttttcaaaatgggccttaaatttttttccccccaataaaatttatgggaaatgggaaaaaaaacggggttttttttttttgaaccctcccggtaaagattttttaaaaaaaaattttttacccccca

SEQ ID NO: 529342 - DNA, 277 bp, Homo sapiens
  misc_feature (14)..(14): n is a, c, g, or t
actctagaggttanctatggacaatgcgctacgcggtgcttactgggcgcaagaaggccttctcggagatgtgcgcggcgctgcgccagcggctcgaggaagcccagcgcaagggcggcgagatccaagagatgctgactgcgtcgttcgccaagctcaacgccgagtacggattcggcctggccacaccgaaggcgcccgacctgacgcgcttcatccgcgacctggacctcatcgagcgcaactacatgcagtaccgcgtagcgcattgtccata

SEQ ID NO: 529343 - DNA, 806 bp, Homo sapiens
tggaaacagggtctcactgtcgcccaggcgggattgcaggggcgtgatctcagttcactgctgctttccctccgttgggctcaagcaggttctcccacctcagcctctcgactaacaggggactataatctggcagcaccatgccgagctaatttaatttttggtaagaagatagagctctcactatgtcacccaggttcgtctcaaactcctgaaccctagtaattctcctatctcagcctcccaaagtggctgggggttacaagacttagacgccactggtggcctggtctaaacttggtactttcaactggtccatttctccctggtctggtcccatggggcactcataaaaaaacaagaatggctcccaatttaattcatcttccaagcctgtagctctgggaatactcactggttgcaagtcaaaacgctggattccatcatggaggtttcctcacgtttcacatctcactcatcaccaagtcatgtgggggtaaatttctggataaacccttgaatttaccggtcttctcaatcctctggtcacaaaagcctcaagtgagggtcaaattcaacattatcctgatctagacaggccccattctcaatccacccttttccacgttgatggcccaaggacttctaacaataaactctctttggcaccacagacttcttggaaacatatacatgctgtggaccctctctgtaaaaaaccggaccacttaaaatttcaccatcagattccatgggtcctggggttccccccgaaagactatccagggttaatagcatcacgaata

SEQ ID NO: 529344 - DNA, 2022 bp, Homo sapiens
ggccaacacgtaggcgtgtggctgtaggtcgttctagtaccaacgtatcacttgtcttgtatcgtgtctcctctgtgctattggtgtggatcctcgtctgcccgaatgctctcgggatcagtgtagcagaaggtcagtgattccaggtgtgtccgagtgtggtacctgagtgttaaggagtatgtactggataaagaccacatgtgtatacttcgtctggtccacgtgcaagaactgctagaccaggcagatatagggaaagaggactgaccaacaggagtgcaacgcgaagaacatggcacgtttaaagactgcgtgcaatcgcagtcgcgcacgaggaacgatatgcacacgcggccatgttcgcaaaggagagcagacaccgtacacgtcatgatggcgtgcaccgtatcctgtacgcattaaaagaacacgacggtgaacattgcaggtgggtgcgtgacatccttggggaatatagctctgagatacttggaagctcggactagcaagtcatccctgagcgggagataaatatcccaattcagaccgccttgctagaggtccctatggcacgaagaggtgacgcggctcccctgactatgtgccatagacctgaacggaggaaagtcgcgggccaaagacgccttagccgaaagggaaagaaaaaccgttacgggcgtcgagaactctctcatgctgggccacagttgtccagccttgaggatggccccagcggaggcaaccatatgggtcggaaacgacttggaggaggccccaattccatgtgtccgaatattacgtaggctcgccgtgggcgcttaatccaatgtggcgatatggggactctttaactggcgaccacggcagctagttagggcgggcaccataggaggggtgtcttccttttgcggcggaaggccttcctaccaaataaccaatagagggaacagcctcgcggtgaggggcacgccgactggcgcgcacttaattagcgtaaaccagagggacacagggcgtgtacatagtgggacgccttggggccacttggcccccggaaaggcgaatgcggggaagtataacctaggttgaccattaaggataccccaaaaagcccgctcctgaaacggaagataaagatggggggacacgacgtagtttaaagaggccttaggcctgggcggaatagtgtatcgcccctctaggacactcctccaaccggtgaggaaaatggctccgttgggggcgccaagcggtaattcagaacgggtccccagtccgtggtgtgccctcggcatgtgagaaagcaacacaggccatggggctgtacagaacgcaaggaccatctggagattttccaacagacagccagttaaagagtgtggagacaaagatacacccccaaagagagttccaagggcaacagctcttccacttgtttctcccgggcactataggagatgttgtcaccggcgagtgtgaggccagaaagagaacgacccccctgtatgggagggaaaagagatcccccgggagcagacaccaaagggagcgcccttcggtcagcagaaaagcgggaaacccgttggggccaactgagcgctttcaaaatccaacagggcgagaggcagccaaacagacagcggatttggtgcgcactcagaaacttactggagcggacaccgaagaacacctaaagacagtgtggatatgaaacgaacaagctacagggaggagacgcgagaacacccgcgagaaaatggggacagcccccaagtggcccaacgacagcacagacaaccacaacgagaggaggacgagacgtcgatgtgctgaacaccagggatttgaagaggacaccgtcaacgtgattgacacacacagggagcagaacccgtgttgagcgagacaacaaccacctgggggagtcaccacatcgagagcgcagaggcaagagaagaggacaagatagacgagaaacgaaagcactcgaaacgatcagacaccaaccgaggcaaccaa

SEQ ID NO: 529345 - DNA, 1108 bp, Homo sapiens
tgctggtctgccctcggatgtatccgggatcggggctgcagtggctgagctgcgatttgcgcagatgacccccgctgggggctgcgtgctgtgccgtgagccccgatgagtcccgagctgtccctggccgcgctggcagctgccccctgtgccctgttgtgagaccccgccgtgttgacccagcccgcaacgactcgctgctgccacgcttgacccggccgtgcccccctacgtgaagcttggctcaccgtcgtctacaccgtgttctacgcgctgtcttcgtgttcatctacgtgcagctctggctgtgctgcgttaccgccacaagcggtcagctaccagagcgtctcctctttctcttgcctcttctgggcctcccgtgcgggaccgtcctcttctccttctactttcaaagacttcgtggccggcacttcgcctcagcccttcggtcttctggctgctctactgcttccccttttgtgcctgcaggtttttcaccctcaaggctggatgaactatgtacttacacgcagggttgatctctccaacggcgaagttcaaagtatttcctccagcacttacgtccaattaccggttaggcccttctaccctgggacctcccctcttcatcaggccttggtcatcgccttgttgggcgcatctctacccttgtgctgtcatgcctggcttaccagcgacgtggggcaaatcttcggccgaaaccgcaccgggtacatcggtcatccgctgttcgcgaattttggcccattaactgtcccaggcggaccattcggtcgaccagttgtgtccgccggcctcctcctctctcccgacccggtcagtacttctcgcacaacccccctccagaatgtctccctatggctgacagctcttatacctttggcggagcttccacagctgggtctcctcccgcgtgatgtttcccgagctcactttgccatctgcacttcaccgagtgtatactgtccttatcgcacgcccttcggggcctgccttacaaccgtgtccatcgcctctcttatcgttcgacaccacgagacgtccccatcccttggaactgacgcgcgccacacgctgttaccacctc

SEQ ID NO: 529346 - DNA, 403 bp, Homo sapiens
cgtggcatgtctgatgtgccatgtacgtgtctatgtttgggcagtcggtgctggtggtccttgtgcccatcgtctgcgatctggatccgtggcaggcgaattggtgtcgggccatgcctctgggtgcatggccggtatctcagccaaggttggcatatggagataggggaggtggaatgggacggagctgtctgatgtctacctgcgtgcatattctcaggcctgattgagaggcgggtctctgctcagagaggactgaatttagactggatctggaggcatgatactccagtgaagagctgttgcgttcttgccttttcagctgacagtgctggctcaggtgataggcctcctgtccccctcaagtccctagtgccgcttcattcctcctcctttgggcccc

SEQ ID NO: 529347 - DNA, 191 bp, Homo sapiens
  misc_feature (14)..(14): n is a, c, g, or t
  misc_feature (128)..(128): n is a, c, g, or t
tcacccgacggggntggctccaacccggtaattattttggattttttgtagagatgggatctcaccatgttgcccaggctggtctccaactcctgaacttaggcaatcctcctggctcagtctcccanaatgtgctgagattacatggcacgctgccaccttctcccgtgtttacttgataaagcattata

SEQ ID NO: 529348 - DNA, 293 bp, Homo sapiens
tttacgcagcttcatgattggtaaacgtgtgacgggtggtggcagaaattgaccaacctggggttagtatagttaattaaactttcgtttatatggtaaaggttaatcactggtgtttcccgtgggggtgtggtaagctaacgttttgaactggattggtgcgtgcttgatgcttgttccttttgaatcgtggtgaattagaaggtgaactcactggaacggggatgcttgcatttgttatcttactaagaactaatagaaaggctaagaacaaatctatgtctgcgtaaaag

SEQ ID NO: 529349 - DNA, 122 bp, Homo sapiens
ttttttttttttggggggaaaaaaaaccccccccccccctggggggttggggcaaacccctttttgggccgggggggggggtccccccccttgggggaaaaatcccctttttttttggggga

SEQ ID NO: 529350 - DNA, 105 bp, Homo sapiens
gatcgagaggataccagactgtggtgatccacagcgatgtaccagaggaagggcccatgacatgcaaggcaagcgcaactcaccctcgtcctggcggtattgggg

SEQ ID NO: 529351 - DNA, 102 bp, Homo sapiens
tcccaagatgaggaattgggtcagggccacattgaggaggtagattaggggcctttccaagattgctgttttgtttgggagcttcaagactttgcatttcct

SEQ ID NO: 529352 - DNA, 760 bp, Homo sapiens
gccaaggagacacttactcaattgaccagtacactccattcgtgtggtagtggcagcccacatagtgatgactgttttaattttaacatcatttggcagccaacctttctgtcattcgtttggtttttaacaccacattaccaccccagataacagggtgtttcacgaccccgattaggtcaaacattatcaaagaaattgtagatacgggttggccttgggggtcaattcttagtgcacaccacttatttatctgtcaatttatttagacgggctcgtaactcctgaatccttgcttccctcaataactttggtgtaaccagatctatgtgtaacatcaaattttagccacttaagaggagttcacttaactcctctgtatctttaaaagggatatcataataatgtccatggttgttggagaatcacatgagggataatgcttttagacacttcccactgacaatcagtaaaagttttccttttccactcattccctattttatctaacccagatgcacatctttcaaataaacagaaatgagatcttcccaaaatatgctggcttcctccaatcgccaatggctggctgtatctggagggtccatccctattaacttaggagatgagtatccaaacccaattatgggccaaatcctttgtccaaagaccttgctctagaagacaggtttatattttcctataaattctctcaaagaaaatgcagaaaatattgtccatgtggttatgcccatggtat

SEQ ID NO: 529353 - DNA, 137 bp, Homo sapiens
ccaggattcctagggtcttagggagcaccctgcgttggcaatgctgacttataaccacacaagcgaatctctgcctttcgagctctgcgagcactcttatctacatacggatgaaggtatccggagtgcgcactggc

SEQ ID NO: 529354 - DNA, 132 bp, Homo sapiens
  misc_feature (95)..(95): n is a, c, g, or t
ggctcatatccctctagaggagctgttctgtaatcgataaaccccgatcagcctcaccacctcttgctcagactatataccagcatcttcagcanaccctgatgaaggtcacaaagtaagcgcaatgagaga

SEQ ID NO: 529355 - DNA, 422 bp, Homo sapiens
  misc_feature (104)..(104): n is a, c, g, or t
  misc_feature (253)..(253): n is a, c, g, or t
ccaattcacaaaaatgaaagtagggaaatgattaacaataatcataggaatctaacaatccaagtggcttgagaatattcattcttcttgacagtatagattcnttacaatttcgtaagttccaatgtatgttttaggaatatgaggtcattactattcataatctgatacagctttatcctaaggcctctctttactacactgcatcatagcttttttgtgcagttggtctttctactgttactgaacagtnagcaacctacagattcactatcaccaaccagccagttgatggatcttaagcaaattatcaagcttgtgataacctttatatatttctgcctcattccttgtagggtttcttcagtgcccgtggtcatcgaccccttgacaagaagagaggaggctcccagcctgggcct

SEQ ID NO: 529356 - DNA, 193 bp, Homo sapiens
gctgactctagcaggaccccagatgagcaagaagttcgagatgacaaccgccccaaaggccgagagtaacactacgaggaggaagaagaggaggaagaagacgaggctgcagctgctgagaaatcacatcgaagagctgaaatgtagcggcacccaatttctagacaacgctcagccaacggattcttttcaa

SEQ ID NO: 529357 - DNA, 244 bp, Homo sapiens
cgtgtttatcatcccaggaaatattcatgatgagagcttatagattaatcactcaggaatatttaatgatctgcgacatgtttgaaaccagaatctatctgggagtatcattgcattatttcataaacagctagataaattccatattacatttctgattcggatgttcatagttctgaaagtatcttatctcttcccctttcgtattagttatatcggatttgacttttatttttattttttt

SEQ ID NO: 529358 - DNA, 113 bp, Homo sapiens
gtgactctacaggatctgattcaatatcagctctgtcataaactgaagttccataaatatatatattatctgcttttggactctctattctgttccactaatctacatgatca

SEQ ID NO: 529359 - DNA, 114 bp, Homo sapiens
cttcatttgcaggatcataaaaggggaatacaaatatttgttagcaaaagggggcatttggtgtgacagagtcgagagtcactgctctagcaagcttcccctcctagccaccag

SEQ ID NO: 529360 - DNA, 127 bp, Homo sapiens
  misc_feature (2)..(2): n is a, c, g, or t
  misc_feature (10)..(11): n is a, c, g, or t
  misc_feature (72)..(74): n is a, c, g, or t
  misc_feature (88)..(88): n is a, c, g, or t
tngtttcccnnattctgtccacttctggtgtcaaaagatttttactcatcttcttagtacattctatgtatnnnatatgtataatttnatacaattaaaaatagatttttgtctagtgaaaaaaaaa

SEQ ID NO: 529361 - DNA, 853 bp, Homo sapiens
ccgaaatactacgcgcgtcaaggaccatgacggaggcggagcagcagtagctcatcgatgaccacttcctcttcgagcaatggcccgtgtcgcccctgctgctggcctcgggcatggccggactggcccgacgcccgtggtatctggcacaatgacaaataagaacttcctgggtgtgggtcaacgatgaggaccacctgcgggtcatctccatgcgagaaggggggcaacatgaaggtgaggttgttcacccgcttctggacctggcctcaccctagtattgagaactcgtcttcaagtctaaggactatgagttcatgtggaactcctcatctgggctacatcctcagcatgcccatccaacctgggtcaccgggcgtgcgggctatggtgtgtcgatatcaagctgccaatctgggccaagcatgacaagttctctgtgagtgtgcttaaagcggttgctgacttcggaacgcgaggcactaggcgggtgtgggacacggctgcggtgtggcgagggtcttcgacgtctccaatgctggccgccctgggcttctcagaggtggagctggtgcacgatggtggttggacgcgccgtgaagctgcctcatcgagatggaacaccgggttggatgcgagggccagggcatcgacagaactcatgcttgccagaaatgaagccgggccacaaccgaaacagccgtgttgggtcctaacgttattgcctggcaggtggcagcatgcaccctgatggttctggcgctggtgagcccttaccttgtgtaaaaatccgtcaccgtggtaaaaaaatatgatggcggagaacagggctggggaaaaaccaggttggctg

SEQ ID NO: 529362 - DNA, 187 bp, Homo sapiens
  misc_feature (134)..(134): n is a, c, g, or t
  misc_feature (180)..(180): n is a, c, g, or t
tgatacaatcgagctcggtaccagcgtggtcgcggccgaggtacatgatccaagcgtgtcttatgtttcttttatccaaaatatctaggcatctgacactttgaaccaaaatttcaattgtatactgtgatttntatttgttgcaatatgttaaatttcagaggtacctgcccgggcggncgctcga

SEQ ID NO: 529363 - DNA, 114 bp, Homo sapiens
agaagagtcaactgctgatgtcgacaatttccaatttaatagtccaaaaatgaaaccataactcttaagattacaagccatattatagaaaaaattaagaatacgaccacattg

SEQ ID NO: 529364 - DNA, 1129 bp, Homo sapiens
gttatgaataaaagtgggtccgcgaagaggagattgacataaaaaaatattcacagatgtggacccagattgcctggtgaggcatccatggcaacgcactctcgtgctgatcttgcgtggaggtcatgcattaccaacggtatgtgatcccgatcgctagcgatattgcaggctgactaagtgactcgataggaacaccgtcgcattggtgctcgctaggaatatcttcgtcgtggaaatacaaggaagagggagacagcgcgagacgtggacgatgtggagattacacggcgaggaggacttctaactccgaagttcgtccatggatgcgacgtgaagtagctagcactccaggcagactcatgctgtagggaagcgaattatgccaaacttgtaacgacccgaattgtggatcagtcaacatggaaaacagggtcgatctcaagattaaaggcatcgaagccgacatacgcggttagtgacggtgtgccaagtactctagcagccattcactgctaagaagttccggtacagaaagcaacatagtatatccgcatttgcataggaagaccgtgatggaagagcgccagagaactagatcatgcgcgacacaagaacggaaacttcgaagaagcaacgactagaatagatatgggcaacacgggacgcagcgccctggttatggacacaactcaacgtgacacacagttgggaaggaatgaaactacttttcacttttcatgcacctgaacctgcacaaagagagcaccaaagggccctggccaccccaacttacatcgcttcacagcgcgagcgcgcctaaaagccacacaggcaaggaccgttccatccctcccgcagcaccaggattacggacaacgccgcccaaagcacgcgtcccagagaggagggaactaggcacagaacggccaaaagagtagggtacgtacagagcaccaccagggatacccaccacattggcgaagccacgtcacagcgaccagtcggcactgggaccaaaccaggaagagaactggggagaggagccatcacaggaaaaacattgggccataggtggagaacccaactaggcccgactcgcaccagcaggagagacacaacgacaaag

SEQ ID NO: 529365 - DNA, 105 bp, Homo sapiens
catcactcgatcgcggagaagagcaatgagggggagaccactggaaatccgggagatggagacgagggagagggagacgggatgtttgatcttttactcttcttt

SEQ ID NO: 529366 - DNA, 570 bp, Homo sapiens
ccaagcgtcgtgatcaccagggacctagggagatccccttcccaccctctctgttgtgcgctcagagtcactcctgccccctctccctgagttggtgctcagcatgcatcctcactagggttatgtgaccaggggtctggcactgcagcttggacaattttgaacgtgacactttgagcttacgtagtcatctaggaaccctggtgtttttaccagtggttccggctcgttaatcatgcttttatggctggtgctcaccccgtcgattacaaggaccgctatatatcaagcatagaacactatacaacaaggcgggcgaccgccttctctgtaatggagtctttgcccccctctcagatgggtgacccaccaaaaggccgttgaccgcgacgtgtcaccccaggccagtcttcgatgtgctccgacatagggggagccgccaattatccgatgaagcctccgatctatgtatcaacctccaaagtgcgaacatgtgcgccgcctgccgtgtcacacgaaacggctgcggggcccggtgtggcacaccaccggtgtatgcgcctttagtga

SEQ ID NO: 529367 - DNA, 210 bp, Homo sapiens
tcacacagcgtccacagactcggccctcgcaccattggctgatcccgtcctccggaagtaagaccattccgtatgcgtgtcttatgtatcagacttatgaatagagaatatcagtaacttattaatgcgcgagagtgaacaatcagcaagacactaccagctccacgttgacagaggctgaaatatataaaataaaaaggtttgcggccg

SEQ ID NO: 529368 - DNA, 409 bp, Homo sapiens
ttgggatgtagtttttggaacatcaggtatgtgaacttttgatattaaatgtaaaggtaaattttacttcatgtaagatttaaaaatattcttgaggtggtcatttggattccattactagttattttatttaatacttttatacctatgcctcagagtttgtttatggggtaaaacaaaagctagcagtaatatagatatatatatactagagtatgtattatatatattacatattttatctataagatagactatgtgttactctaaagaattatatattagatgcaccctccaattaatgtagttctgaatttcttatactgaaaggattatagtatcagaacttcaaaaggttattcatgaacagtaatcagtaataataaaaataaatttattcataaataag

SEQ ID NO: 529369 - DNA, 208 bp, Homo sapiens
ctatgatggactactcaagatcggagcctgagcgcgctgtgacgctggtgctgagactggctaccacattgctgtgctctacagagagctcctgggacgcggccattacatgcgcatgctatgcccaattgcacaacgaatgccctctcttccatgagcctgaacctttcactaagcaagaatgttatgttgtttcaccttgacgagt

SEQ ID NO: 529370 - DNA, 354 bp, Homo sapiens
gggggagggtttcactgttacataccaagaggccctgaaaagaggaaaaaaaaaaaaaagaggccaggcattggttggctcaccccttgtaattctcagcactttggaaggctgaggcgggcggatcacaaggcccaaagttcaaaagcagcctggccaacttggtgaacccccgtctctactaaagatccaaaaaattacccgggcgttgttgttgcattgccctgtaatccaaaatactcaggaggctgaggcaggaaaattcgcttaaccctggaaggcggagtttgcagtgacccgagatcatgccattgtgcacttccagccgtgggcgacagagtgagactctgtctt

SEQ ID NO: 529371 - DNA, 358 bp, Homo sapiens
agcatactctgcttttattagaatgcaactttcagcgtacatggagaacgattgtagtttactttgtcgcacgctttatccacagttagacaccatttcggaaaagtgacattatcaatagcaaatgctgttcaagctagttgagaagcctataccacacccctgaattggcttgcattttgtaactgttatgcacacagtggtgtttgtttaggtgctgatatggtttgggtctgtgtccccacccaaatctcatgttgagttggaatccccgatgtttaaggtggggcctggtgggaggtgattggatcacggggctgggtttcttatgaatgctttagcaccatctccttgatgc

SEQ ID NO: 529372 - DNA, 830 bp, Homo sapiens
ccacttcaaatggtggtagtacccacgaaatgttgggttaccgcggcaaagtttataccaaaggtttcttaaaaagggcgaccctcttccgcctcttttgttaattaagggggggaaatattatactctgttaattgcgccccccaaaattgggggaaaaggaggtgtgtaacaccgtcgtgtcggtcgccacacccgttgtgagatgattttccacccggcggagtttaatattgtgtgactcccgagcccactttgttcaaaaaacccccttgtctcactatatggttaccccgccccttgtacagaaaccccgccaaaaatatttgtctcccccgaaaaaaaaaatgtggtttccaacacaaatctgcccgaggaaagcggtcgccacctcttcctcgctccctgtaacactcttctccgccacaacacacccatttttttgaaatggaaataaaatcttctgtcgagaagtaatacctcgtgaatgtagtacaccccttttgtctcctctcccttatctcaccgtggcaccaccccaaaaagtatgagatatacaaagaatcgggtttttcacacaggttccttcccctgataacaacaacctgctgcttctaaatggtccctatactcttgtgttgtccccccaactggcttgcccccacctcataatttttcacacgccccaagccggtatttcttatcatttttggtggagaaaaaaaagatttcctgagatttttgtttttaaaataaaagcttaaaataatctggttttgccccttaaaataaaaagcccaccccgctttccggccccccaaccccaaaaa

SEQ ID NO: 529373 - DNA, 120 bp, Homo sapiens
tgacatgggttatagatgatgtcgagcggcgcagttaatggatattgcagaattcggcttagggtaaatccagcacatgggcggcagtactagtggatcggagctggggacatgcttggt

SEQ ID NO: 529374 - DNA, 534 bp, Homo sapiens
  misc_feature (52)..(52): n is a, c, g, or t
  misc_feature (107)..(107): n is a, c, g, or t
  misc_feature (119)..(119): n is a, c, g, or t
  misc_feature (196)..(196): n is a, c, g, or t
  misc_feature (205)..(205): n is a, c, g, or t
  misc_feature (222)..(222): n is a, c, g, or t
  misc_feature (278)..(278): n is a, c, g, or t
  misc_feature (340)..(340): n is a, c, g, or t
  misc_feature (390)..(390): n is a, c, g, or t
  misc_feature (408)..(408): n is a, c, g, or t
  misc_feature (430)..(430): n is a, c, g, or t
  misc_feature (456)..(456): n is a, c, g, or t
  misc_feature (460)..(460): n is a, c, g, or t
  misc_feature (470)..(470): n is a, c, g, or t
  misc_feature (530)..(530): n is a, c, g, or t
gctttccctccctccctcccccattgcaccccggaactcagcaaaggtgagntagccacagagcataacactgtggctgggacacatgtccatgtgtgtttctacanaagtgggcatcngtgccacaaggagtcatgtggcaccacagttcatcagactgtgtttaccccttcctgccctgctgtcagcgccacangttggaggnaaagacctggcgctgangagcagggtcccaggcatggacccacccacccaacagtggagcatcaggagccatnaaaagcatgagagcagtcatgaggatgtccagggcctggctcgctcttcggctagccatggncttaaagagggactcgcccgaggcctcgatgtaagtgacagtgatctctntggagctgatctccacanaggcaaagccacccagtgagtnttcagtcccatagtggaagcgcaganagcngtaggcgganctatgcgctgcgtgccgctttgaggggtccatgaaattcccagccccactcagcacgtanccca

SEQ ID NO: 529375 - DNA, 274 bp, Homo sapiens
tgtagaggtcaggacatgtgagagtccttgtctataatggggcgggacagttggagcccagtgatctgggatgtggaggaacccctgccatgctgggaagtgtcagaccttagatgaggtgtggagggacctggcggcctggtgagtgagtgaattgagacccggtgtggagggacctggctcctggtgagtgagttaattgagatgatgtatggagggaccttgtctcctggtgagtgagttaattgagatgaggcttaagggaccctagggg

SEQ ID NO: 529376 - DNA, 126 bp, Homo sapiens
aagcatacccctatccttgcttatcatgaatccaggccaattgtcttggtaagacaaggtatgtgggctgggcgtggtggctcatgcctgtaatcccagcactttgggagaccgaggtgggaggat

SEQ ID NO: 529377 - DNA, 262 bp, Homo sapiens
  misc_feature (13)..(13): n is a, c, g, or t
  misc_feature (105)..(105): n is a, c, g, or t
  misc_feature (112)..(112): n is a, c, g, or t
  misc_feature (139)..(139): n is a, c, g, or t
  misc_feature (204)..(204): n is a, c, g, or t
acaacataccgcncaagctatgttgcataaagtttggaaggaatttcataacgtggttctctgaaactgtggaaacgaatgactttcaggattttacaggatggnatctgtnctattgtgttgaaaatcactgttacangacataaatttaactggaagaattatgtgtttgcatagtcactgttctgctgttccacatttttnaggagttatacatcacctttagttctgcaaaatggacagtggtatgagccaaaactca

SEQ ID NO: 529378 - DNA, 227 bp, Homo sapiens
  misc_feature (227)..(227): n is a, c, g, or t
acggcccctcgctggcaacctaccaagtccggactgaggccaagaaccagctcttgggggacattggtaacaaagtcagtgaacactgcaggccaaaatgctatgaggagggagcaaaccttcagctactggaaagtcattgataaaaactaccaaacctcttgaaaggtacctatgctggtgcagttcagtgtcttagcagttcagaccagaccttagcagacctn

SEQ ID NO: 529379 - DNA, 231 bp, Homo sapiens
tctgcgagatttgagcgggatcttgaagtagctcttttgggtggaggggacacagaacgggcctgtgagggtggagcaggtagcggcgaattggagcgggactgtctccttgatctggattttgactttatatcaccctttccatgttctttgggggatcgggatcgagatctgcttcgagatttctcatactcagccttagatcggcttggagaaggtgaaggggaaatg

SEQ ID NO: 529380 - DNA, 875 bp, Homo sapiens
  misc_feature (373)..(373): n is a, c, g, or t
cggtttatagatgaagaaacaattagtgcagttgagtgaattgtccccctcaaataatctggatctgtgtgaccagtggctctctcctcaatagcaggctgtcctgaggaactcgggctgaacttagtttgggggagtccctcttgtgtgccaggcactatgccgggtgctgtttctttgctttgtagctttgtccctgtaagatcagcttcaatgccagagaactctacctcttgggcaagactgactgtaatccatgttactttcgcagcgttcagtggctcgctgctgtccacaggatgaagttcaggctctttggcctgcgcatagcctctctggtcacctttgccacccattcctcaccgggtgcttngcgctgtgtcctgctgaactagttgtagtccttatccccttcatattcaggctgtgcacctgacaaggcgtgctcttctcccctttctcttgcctgctaagttctactcattctcttcatggcttacctcagatgtcccctcctccaggaagcttccctgatagccactgcccccactccaattagatcgtgtctcacggtgcatctcttgtcatagcatcatcccatgctgtatctacacgttcatcgctcctcttaggctgtaaccttcttgagggccagaaggtatcttcactctttcccagcaccttggtcagaacgtcggtaccccgaacccaactgcaccccacaccaccactgacgcagacggtccacactgatcacaacgacgcccatacaaacacaaggaccactaaacatccaccgacacccctccgtaacccaacagcatgcgatacgccagggccacaacggcccatcataacccagcaacggacaggga

SEQ ID NO: 529381 - DNA, 364 bp, Homo sapiens
cgagacggacagactggactaaactccaagtggagaaaacagaaggatcaactttatagaccttatcgcatgagcccatatataatccttcagctgctgtgtcccaataatccacatcagaaagtgactgtctgcagacaccatgggttatgcataatcacctcctgcagcatcttagtgtctgagaactaaactgagcaccagactgtctcagtaacactttaagcacctgcacataatgtagctcctcaatcccagcactttgggaggccgaggcgggtggatcatgaggtcaggagatcaagaccatcctgcctaacatggtgaacacccgtctttactaacaatacaaaaaaaaaattga

SEQ ID NO: 529382 - DNA, 702 bp, Homo sapiens
gccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaacaaaaggcacaaaaaaaaaaagcgcggtaacttcccctctcaaaggcaaaaaacccttccccaagcccaatcccggggggcgcaacacaaaacaaaaaccctgggcgaaaacaaaaaaaaaaaaaaacaaaaaaaaaaaaacacactgtgtgggcggggcgcccgcgggcccctcggagaaaagatcttttcaacaacacatcggggtgggcgcgcgcgggggccccagatgagcggaagaggagaacacgcgggggacaacaagagggtgcactacaagcggagagacaccggggagacaagagcaaaaggcgcgcgcgggaaggctctcctcccacccaacatcaaaaagagaaggcggccgcgggggggcgacaaccgcgagcgccgcttttcgtcgcgacacacacaacccccaagaagagaagagagcacacccggggagggccaccacaagcgcagggggaacaccatatcaaaagcggggggagcacccccagacgagaagcgcgatcggactatacaaaaattataagccccccgccgcggtgcgtat

SEQ ID NO: 529383 - DNA, 362 bp, Homo sapiens
tcccgtttggagtgcttgtgtctggagagttgacattgtccaaagcaggcgaacagctgtgtatgggtatggatgaaccctacgtcctagctgttgcttggtgtgaaaatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcaga

SEQ ID NO: 529384 - DNA, 317 bp, Homo sapiens
gaacttttaaaagcccccccaaaaactggtccggggggccctaagggtttcaggttggaaaaggaattaatttccacgttggttcccaaaaaggaaaaagggtggaagtaaaaagtttccttattacccgcccccccctaaaaaaagcctcccctattttttccaacccctttacccccatggggagttttgataaaaaaaaaaacttaaaactttgggaaagggtcctttgtccccccggggaaagggaactggtctttttcccgttagggaacgggtttggtttttttttgtaataaaaagggggttttttggga

SEQ ID NO: 529385 - DNA, 116 bp, Homo sapiens
  misc_feature (13)..(13): n is a, c, g, or t
  misc_feature (19)..(19): n is a, c, g, or t
atcttctgcaganaaaaanaggaacagccaggagtacaattatctctcctctcttttaaatacacccagtattcaaaacatcacttgatataccaagaaataagagtaaatgatca

SEQ ID NO: 529386 - DNA, 685 bp, Homo sapiens
  misc_feature (267)..(267): n is a, c, g, or t
  misc_feature (281)..(281): n is a, c, g, or t
  misc_feature (295)..(295): n is a, c, g, or t
  misc_feature (306)..(306): n is a, c, g, or t
  misc_feature (381)..(381): n is a, c, g, or t
  misc_feature (383)..(383): n is a, c, g, or t
  misc_feature (389)..(389): n is a, c, g, or t
  misc_feature (400)..(400): n is a, c, g, or t
  misc_feature (418)..(418): n is a, c, g, or t
  misc_feature (442)..(442): n is a, c, g, or t
  misc_feature (471)..(471): n is a, c, g, or t
  misc_feature (476)..(476): n is a, c, g, or t
  misc_feature (502)..(502): n is a, c, g, or t
  misc_feature (550)..(550): n is a, c, g, or t
  misc_feature (609)..(609): n is a, c, g, or t
  misc_feature (611)..(611): n is a, c, g, or t
  misc_feature (617)..(617): n is a, c, g, or t
  misc_feature (620)..(620): n is a, c, g, or t
  misc_feature (656)..(656): n is a, c, g, or t
ggtcgcccggatccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactancaacatctctgagngtgaagggtcacangagctgcaacntgaacatcttccgagctcgatttccagccacagcaggagctgatgcttcaaatcaccaatgcctccttggggctncncttccngagacagctgntctactggttcttctatnatgggggctacatcaacgcctcanctgagggtgtgtccatccgcactggtctngagcnctcccgggatccgctggacggatganagtgtccaatgtctcctgccaggcctctgtctccagaatgcacgcggncttcgggggaaccttcaagaaggtgtatgattttctctccacgttcatcacctcagggngncgcgtnctnctcaaccagcagatctgccctgtcctctaccacgcnggtaggttcctggctcaactccctcctgg

SEQ ID NO: 529387 - DNA, 950 bp, Homo sapiens
cattgatatacctgtggttcgcgacgagcacccccgtggttctgtgcgcgtgccccttgatgtccaataggagactgctggaaattgactagatgatttgtgtttgttcaccattataaaaaacgagcggatgtagtcggctccgtacatggcatcgatagcatcactagatggtagctccttgaatggtcagttacctggtgtctattcgaaagcatggagtccaggcgaagtcgatatccaaattagggccccgtctcgtgaaggggtatgcctccccaaattgccaatccttgcgttttgaaaccttggttggccgggggaccttgattggatacctcaatgaaagatcctcacagaaggagggtaaaagggtttcaccaaccaggccgaggcgggaaaactcgctgcggtgacattaaggacgacagcttggtgctaggtcgccccgtgaatttcggagccaatgagatggccaacgggtttgcttacacagctcctccccttggaaaaaaagctaagagctgccttgagggccatggttcactcaaccattgcaaatggagcgggttcacgctgcccttgagggcacctcttccagcttcctctccgggggatggaagtacttgtggcatccacgaaaataccttaattccaatatgatgtgtgacgtgacattccgcaaaaactgtacgcaacaacaagtgtgtttgggggcacacattttacctggatttgcagaaggatgcagaaggggatcattgcctggacccagcacattgagatcagaacattggcctccgaaagaagaaccggggggatcggggcacactgctcgtgcacttcacagaatttgtcacaaggagtaggagcgccctatgacgaatgttagggaataatggtatttttaatatttccagaaaatggggtcgtattgggctatgcagaca

SEQ ID NO: 529388 - DNA, 615 bp, Homo sapiens
  misc_feature (261)..(261): n is a, c, g, or t
  misc_feature (264)..(264): n is a, c, g, or t
  misc_feature (266)..(266): n is a, c, g, or t
  misc_feature (277)..(277): n is a, c, g, or t
  misc_feature (296)..(296): n is a, c, g, or t
  misc_feature (298)..(298): n is a, c, g, or t
  misc_feature (305)..(305): n is a, c, g, or t
  misc_feature (309)..(309): n is a, c, g, or t
  misc_feature (330)..(330): n is a, c, g, or t
  misc_feature (336)..(336): n is a, c, g, or t
  misc_feature (339)..(340): n is a, c, g, or t
  misc_feature (343)..(343): n is a, c, g, or t
  misc_feature (348)..(348): n is a, c, g, or t
  misc_feature (352)..(352): n is a, c, g, or t
  misc_feature (357)..(358): n is a, c, g, or t
  misc_feature (364)..(364): n is a, c, g, or t
  misc_feature (366)..(366): n is a, c, g, or t
  misc_feature (368)..(368): n is a, c, g, or t
  misc_feature (374)..(374): n is a, c, g, or t
  misc_feature (379)..(379): n is a, c, g, or t
  misc_feature (382)..(382): n is a, c, g, or t
  misc_feature (384)..(384): n is a, c, g, or t
  misc_feature (387)..(387): n is a, c, g, or t
  misc_feature (389)..(391): n is a, c, g, or t
  misc_feature (393)..(394): n is a, c, g, or t
  misc_feature (399)..(399): n is a, c, g, or t
  misc_feature (402)..(402): n is a, c, g, or t
  misc_feature (407)..(407): n is a, c, g, or t
  misc_feature (438)..(438): n is a, c, g, or t
  misc_feature (444)..(444): n is a, c, g, or t
  misc_feature (477)..(477): n is a, c, g, or t
  misc_feature (484)..(484): n is a, c, g, or t
  misc_feature (508)..(508): n is a, c, g, or t
  misc_feature (515)..(515): n is a, c, g, or t
  misc_feature (613)..(613): n is a, c, g, or t
ggtcgcccggatccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttngtngnaaaaagtatgncgagaagcgtgtatgattntntctccangttnataaactcaggcatgcgcttnctcctnaannagnagatntgcnctgtnntctaanangnaggganggtcntgntnaantnnntnntgganacngtgcntgtgcgcagttctgtggacgagcttgttggnattgantattccctcatgaaggatcctgtggcttacacnagcaacntggacatggacttccgggggcgcnttcttcnccctgactgagaggaactggagcctccccaaccgggcagtggagccccagctgcaggaggaagagcggatggtgtatgtggccttctctgagttcttntt

SEQ ID NO: 529389 - DNA, 857 bp, Homo sapiens
ctagttctagatcgcgagtggcgcctttttttttgtgtttagatattgggaaatacaactttattctggattctaaacgaaaaggaaggggaatgacagtaacaaacaagatttcaccactgaatatggtgatgtgactgcagcagtcttatatatgaaactcaaggaatcaaggggtcccaaaacagtaaatatgcgggttgccaaacaaggaagttattgtttaaactaccacctacctccctcaccaaagcccataaaaataaaaaattataacaaacccggagaaccaaaaggaacgaaaatctggttcgcttcattcatggcccccacaatcctaggcctacccgccgcagtacggatcattctatttccccctctatggatccccacctccaaatatctcatcaacaaccggagctaatcaccacccaacaatggagctaatcaaactaacctcaaaacaaatggagtaaccatacacaacactaaagggacggaacctgatctcttatactagtatccttaatcatttttatggcacaataacctcctcggatccggctcatcatttacaccaaccacccaatatctataaactagcatggcatccccttatgagcggggcagggattatagggttcgtctaagattaaaaatgcctagcccattttaccaagggagactaaccgtatcccatatagtattatcgaaacatagtattattaacatagccggggagcttaacgtaatatggggccatatgccctattggggcccttgaataagataatcctattaaattcaattattatggatccaaagggggtaaagccaggtatataggcgtcgcggat

SEQ ID NO: 529390 - DNA, 137 bp, Homo sapiens
tatgaggcacagcgtttctgtcatgactgatcaggagctcttagagatggacacagatccatccattacacatgagaacatggatgcttatctatgagaggtaagatcgggagaggcacgaggcaccgaggaaatgc

SEQ ID NO: 529391 - DNA, 139 bp, Homo sapiens
agttgctaccgtccaaaacatggcgggttaacgagtttggcgatgtcagtttgtacttgttttaaccatttccttatgattcatgcctgtgttgagttgacagtgagggtaataatgacctgtttgtggaggtagcact

SEQ ID NO: 529392 - DNA, 184 bp, Homo sapiens
aagggagtataaggttccaaagggaagaaggtaataagctgatgctggcaacgatgggaataaccctgcataatatggagattccaaaacatgaccaggcacagaaagctgaaggtgctggagataccaagtgaagtgtgttcatttttgatgactgtgttacgtctgggtcctgctgtttacg

SEQ ID NO: 529393 - DNA, 1589 bp, Homo sapiens
cctgatccccaaacaaacctcacacccccaaacaccactctcaacacaaacacacagacaaacaaagcaacagcaacatgacaaagcagagaagagcagaacaagaagacagaacacagaaaacacaccaacgagaacgaagcaccatcacaccaacgactcagacacacaagcacaagagagagagcagacaaccagcagaacaagcaagagaacgagaagcagacgccaaaacacaccaacacaggacaacaagaagcagcaaacagagaaaccaccaaagcctaacacacaacacagcaaacgaagacacaaaaacaaggagaacaacgccaaacacagaagccacaaaaacacatacccacaccatcacgagaagcacacaccaacaaacaacaaaacacgaaaagcaacagaaggcaaagagagcaaagacacacacacgaacagagagaaacacagcacacaagaaaaatagtaacagacagaccacgcaaaagaacaacacacaaagagagcaaaaaaaaacaacaaaagacgagcataagaaccaagaaacaaaacagaacacaaaaaatagacaacacaaaaaacaagagatagcaacagcaaggaaatagacagcagtagaaacatacaggtcagacgagtccacatccactcaaaacatagtaaatgtaaataagtatagcaacctatacaaagaagagccaaaacatacaacaagacacacagcctagtcacccgaatacacacacgcgcaagacaagagccaccatatctctcagaccaagcacacactaaagcaacgcaaacaacaacagaagacacaagaagcagagaaagcgaaacaacactacacacaaccaaaaaagacaaaagagaccagacaacacaccgataaacacaaaacaaagagaaacagaaagacaaacccagaaacaatcagacacaaacatcccaatagacaaagcaagaaaagaaaaagtaaacatcaaaagaaaatagtacaaaaacagccgaccaaacgaataacgcacaggagaagagaaacaaacaagaagaagagcagaacacaacaacaaagacacacaaacaaaagcaccaacgacgacagacaaacgaccaacacaacaaccagaacagcacaacaagaacacacaagaacagagcacagaagagacgaaaagcaagagagcacagacacacagccagagcaaaccgacaaaagacacaaacaagaataagagaacacacaaaagacaccaacgcagacaagacagacaatctaccttacaatacaaagagaaacagagtgcacagagacagagcaactcaagcacagatagcaagaaggcgagaaccacctagcagccgcacacgaccaagaagcgaagaacacaacagaacacaagagcgagacgaagccaacagaaaagagcgcgagcacatgacgcaaccgccacccacacaaccaccgctacagagaacagcaacatccacgaacagcgcgaactaaagaaaaagaaccagatacactcagacaaccacacaagcaccgaacaacaacaccacacatgaagaaacag

SEQ ID NO: 529394 - DNA, 397 bp, Homo sapiens
  misc_feature (140)..(140): n is a, c, g, or t
  misc_feature (173)..(173): n is a, c, g, or t
  misc_feature (189)..(189): n is a, c, g, or t
  misc_feature (278)..(278): n is a, c, g, or t
  misc_feature (322)..(322): n is a, c, g, or t
  misc_feature (326)..(326): n is a, c, g, or t
  misc_feature (335)..(335): n is a, c, g, or t
agacacggtcaggccccagatggagccagccagtggcctctgtcaatatgaactaatggctgacttggactgggagccatttgtcaacaatagtggggccagatctgtccatggcaccaacctgtgaggtaggttgagcnccacaacaagcacctcaacctgtgtgaagactnagatggctgagacacnctgcatcaggcaggggatttcttttgtctttgactcaattttagatggaatccaagtgatgcagttactatgattatctgtactctttnttaaaaatggttactaaatacttgtagggtaccaataaaggaanaatntggcagttntgggatgaaagttaatagagtttttcttgttttatagtagttgaaatataatcaatgtattg

SEQ ID NO: 529395 - DNA, 1027 bp, Homo sapiens
  misc_feature (1027)..(1027): n is a, c, g, or t
ggaaaatcctcacgtgaggtgaagcgcaggcgagtagggccagacatggtggctcatgcctgtaatctcagcactttgggagactgagatgagaagatcacttgaggccaggagttcgagaccagactggccacatagtgagaccctgtctctacaaaatgctggccaaggagacaggagctgcgcccgtggtctcataagcctggctgtccctggaagagcacccagttgttccttctaggctgccaagccccactgatgatggctgagagggaacgaggacgacgacactgaggaagcctggatgcgggcatacaggggcacagaaccttgccttcccagtgctgcggaatttggctgtcaccctgtgtgtagacctctatcaccgagatctggcaaacgtgggaggcaagaccaaagccagcaaggacaggagggctgctgcgtgggccagattcacagagctgcccatccaagctgaactcccagagaccttcgtaggccttctgcatcatgggcatggacaaggcatcacctaagcggacacctaagcgtgtccgggttgctcgtagcccggggaacacagcgcaagattgagctgacgggcccgggcacagcacctcatccaacgaagggatcagtacatgacttagaaaatcagaaggcataaacaggccattcacccatgccacgcaggaaggaaacttgcaagtgtgagtgaaagtgctaccagaagtggggctgaggtccgctatgtgacgcacggcagataggagagaagataccggggaagaacaacgacgataaccaggaagccacaagacgaggggccaatgcggacgcgggacagacaggcccagggcaatcagcgaaccagcacgcatccgtgccgacccgagcgaacacaaagcaaacacgtaggacacacgagcacacgagcgacaagccagcactaacacacgcacacagaggaccgcagacaacggaacacgcaacacgagagaaccacaacgtcgctgatcagtcn

SEQ ID NO: 529396 - DNA, 208 bp, Homo sapiens
gatcgctttaatacacagcgtcatctattctttgtgttttgtaaatgatgatgctctataattggtacaaagatattcataatatattttgatgtgatctgtatccattagcattaaaatgggcctacttatgtctccttttttttttggaaacggagtttgtcgttctgttgcccaggctggaagtgcaggggcgcagctctcagcc

SEQ ID NO: 529397 - DNA, 306 bp, Homo sapiens
cagaaatctacaaatgctgcccaactcagactccttcctcaagcagcactgtggaaagcaaatttaatgatagcagtattttattaaaaggatgtattcaaaaaatatttacgtaatgttaaaatagcagaattaaaactaattctaaaaaataagagtaaatagttctttttatcagctaaaaatgtagggcctactatcaatagggttacagatctacctgcctgatttaaaatcatgcaattcttaaacaattatttgagctatttgaattatttcagattacacacataaagtgtgacttca

SEQ ID NO: 529398 - DNA, 246 bp, Homo sapiens
gataggagaattgccgatataagcgctgtgcttacctgttgatagcagcagtaacaggtctcggtccagctcgatttccagctcaggctccagcaccagcactggctcatgctaccaacacagcacagactgggagccccctcccctgcatgctgtcacttggagcgcccagaccatgagctgtgtcccagacctgtgtgtcggtcgtccctgtcgcgtctgccaacagggtacctgagctctgaa

SEQ ID NO: 529399 - DNA, 239 bp, Homo sapiens
tagatgaatattaggaagtaactgtgaagaggatatgtactaagtaagttaggaacctctgattaggcattgattgggcccaatgaagtgagggacagccctgggtattggataggtgggaggatttagactgaagaacttaaatacaagtgttgaagctggatgtgcttgatagtgttctatgagctgcaagagaggcggagtggctgcattgaagtaagtgagggtggaggtagtag

SEQ ID NO: 529400 - DNA, 415 bp, Homo sapiens
  misc_feature (32)..(32): n is a, c, g, or t
  misc_feature (176)..(176): n is a, c, g, or t
gcacttataatatgccaggtgcattacatacntcctgtggccttttgaagaaaatattattttatatgaagctcagtgtcttaatctgttttctgctgtttagaatacctgagactgggtaatttataaagaaaagaaattttagtggctcacgcctgtaatcccaccagtctggnaggctgaggtgggcagatcacggggtcagtagaccgagaccatcctggctagcacggtgaaaccccgtctctactaaagatgcaaaaaattggccgggcgtcgtggcgggtgcctgtggtcccagctgctcgggaggctggggcaggagaatcgcttgaacttgggaggtggaggttgcagtgagccgagatcgcgccactgcactccagtctgggcgacagagcgagactccgtctca

SEQ ID NO: 529401 - DNA, 217 bp, Homo sapiens
  misc_feature (93)..(93): n is a, c, g, or t
tctactccaacaagtgaccgtaggctgaaaaacaatttaagttagaggctagccacacaagaattgaacagtctattattatcaagagaatgnaaaagggaagtaagccccaagggaaatatataaaacagtccagtacatctgaaccaacagcaattgatatctggccattaaaatacagaggtcatttttgtagtcggtcaacttgtctggagta

SEQ ID NO: 529402 - DNA, 513 bp, Homo sapiens
gtacaggaatttggtgtttattaatgctctgaatgatacagctggctcaagggagaatttgtcacgactgtcatgcagcgtggctgctgttgtcatcaacgctccaagaactatccagtgccatgtctgctgcataagccatctgtgaccacgtcaagcacatttggtttggaaccccagagggagagtttgtgtccatgggctgttatctctgatggcgactcctatcgtgatcctgatgatctgctctactcattccctgttgtaatcttgaaaacagaacaaggaagttttgttgaaaggtctccctattaatgatttctcacgtggagaagatggatcttactggcaaggaactgacagaagaaaaagaaagtgcttttgaatttctttcctctgcctgactagacgatgattttactaaatgcttcaaagctgaagaatcttaatgtcgtctttgactcaagtacccaataattaataatgcttatactttaattacttgtgaaaaac

SEQ ID NO: 529403 - DNA, 275 bp, Homo sapiens
cgcgggcatttggaagagggactctggaaaacttctgtaactggttttagaaaataatccattgggttccagaggcagagatggctttttcccctaggattctgacctaagccaactaaaccccactccatttccccagtaaaatggatcgtgagcctaacccatccccaactaatttcttatgagagactccccctttttttttttttttgcatttttaatagagatggggtttcacaggttggccaggctgtctccagctcctgacctcaggc

SEQ ID NO: 529404 - DNA, 197 bp, Homo sapiens
ctactttggggggctcttcgcgtggctcttagtgtggcgcattgtgggcctcgttgtgtggctctttggggggctcttggtgggccaggtccagctgccctggaggctgaagcaggaggatcacttgagtctaggagttcaagaccagcatgggtaatatagcaagaccctgtctctacaaaaaaatacaaaaaatt

SEQ ID NO: 529405 - DNA, 562 bp, Homo sapiens
  misc_feature (9)..(9): n is a, c, g, or t
  misc_feature (94)..(94): n is a, c, g, or t
  misc_feature (114)..(114): n is a, c, g, or t
acgtcgtancatgttacacaaggtcttctgctgctatgcagtgagattcgtggacacgtagaagatagcacatgtctgagagctttgcgcagantcaaggttcagttgcagaanggaagtaaagaagtgtgtgaccagactgaaggagcacagatggcacctcggcgacaactacgttccaaagggaagatgagaagaatagagaagtatatagtgactccacgcaggggtgtagaagcaacgcaggcatcaaggtctactgagctaaagactaacagacgagagagaaaagtgacagtgtgagctaggagcgaacaggaggtgtcagagtgctgaagccgactctgaaggtgatcatgaagttccagaagccagaatgaggaatgaaggtgagactgcgaagacgaggcaaaaccgcggcactagagaaaagtagagttaaccttgcccaattgcgcaatgaagatctaagtgatgaaagaccgtggaggtggagtcctttaggattatggccggttatttgctttaataaagaagaagtgacccttgtcaaaaaaaaaga

SEQ ID NO: 529406 - DNA, 267 bp, Homo sapiens
ctgtttaaaagctctttagttatgtcccacttttctatttctgtttccattgcaattgcttttggagattttatcatgaaatgtttgcctaggcctaggtccagaatggtatttccaaggtattttgctagagtttttatagtgataggtcttacgtttaagtctttaatccattttgagttgatctttgaatacggtataaaaaaggggtccagtttcaattctctgcatatggctagccagttatcccagaaccatttgtcgacg

SEQ ID NO: 529407 - DNA, 1446 bp, Homo sapiens
  misc_feature (253)..(253): n is a, c, g, or t
  misc_feature (333)..(333): n is a, c, g, or t
gctggagcggcgccttgtgtgctgtgggagccgcggctacccgtctgctggatgggcagcctgcactctgatcgtggacgggatggttgggcgactcaccgttcgtggggctcatttcgagcagtggctgagcgagtagcacgagaagattgacctggagaggccgtacactggtctgagggtagacaaggcagtcgatcagatgggtgacctatgagtagtagcgcatttggcgacgtggttgacgagccgngacgcacatttgttgtcactcctagattggggtttgcagtggtaacaatcgtttgatcggcggtttgtcactaatagccnaccaagcacggacggtcacgtggacaatccagcaatcggtcgctaggaaccatcgtgttgcttgtcgctactaccctgagcatacacgttgccattgcattgatcttgcttggatctattctagtcatgatcactggctagggttgacgctcccttgtcggtgctttttctttcatagtagtttgtgcacttcttaccgtgtggtcctcactccagtctcttgctagccttgggtggtcctttccaagtgcacccccgagggttggctccagtgggggtcgtggcatcatatgccgtctagcatagtcaaaacccttccgttgcttgggcctcgagcctgtcttggtgcgcttgggggttttgcggtagcatgtctcgatgctctgggctagggtctcctcgtgaaggactgatactgttgcgtggctcttcggaccgctgagggttaacttgttttcttcatctcgtcataactagtctcgggcttccgggggtggcccgtcctcgcgaagctcgggaactctgggtgcgtggtcgtgtcagggtggggtgggttggcgggtatgtaccttgctggcttgtgaggaaacgccaagggggctacacctgttaccggacccttttggagctttgggccggcagggattctcgtgtgccacggtgggacacggtcgaacttgtgggctttcttgccagaaaggggctctttaccttggatttgaagctgttcagctgtggtgcccttggtgtggtgtgtggccaccttaggcctgtgtctctggtgggaaggcgcgccttgcaaggtgtggccagcgcaagcggggacaacaaattgtcggccgccctcggaagaggaaccctccaccagagaaggagtgttccccgacggcccttatattcacacacaaggagtaataaccactccacaccccaaaatcgagcgcgtgggatacaggcgccaccacacaacataatatggtgttcgtcaaacgcacacactgggttgtgaagacgaggagtaccaccacactactgggggtgggggacccacacaacaccactcctgggattgcagacagagagacagtgttcctactgcaagagtagtaagaa

SEQ ID NO: 529408 - DNA, 310 bp, Homo sapiens
gacagagtttcactcttgtcctcttgtcgcccaggctggagtgcaatggcacaaccaaggctcactgcaacctctgcctcccaggttcaagcgattctcctgcttcagcctcccgaggagctgggattacaggcatgcgccaactcgcctatccaatttttgtatttttagtagaagtgaggatccaccacgttggccaggatggtctcgaactcccgacctcaggtgattcgcccgcctcggcctcccaaagtgctgggattacaggtgtgagtcactgcgcccagtcgacagtccatcttaaatcgta

SEQ ID NO: 529409 - DNA, 166 bp, Homo sapiens
atccccgcatgggggcgctgatccagaagaagctacaggaagaagtggagaaatatcaacagctacagaaggacttaagataatccatgtcggggaggcagaaatttgaagcacaactaacagaaaataatatcgtgaaagagaaactggccctgctgaatgggtc

SEQ ID NO: 529410 - DNA, 451 bp, Homo sapiens
  misc_feature (65)..(65): n is a, c, g, or t
  misc_feature (365)..(365): n is a, c, g, or t
  misc_feature (367)..(367): n is a, c, g, or t
tggccggatccgggcgaataataataatccccccccccccccgagcctggacacataaatcaccncggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctncncagcagagacgccgcacaacaaagaggtcagcccctcagaggatggtcacctgacacatatacagagacgtagagtgcgtgttg

SEQ ID NO: 529411 - DNA, 445 bp, Homo sapiens
  misc_feature (16)..(16): n is a, c, g, or t
  misc_feature (23)..(23): n is a, c, g, or t
  misc_feature (44)..(44): n is a, c, g, or t
  misc_feature (70)..(70): n is a, c, g, or t
  misc_feature (122)..(122): n is a, c, g, or t
  misc_feature (131)..(131): n is a, c, g, or t
  misc_feature (153)..(153): n is a, c, g, or t
  misc_feature (231)..(231): n is a, c, g, or t
  misc_feature (277)..(277): n is a, c, g, or t
  misc_feature (295)..(295): n is a, c, g, or t
  misc_feature (332)..(332): n is a, c, g, or t
  misc_feature (349)..(349): n is a, c, g, or t
  misc_feature (440)..(441): n is a, c, g, or t
ggggaaggtccctggnaccctanaaagcattatgcagatggagncccccccttataataggtgtgtaagnatataagacaaccccacatcctcatgagcctagcccataagttttagcaacntgccttgancccacggtagatttacaatttnctgtagtattgagttgtgttcatttagaattttgtaatatttatattgaaaatcaaatttttgtccctacaaaaactncaaaaaatccccctagttttatagttcctattaaaattatagctgnacataggatgccagaagnctgtttaagaagctgaaaatagagaaatgaatttacntctcatagttagcaggncacagtagaaggatgcttaacattgaagctgatgggaacagcaggttgatatagcttgtgataacacttctaaagaaaaagcaatgagccnnagaa

SEQ ID NO: 529412 - DNA, 396 bp, Homo sapiens
  misc_feature (65)..(65): n is a, c, g, or t
tggccggatccgggcgaataataataatccccccccccccccgagcctggacacataaatcaccncggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggacaccatatctcagaagacggtagagattgcatctcctgcaaatatggacaggactatagcactcactggaat

SEQ ID NO: 529413 - DNA, 996 bp, Homo sapiens
accagaagaagttctgttatagacgtaggttacgaaagattcctgggacctgaaatattctttcacccggagttggccaacccagacttgatggaggtccatctcagatgttgttgatgaacgtaatacagaactgccccatcgatgtgcggcgcccgctgtataagaatgtcgtactctcgagcgtaggctccaccatgttcaggggattgtcgtgacgtccgaacctgcaagagggattatgaatgagagtggttgagatggctagaggttctgaggcatcagcagagagagctcactcggctgggaggatcactgcctgaagcctgtggagtgtccatggtggtcgacgcatcacatgcatgcgctcacgccgtgtggttcggaggctccgatgctggcctcgactcccgagttctttcaggtctgccacacctaagaaggactatgaagagtacgggcccgaagcatctgccggcacaaccccgtctttggagtcatgtcctagtgtctgccttgaacgcgtcgtaacgatggtgtcagcgtcggggaacaagtgtccttcagcaacccagagaaggcgccgtctgtaaatagcgacgtcggtgttgctgcccagtagcgtgcttgcattggcggtgcatgaggcgcgggcgggcccttcagtacaagccatatatgccgtgtgccgagcgctgtgctgccagctctgccctttttcccggcctcctgcaatctcgctctccctcctcctcccttctcgtagtctgctgctgacaatttcaattctgtaggtggccactgtggacttcgagctcgttgtggttaccatcctttgaaatggggtcgcctcgtgtgtccgggagacttgggggtcgcgcctttccccagcgttggtataaggtgcctgggctcaacgggtttttccgcgtgtcccgtgggccggctatcaggaaatcttgggggtcccgagggggtcttttgccaacttgcgtt

SEQ ID NO: 529414 - DNA, 433 bp, Homo sapiens
  misc_feature (38)..(38): n is a, c, g, or t
  misc_feature (64)..(64): n is a, c, g, or t
aaggaaaaagacgtaaaaaagtcataaggtactgagcnattgtgctggtaaaatgcatgggacntgattctgaatttcagtttagggtaccagaatatatctgttcctgttatggtagtaatgagggatccctttcttaaactgcaaaaaatagaacaggttgggcgtggtggctcacacctgtatcccgcatttgggaagcgaaggcagcggatcacctggggtcaggagtttgagaccagcctggccaacatggtgaaaccccgtctctactaaaatacaaaaatagccaggcatgttggtgcacacctgtattcccagctacttaggaggctgaagcaggagaatcgcttgaacccgggaggtagaagttgcagtgagccgaattgagccactgcactctagcctgggtgacagagcgagactctgtccc

SEQ ID NO: 529415 - DNA, 421 bp, Homo sapiens
  misc_feature (39)..(39): n is a, c, g, or t
  misc_feature (384)..(384): n is a, c, g, or t
atgtgttgtgaaggcttatgaggaaagtggctttagtcnaggtgtcaacaccttctcagggttacaaggaataacctagtccagctgccattgcagatgtgggggcgcaggttgtgacaggtggcccctcaggtggggagggctgtcttagtgctagctggtctccacttgtctgttctgcttcccacttgagagtactgtgttcattcctcctttatggggtgttcccccatcatgtttttaagtgtcagaatgttgggcagagggttcttttctgcatcatcctataaagcaatcactaaatatatcgggctatgaagcacttttcctttaaaaaaaatttttttttctttagaaacggggtctttatgtaacaaagcgctnacgttgtgcacatgtaccctagaactgaaagtataat

SEQ ID NO: 529416 - DNA, 266 bp, Homo sapiens
ccagtcttaaaaaaggaaattctgtcatttgtgacaccattgatgaaacttttggacattacgttatgtgaaataaggcagacacagaatgaagactgcatgactccacttacatgaagtatctaaaataggcaaatatggtgaaaccccatctacactaaaaatacaaaattagctgggctagacttttgtatttttattaaagacggggcttcaccatgttggccacgctgatctcaaactcctgacctcaggtaatccgccca

SEQ ID NO: 529417 - DNA, 345 bp, Homo sapiens; identical to SEQ ID NO: 487030

SEQ ID NO: 529418 - DNA, 193 bp, Homo sapiens
  misc_feature (29)..(29): n is a, c, g, or t
  misc_feature (158)..(158): n is a, c, g, or t
  misc_feature (189)..(189): n is a, c, g, or t
ctaaccaggtgggcgaaaagcgctcacgnaaagcagcccataacgcctcggacacctgcgccgccgtatcattccacgtcggcaggcgcgcaccgttttcccaggcggcatcacccatcacgccgcgtagtggcgtccgtcaaaacctggcgcaacgnatgcgcagcgcgtcccggactcatcggggcnggga

SEQ ID NO: 529419 - DNA, 84 bp, Homo sapiens
  misc_feature (23)..(23): n is a, c, g, or t
  misc_feature (40)..(40): n is a, c, g, or t
tgccctgccctgccccgtgtccncctcccttgcccccaancctgtccccgtgcccctcccctctgtttgtgcccctctcccccg

SEQ ID NO: 529420 - DNA, 394 bp, Homo sapiens
ggcgactctagaggtcccccatgcctcatccatgtgctccactcagccactggcagggaaagctccaaatccatgagagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaggtggatgacttcacactgtggacagtttttcccaagatgtcagaacaagactccccactggatgagggcatggggta

SEQ ID NO: 529421 - DNA, 556 bp, Homo sapiens
tccccgtatccttctgcgatatgaattaactagaaatactttgcaaggagagctgcagctaagtactccccgtataaccagacgagcttacttatgaacagctataatatcacacccgtctatttcgcatacatatgtgcgaagagtctatatgctgaggcgagcaaaccgtaccgagcctgcttattcctggtcttcttggttaataatattagttcaactttaaatttgcccacagaaccctctaaatcccctggtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagatttaaacactgaactgacaattaacagccca

SEQ ID NO: 529422 - DNA, 208 bp, Homo sapiens
  misc_feature (39)..(39): n is a, c, g, or t
  misc_feature (42)..(42): n is a, c, g, or t
  misc_feature (145)..(145): n is a, c, g, or t
  misc_feature (156)..(156): n is a, c, g, or t
cggatcgttgatactggcatttcaaactcaataaaaganttntttcttagtaaggtaaggtttcagacacatttcaaaaatgaagctaatgaacaagtgtcgaagtataaaatatttgggaaattatcaaaataataatgtatancaaaaactcanacagaaccaccaaagtaaacgtgattaaacaagatagtaccacgtgtacggt

SEQ ID NO: 529423 - DNA, 1181 bp, Homo sapiens
  misc_feature (1)..(1): n is a, c, g, or t
  misc_feature (69)..(69): n is a, c, g, or t
  misc_feature (112)..(112): n is a, c, g, or t
  misc_feature (368)..(368): n is a, c, g, or t
  misc_feature (399)..(399): n is a, c, g, or t
  misc_feature (435)..(435): n is a, c, g, or t
  misc_feature (453)..(453): n is a, c, g, or t
  misc_feature (467)..(468): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (494)..(494): n is a, c, g, or t
  misc_feature (496)..(496): n is a, c, g, or t
  misc_feature (515)..(515): n is a, c, g, or t
  misc_feature (520)..(520): n is a, c, g, or t
  misc_feature (528)..(528): n is a, c, g, or t
  misc_feature (556)..(556): n is a, c, g, or t
  misc_feature (560)..(560): n is a, c, g, or t
  misc_feature (562)..(562): n is a, c, g, or t
  misc_feature (564)..(565): n is a, c, g, or t
  misc_feature (567)..(567): n is a, c, g, or t
  misc_feature (600)..(600): n is a, c, g, or t
  misc_feature (603)..(603): n is a, c, g, or t
  misc_feature (612)..(612): n is a, c, g, or t
  misc_feature (623)..(624): n is a, c, g, or t
  misc_feature (634)..(634): n is a, c, g, or t
  misc_feature (651)..(651): n is a, c, g, or t
  misc_feature (662)..(662): n is a, c, g, or t
  misc_feature (745)..(745): n is a, c, g, or t
  misc_feature (748)..(748): n is a, c, g, or t
  misc_feature (758)..(758): n is a, c, g, or t
  misc_feature (824)..(824): n is a, c, g, or t
  misc_feature (841)..(841): n is a, c, g, or t
  misc_feature (858)..(858): n is a, c, g, or t
  misc_feature (905)..(905): n is a, c, g, or t
  misc_feature (918)..(918): n is a, c, g, or t
  misc_feature (976)..(976): n is a, c, g, or t
  misc_feature (984)..(984): n is a, c, g, or t
  misc_feature (1047)..(1047): n is a, c, g, or t
  misc_feature (1111)..(1111): n is a, c, g, or t
  misc_feature (1181)..(1181): n is a, c, g, or t
nccccagcctcccagaccagaataatatgtgattcgagaccatgaggatagtggtctgtacatttgggnccccaggtccatccagtggggcctggcctcccagagtgggacnactccagtgaccaaggagacgggctggacaccagcgtggcctctcccagttctggtggagaagatgaggacttggaccaggagcgacggcgaaacaagaagaggggatcttccccaaggtggccaccaacatcatgcgagcctggttgttccagcacctctcgcacccgtacccctcggaggagcagaagaaaacagtggcgcaggacacggggctcaccatcctgcaagtcaacaactggttcattaacgcccgnagacgcatcgtgcaacctatgatcgatcaanccaaccgcacagggcagggtgcaaccttcatcccanagggccagcccatcgggngctataccgagacnnagccacacgtgnccntccggnctccngnatcagtggggatgagtttnaactnggaagganaatggcattatctatagaggctgatgcngganananncngcctccggctgtgacccccagcctcacacctgnctntggttcccncctggtcctcnngcttcaggancccacctccaaaggccnctccgctcaangcctacctccctagggccctgctgggacatgggggcctgagtgcccacccaagggctctcaaggacaccggcaaggcctccangcnctgagccccncttctgccttcacctctgcctgggacccgagctgggctcctgggccttggtccccagaagatggcngctagggcctcgccgcnaggacagagaagggacngggtggctgggcagtcagggaaggagggtcgcccggatccgacattntggagagattctntcacccttctggtcccccacctccttctctaattcttcttttttatgataaagcttanacacaganaaaaaagacttagagaatacgtagatgagcacttatacagatatatctcaggctaaattgttntgagatttttttattttaagtagcaaagataacactcttattttagtaatggttgagcaactanaagacggggcattattaccaaacaaacagaacccaaaaatggacatctggactagcggtgaactaatttn

SEQ ID NO: 529424 - DNA, 718 bp, Homo sapiens
  misc_feature (585)..(585): n is a, c, g, or t
gccgaataggaacagctccgggtctacagctcccagcgtgagcgacgcagaagacgggtgatttctgcatttccatctgagggtgaagaacaccagtgtgttcctcttacgtggtgtggtggcatgtcaggcccttctaccagaacggaccggaacctggccaggtgcctgggttcttggacttcctagccttcagaactacgtggttggacctcggggtaactaaaactggcagaaggcaaaacgtggataaggagactacgtggtaatgattatgctattacaagacgctcgatgggctaacatcagacatttttataaaaggccagaatcctggctaggacatctctgcctggggaaggagggctggatggcatacggggaatgggcttctaggatgacttccgggtggctacagactacaagaagcatttctggccttgatgtggtctgaatgaagaagacataggagtttcaccaaaggtaggatcctgatggttacacgaacgtgtccacctccatccagagccgtgtggcttgtagtgccttctcgtggccgatgccgaaccgggcacctggttccanaaggtgaaatcactaaatgcctgaaaaaaagggctatgatagtgggagctggagaagattgaatctgaggattgtggacctggggatagggagaacctactttctgggacaatggctcggggtcgaagaggcg

SEQ ID NO: 529425 - DNA, 123 bp, Homo sapiens
ttcggtacccctacaggctttggagcatgttgtggacacttgcctggaagtttattagccagtgaagcagagatggtttcttgccatcaagcctcctcgtgaagagttcctcaacagccggat

SEQ ID NO: 529426 - DNA, 337 bp, Homo sapiens
ggacaatattgggaagttatcagctatcaggacaaacagctcttatcccccagattgactacaaagcatagcgtgctctattctttcactgttcctatctcagccactgccatgtacaagctcctaatccataacagtcatagtctctgctccttcaggaacagtacatcttcctggccttcatccattatagcacccgtgatgtcgataactgcctgtcagggaagactggcagacagttgctttcattcttcctcaaagtatttaccatcagctacagtccaaaattgctttttgttcaaggagatttatgaaaagactctgacaaggactcttg

SEQ ID NO: 529427 - DNA, 775 bp, Homo sapiens
aaaacaatgcaggcagttaagcaagaagatggatccacaaaagaccattcacaaacacatagcagacatttccgagaaggcaacaacatgcaaaatggcaacatgcactgaaggagaatgatcaatgatcacacttgatgcaccatctttgacggattctgatgacgcaagcacagacaagccatggtatcatatgtgcaatccaatgtacttgcgatgcacacatgggcaattgacaactcttcatggcacaagagtggcccaacagctccgatcgagctgcatcggaaagctgtaccactcttgaccatactagcttcataagagactacgaagtcatcaagaagtgaaacgaacgacttgacagcggaccaaactcagaggcgcgtactagcgagctagcaactctagatgcaaaacgaaggtcactacataccttattagctatactgtactaactatactgcatcgcatactaaaacccagagcccactccgttagtcaggcactatccctcaatatagccaaaagacccagcacttgctacctctcccgcacagacaccaccaaacacacccaaacactcgcgagaagacacgcataaagaaacgcacgacaccgacgaggcctgcgcttacccccgcaacatcacccccgacgagcggacaccatacaatcagacgaacaaaactcccccatagcgccccgaaaaaggcgaaagtgacacaaacacacgcaactgcgcaaaccgcaccacgcgaacagcacccacgca

SEQ ID NO: 529428 - DNA, 376 bp, Homo sapiens
gtttcgtcctaatcaagctgaacactagtcactgggttccacggttctcttccgtgacccacgacttctaatagagctataacactcaccgcacggcccaagattccattccttcgaatccgtgaggccaagaatccccaggtcagagaacacgaggcttgccaccatcttggaagtggcctgccgccattttggaagtggcccaccaccatcttgggagctctcggagcaaggacccctggcatctggatattaagactctctccagccctttgaggttgagagaggaagcaaacacggaggaatggatttgacaacccacatgtccgtgactcaatgcaagcaaggcctttcacaaccaacttcgccacccact

SEQ ID NO: 529429 - DNA, 407 bp, Homo sapiens
  misc_feature (267)..(267): n is a, c, g, or t
gaacgcacatcaggtgatgctgaggctacagaagtgtggtctcaggactggcagctgcaaagtcaccccgggaacctgtgagaaatgcagattcttgagccccagccctggcctgctgagccagtttctggttgatgcccaaaccctctgggtgactccgatacacattaggattgagaaccaccaatggaggagcaaaaagaccagccatgaatcaagaggcctgcttctaatccttgttctacaactaatctctgagactgacgnaacacctgcctcctgtagggcacagctttcctagtagacgatgaggagtcggaatagggttgccacaatccttcatttccctcttaaaaggtgataaccctacggtagcagttcatttcctctaaggcctgaaagtgaaa

SEQ ID NO: 529430 - DNA, 302 bp, Homo sapiens
  misc_feature (58)..(58): n is a, c, g, or t
accccggtctgggagcctggtctgtgtgggaagctgtagattcctgactgacgcctgncatggtgggactgccagggaatgccgttgcgtgcgttgagcctcggcggctgcgccaggcgaaggattcttcactgacgcctgagcttgtcgtgctgtacacaagacagtgctgcgaacggtgatctggtgctactgatgaagacgctcaatcactcacataggcactgtcgcaggctgcatgccatcaacaagctgtagtcccagagccacatgacagaaagcacgtctagcaaagcagtgca

SEQ ID NO: 529431 - DNA, 958 bp, Homo sapiens
gacctcactatactctactcaacgcttgatcgtacgcccggaggggttgcacgcgtatcccacatgcgtatcaagattaggtgtaatagctggtacgagggccgccatgcttatccttgggactaccagccactgtagtgttgcgcttacgcgtctaaacgcagtgtgcttaggatcgtgtcacagttcaagcagggatcttaagatgctcagttgatatacaccttgttagatagagtagaagcagtcgacatgccctcgctagaagatttcggtgtctccacaatgttaccggcaaagctgttctgttcaagtagcttaaccgtcgtggagtaaatttcacttgtgtaagttatcgtaggtagggagcggtatgatagagtgcagaccgtatcaaatagccgagcgatagtctaatggtactttgaaactaattcgaagggccgattgcataggagtatgcttgaaacgcaaatactcattaaccagaagacggcgcaagctaaattttgtaactggaccagtaatttgcatggatggactcactggaagtctaacagcaaaaaggtacaagggcataatcatagatagttccatctcgacctttattccatccttattcgtaccccccttcttatgctgggctaggtgcgagaatcgatgctttgtggaagaaagaatgattggtataaggtatgcatactgaggtagggagttgtggggaccatttggatagaattggttcactctagataatatacttgttgtatataccgattatgaaccttttagagttgctaacagtctgagaataaaattggcccttttggtattcaactttgtgaaacttgggttagaatatagtttttaattttttgttcaccgtcaatgtgtcagacttttaaattggaacagtggcggatttaaataggaatccttcttttcctgggatttgggc

SEQ ID NO: 529432 - DNA, 273 bp, Homo sapiens
aagagacaggacacaggaagagagggacatggagagacagggacacagatacacaaaggtcaaggacacacagacacacatatatatgtatatatatgcatttagatgaaaagatcacttggacaataccacatgccggtgaggatttagaaaaactaggtcacttattgctggtgggaatataatatagtacggccactctggaaaacagtttggcagtttgtcataaacctgaacataccgttagtatacagcccagcagcaactacaatc

SEQ ID NO: 529433 - DNA, 1157 bp, Homo sapiens
gtggaacgaacgtgttccagagggcgcgtgggtcggggatgtgcagtaacctctcactggatctcggcgagaaagcaacaagccattatatctgtcgtttcctagatcctacgcatcgtgttttcgcaagggcttctcggaggcctcgtgcaagtccatccacaggccccgcctttgctcactgttgtggctctcgtggcggagcctggtggctgatgattcccaaggttgctcatacttcctgtcgtctgcgatctttctctggagaccttgggccctttggcctgtgtggggctactggaggatgggtaaccctcgatttgcacccagtccgcgtctccttccacaagcgcttgacaagaccctagatcgccgaccgtacaggcagaggatgcgtcgcgtggtccagcatcccagcaaagggtccgcgggtcatgtagccgtgtgtcttggtggggcggccactccaggaagagatatgaggttataatcaggggcctcacggagtggagccttagactatctgagcattggctgcgcgcgtggagtattgcgagccccttgggtcacatttcctcgaaagttaactgtgcctcagggcccttgacgcccaagagaagcaacgtttcattctgaagattgctctgggacaaatcgatcggctatgtgaaacctctgtgcacatagtgggtcacttggaccatgtatggcgtggcaggaccagggcctcgctagcgatggggtgcatcaaggtatagcttcaagcaaatgttgccccccttgtctgtctgtgggtctaacacgtggtacccctgtggtgttccactgttgagcacgtgcccaaagacgttgattatggcccacagctatagagggttcgaccacgggccccataagaaacctcttggccatgcttgggtggcgaattccaccctgttcgccgaagtgccttacgggctcttaacctggaagatatgctcgccttgggggacatccgtgttgagaaccgatcccacttaggtcacaagcaatcatgagggcgaacctagtttgacggcgaagttgcccttagtggggctacattcgccaagagggttccactccacccttgtacttcctgaaaaagctacatcccattttgcctgtggagggcccca

SEQ ID NO: 529434 - DNA, 101 bp, Homo sapiens
tccctgaaagcggaaagcatcaggccacgccgtggcagcctcgtgttggcctcggatagcctggtcccccgcctgtccccgccggacccgccggaaaggct

SEQ ID NO: 529435 - DNA, 1300 bp, Homo sapiens
cccccgctgtctctacgaggttggggggggaaaccccctttgtgtttcccccgcggggtatttttctcctgcgcgacggcgcggtcgtgtggttctgctacagagaggccttcttcatcgggggggggtggtgattacccccacacgggggggggctctcttcttggtgggggtctccacaccgccgtttttgtatactgtacagatcgcactatggtgctctttttatttgtggtgcgagaaacgtcaataaggcaaaatttgtttgtagcgaccccctgttgtccccacctctgggggtggtttataaacacctcttgtatattcccctcacaatgtactcccacgtagtaggacagggtgtaaatatattggaggccccttccctccctcagatcagaggagaaatttttatagagacatagttttcgagaggcgtctcttatgtgtgtcccacacagaggggagtttttaaaattttctccccacgccggctgtatatatgggcccccccgcatttgtcgccacacatacccacagcgcgtgtttacaagatatagagagggagaccccacacacaatagatattggagatcacaccgcatagagtgagagtgtatagagagagaaatattctcgtgaaatatagagagagagagagatgatatagagagagatatatatatatatatagagagatatatctctcgtggagagatcacgcatatataaacgagagagagatgagagatagagatatgagagatacatcttcttcacacgagagagagagatatataagagacacgcgcgcgcgcgcgctcgtcgacgagagagataatgagatagaatatatatatatttttgccggctctcgatagtgagagcccctcgcgcgcttcttactctctcttgtgcagatatcctccacacactgttgtggggcgtgcgcacacacatatagtgtgggacacacagtgttgtgagtggtgtgtgagagcgactcacacactgtgtctctgttgagagtgtgttctctctcttgtgtgagactcacacacagagtttagagagagagagttgaatagaagaaggacacactctcactttgtgagggttttcacttgttttgtgcgcgagaactttttccaccgcacaaagagttttcacaagagagaattttgtggtgtgtccgcgtaatatatacccacacattactttctgttttttttcctggagaaaagaaggcacccaaaaagaaaaagaggaaaaaaaaacacccaaaaaaagagagagaaga

SEQ ID NO: 529436 - DNA, 239 bp, Homo sapiens
  misc_feature (51)..(51): n is a, c, g, or t
  misc_feature (61)..(61): n is a, c, g, or t
  misc_feature (225)..(225): n is a, c, g, or t
atgtcgggtgatgtcgccagggattaccgctttgcgacgagatccgtcggntctgggccgncatgctatcaccatgctgatgggaatccttggcggtgacgacgtcgaggatgtcaccgagcaacctcctgaactcatcgtgagaggatccactgttcaggcccagtaaggggcgacgcgacggtggtgtcaacccttgaccccgccactctcaacaccgcggangaacaccttctgca

SEQ ID NO: 529437 - DNA, 817 bp, Homo sapiens
cgagactctttttaatcttgttgccaggtgaaataaatgcccgtcccttatctcggcgtttctgcccttctgggtccttacccaccgtttcttcaaagaacccctagcgataacaggggctcccgccatttcatagcacactggtaaaagttgtgcttttgaaattttatgtttagttgcacacaatgggcccaagaaacattgccttgaggaagatacgattgggaaatccagagtgtagaaggataaatactgtgtttactgtcccaagacatgtttatagtgctctgtaaatgttcccttcccttgtagtctctggccagatgctttaggaagataaaagtttgaggagaaccaccgggattctgaattaagcaccgagttgaagtttatacccctttcacaagcttttccaggatgtcgccattactaagaagccagataatggtgttttttagaaacctctattgaagtatattccacccaatactttatgtataaataatattataccatatacttgtatagaccgtttctgcttcaccactttgattttttcccatttaatatttatattagagatctatatatgtataaatatgtattttgtccaatttgttaacttaaatatatagagacccttttttcttctggaagtttgttgaaatgaccgaagcgtatatggattccagaaatttaagctgccaaaatgtatttgctattaaatgagaagtctccctgatagaggttctttattgctccttttttaaaaaatggactcttggaatctgtttaaataaaattgtaccatttggga

SEQ ID NO: 529438 - DNA, 179 bp, Homo sapiens
ccacgatatttggccagggtctacaggtggaagtgtgatcccgtcgaccaatgccaggattcagagactggtgacgttttatcaaagtggagattcatgggagaagtatgtgcatagtgtcagataccagtctactctatggccgtgcatagggagtggcattccaacctttacagacc

SEQ ID NO: 529439 - DNA, 101 bp, Homo sapiens
  misc_feature (8)..(8): n is a, c, g, or t
agtagttncgggacagcgcccctatgggaatacggcagctggtacaaggcctgtaaagtagacagccccacagtcaacaccaccctgcgcagtttgggggc

SEQ ID NO: 529440 - DNA, 141 bp, Homo sapiens
caggtgctctttcactcaacattaagtgtaagatttatttgtattgttacatgtagctgtgggtttttgtttgttttgagacagagtcttgctctgttgcccaggctggagtgctgtggtgtgatctcagcacactgcaac

SEQ ID NO: 529441 - DNA, 596 bp, Homo sapiens
gagactcggagagatgggccggcggaagacaccggccgcgtcgtgggcacccctccacctgctgctgcttggtgggccgccctgccctgtggatccaaggggtggggtcagatccggagtgccttcagactttgggcccagaaggagcagaacgaaattaccacccagtccaaccacaattatggaacttcaatcggacatccttcggaaataatgcaggaaggcaaccaaggtatctctgaaaagtgtggcacacagtgaccttacagccacttggattgaatacgcagcgaatacaccggggacttcccactggaaagtaaatatggttagctcggttccaggcacaacatccactggcaggccgaaatttcagcaggggcttacaatcgctgggacactgggcgtaacttgggacacataaggaacacccctttcttggacgcatcaggacaacccctattagtggggtaacccggcgtacttatctcaaaatattcatgacggcaaccccttcaaattccccaacaggccttaaaacgaaccactattgggtcaatcgccttggcaactattgtaatccacaaatattttac

SEQ ID NO: 529442 - DNA, 299 bp, Homo sapiens
cctcacctgatacagcgagtcaagaccagcctgcccaacatagtgaaaccgtgtctctgctaaaaacacaaaagattaaccaggcacggtggtgaacgcctgtagtctcagctactcaggaggttgaggcataagaatcgcttgaacccaggaggcagaggttgcagtgagctgagatcatgcccctgcgctccagtatgggtgacagagccaggttctgtctcaagaaaaaaaaatgtatatatatatatatatatcttttcaccatatacatgcctgtctgtcaatctctggttggg

SEQ ID NO: 529443 - DNA, 152 bp, Homo sapiens
  misc_feature (128)..(129): n is a, c, g, or t
accatgaggatgatggcgaggaggcggattagcagggggccgggacagggaggttgggaggggttacagaggggagacagaggcacggagagaaaggggggtttagcacaagacacagcggacctcgnnattggctaaactcccatagtatt

SEQ ID NO: 529444 - DNA, 219 bp, Homo sapiens
gctgagtgtctacatgtcacagagccctcatgaacgtacaatctagtgtaccagagttaagctgaccatggaagaagatatgctgctcttcgtcaactctcgtagtaaagctcgacatggtggacaccaggcggcaaagaaatcaacaagccatggttcttagtcattggcaggaaaattttgaggtccaagcgtggtaacatgagaattcacactttc

SEQ ID NO: 529445 - DNA, 807 bp, Homo sapiens
  misc_feature (34)..(34): n is a, c, g, or t
  misc_feature (63)..(63): n is a, c, g, or t
  misc_feature (120)..(120): n is a, c, g, or t
  misc_feature (124)..(124): n is a, c, g, or t
  misc_feature (130)..(130): n is a, c, g, or t
  misc_feature (132)..(132): n is a, c, g, or t
  misc_feature (173)..(173): n is a, c, g, or t
  misc_feature (181)..(181): n is a, c, g, or t
  misc_feature (183)..(183): n is a, c, g, or t
  misc_feature (185)..(185): n is a, c, g, or t
  misc_feature (187)..(187): n is a, c, g, or t
  misc_feature (189)..(189): n is a, c, g, or t
  misc_feature (194)..(194): n is a, c, g, or t
  misc_feature (197)..(197): n is a, c, g, or t
  misc_feature (208)..(209): n is a, c, g, or t
  misc_feature (213)..(213): n is a, c, g, or t
  misc_feature (215)..(215): n is a, c, g, or t
  misc_feature (217)..(218): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (250)..(250): n is a, c, g, or t
  misc_feature (253)..(253): n is a, c, g, or t
  misc_feature (258)..(258): n is a, c, g, or t
  misc_feature (263)..(263): n is a, c, g, or t
  misc_feature (273)..(273): n is a, c, g, or t
  misc_feature (278)..(278): n is a, c, g, or t
  misc_feature (283)..(285): n is a, c, g, or t
  misc_feature (288)..(288): n is a, c, g, or t
  misc_feature (298)..(298): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (325)..(325): n is a, c, g, or t
  misc_feature (330)..(331): n is a, c, g, or t
  misc_feature (343)..(343): n is a, c, g, or t
  misc_feature (358)..(358): n is a, c, g, or t
  misc_feature (388)..(388): n is a, c, g, or t
  misc_feature (390)..(391): n is a, c, g, or t
  misc_feature (396)..(396): n is a, c, g, or t
  misc_feature (400)..(400): n is a, c, g, or t
  misc_feature (412)..(412): n is a, c, g, or t
  misc_feature (417)..(417): n is a, c, g, or t
  misc_feature (421)..(421): n is a, c, g, or t
  misc_feature (423)..(423): n is a, c, g, or t
  misc_feature (427)..(428): n is a, c, g, or t
  misc_feature (435)..(435): n is a, c, g, or t
  misc_feature (450)..(450): n is a, c, g, or t
  misc_feature (454)..(454): n is a, c, g, or t
  misc_feature (456)..(456): n is a, c, g, or t
  misc_feature (465)..(465): n is a, c, g, or t
  misc_feature (468)..(471): n is a, c, g, or t
  misc_feature (473)..(473): n is a, c, g, or t
  misc_feature (488)..(488): n is a, c, g, or t
  misc_feature (494)..(494): n is a, c, g, or t
  misc_feature (563)..(563): n is a, c, g, or t
  misc_feature (587)..(587): n is a, c, g, or t
  misc_feature (592)..(592): n is a, c, g, or t
  misc_feature (595)..(595): n is a, c, g, or t
  misc_feature (598)..(598): n is a, c, g, or t
  misc_feature (601)..(602): n is a, c, g, or t
  misc_feature (659)..(659): n is a, c, g, or t
  misc_feature (668)..(668): n is a, c, g, or t
  misc_feature (670)..(670): n is a, c, g, or t
  misc_feature (702)..(703): n is a, c, g, or t
  misc_feature (706)..(706): n is a, c, g, or t
  misc_feature (710)..(710): n is a, c, g, or t
  misc_feature (731)..(731): n is a, c, g, or t
  misc_feature (807)..(807): n is a, c, g, or t
ttcagaacaagaagaaattcagaaacaacaaaanaagtatcattcacagtgtaatggaaaaantttttctgaagcaggaattataactcttccttctttttccctagtctttcatggtcncccncccggncnctcgaatataattcgtaaatcccaattcctgcagggaagtnggagacanananananacagnccnttaatccccgnnccgncngnncncncnctccccccacacccccagcccctccnggnggtcnccccnatgacagggngaggngggcnnnccnctgccagcgnggagagggnccncntngctngcncccnccccnnccagcaagtganacaaccctcggcttntggagctccagcctgcctctggggacaggncnnctgtngccnccccttgggacnctccncccncncacnnccccccnccccccccccccccncccngncctctcggngcnnnntnccccccgacttctgnggtgtntgggatggggggggggggggcccaacccccgggcgccgctcccggcccatcagcagagagagagctctnggcagacgcctctcccccacttantgtgnggncgntgnnatacttttctgcgaacttcccatagtggtagtagtggaaagtggggtagcccttgancgcctcctncncgcacaggtcttggttcttgtctttgacgcannaanaagnggcacaggcaatctttcgggnatctttgaaggcatcagcagtagcagttaagtgcggaatgaccttcttacagtgtgggcacaaggggcgtagaacn

SEQ ID NO: 529446 - DNA, 444 bp, Homo sapiens
cggcacgaggtaaaaaaagaatttatataattcatggatgaaatgtttcagaatctataggattatattttttttaaggcagacagatacgaaaatacaacgaagcgtgcatgaccgaaaccagaagagattaaagtaaaacctcattctcctgaggaaatcgtgtgagaagggacttagggactgccggaacacagcgaagcagaggcagaaggcagacaaaaggggctgggttggtccccgcctgtgtgaacgaaaaaatatgtcagattggaaaattgcggtaaaaaccaggcagagcacgtacgttgcccccacaggaagtgtccgccatgctgcctgtgcccggaagtaggtaggaacacacagtcagagggacccaaaagcaggggggaaggaaaaagagatgcacacttcccccagagaagcctccgagcgcggccg

SEQ ID NO: 529447 - DNA, 906 bp, Homo sapiens
gatcgcaccactgcactccagcctgggtgacacagcaagactctgtttcaaaaaaaaaaaaattctttaactttgataaaccctagctaaaactgatcagggaaaaaaagagagaatttagcaagatcaaatttagaaaagggagatcctacctcgtgtttacagggggagtcctttaaactttaaagatcctgccagtacttaaagggacaagagaacacctatgagcaattttaggccattggttctctgacaacttaggggaaatgggataccctgaaagacaatttaccagaatctggacacaagattattagaaaactttatacagccttatatctgttacacttaattggtaattaaaaaccttcctcagaacagctgtgtcagatggcttcacggatgatttctaccaaattgtttaagaacggattgataccaatttggtacaacctcttttagaaagagctacattttttttagaaaatctaggagggaagaacctttctcattggataccaaactcaatggatacccagattatttggataacttctcaactcaccttgataccaaaaccagacacagaccctacaaatttggacgttacagacgcgtatctctcaagaaccttgacccaacattccaaacaaaattttactaaagtcaagctcagtactatttttaagattgatccagtcttgacccagtggggatcttctccaggacccaggtgggttcaacctcttcaatggtgccacaatggtgcttccaccatattagggacaatgaaagagaaaatgtttttttcccataaatgccgggcaatttttgggaaattcactggggctttaaattctcgcaactaaagttgaacaaaatttctcacccgtaaggaaacctaga

SEQ ID NO: 529448 - DNA, 250 bp, Homo sapiens
cgaagctattcagagagaccacctgcccatgggagaacctgcagttctccttaaagcggcactttccctgcaggccggctctgcgtgtctggccaagctagcaggatggcctctggccacgcagacacgcgatcaccggatgtggacaacgtgcgactacacaggcacagtttgactctggcgtgctgctgagaggtgggccagcggcggggagatcctcgtaggagtcggaccgctgcgaggcaatgca

SEQ ID NO: 529449 - DNA, 258 bp, Homo sapiens
cccctggggggggggaaagggggggggttttcccctccccccaaaagggggcccccccccctggggggggggttttggaaaaagggccctttttaaacgggggggggggggttttttagggaaaaccccccccccccccccccgggggggggggggggccgggggggggggggtttttcccccccccccctttttttcggggttttttttttccccccgaatttgccccccggcccccaaaaagtttgttttttttta

SEQ ID NO: 529450 - DNA, 142 bp, Homo sapiens
tatccctaacacatgtaacaggaatctatccccagctgttttttgtcaggttgtcaagatgatgatgtaggtgtgcggtcttatttctgggttccctattctgttcccagtctgtgtgtgaaaaagtgttgggcgataacat

SEQ ID NO: 529451 - DNA, 210 bp, Homo sapiens
gttggttttcgctttaagtcaggagtcccaaatgcctttttttttttcaattaagggaaaagccccctttctccctttaacatcccccagacccccgccccggcccgggccccccggtgttgctaacgccagtatgatgcttattttgctactcggaaactatttttatggaattaagggatgcttttttgtttataaatgcctgtttta

SEQ ID NO: 529452 - DNA, 1251 bp, Homo sapiens
  misc_feature (132)..(132): n is a, c, g, or t
gaggactcaaaggctgggatcatggtatatggaaccctccttttactcctctcgagagcgacctggtcccttatcgccagacccatggtgtggggctccacacgtccgttgaatgtatttccacatgttccnggtgatgccggtctctgttcggggggaggctcgccggattcagtctcatgttgggctactgtggatcggagcacaccaaggtctgtgctgcattctgatagacgagggaccgcgagatccagaggaaatggctcgctcgccgtggtccggacctgctcgtcatcgcgaagccaatgggaagggggagtacaatcacgctatttgggggaatccgggcgaaggaactagcgagaagtcgccctatgtggaattggtcgtcgaccaggaagtttttcacggatatcgtagatttcatggctgaggaacgagctgcagacggtgcataacattatcatatccaggaaagtcagaaagggactcgccgtggtgcttcaatcaaacactcttgcacatgattgggagtatgcttgggggactttagacacgacgactgggagtggggccccccgaacagagggctggcctgtttccgctacccggcggggttactcgacaatcatagatttcacagacgcggagagcgactgggggctaagcggaagtttgaattcctcccaagagctctgggaaattggaccgtgagaccactagggccgttcttgcccatggggtgtaacccggcgcgaagatgggaacacatcggtggattaggggcattcccgaagaaattctctcccgccatgggtcgaaaaaaatgattccgtacactcgtaattggcagttcccttgggcatgtggtcagggcaggcacatacccacgtcaggaagagacctttaggcgtgggaaagggaatcaccaattgagccggtcgtgacacgtttgggagtttcacctatgtcaaagagattaagaccctcgggcaactgcaacatgcggggcgacaactgatgagagcaacggtccatcagccatcataaaacgtcattgatgtattggcaccccccaagaagggcaccacacaacgttggcaatcttccaacccgaacacaccccgatgctttactttggacagcaccactatggaacgtggccaactcattagagcagggtcgcctactggagggtcacatttgtggctctggactcgcgccactctgcagggcagaattccacagagg

SEQ ID NO: 529453 - DNA, 776 bp, Homo sapiens
cataatatgtctatgtgcgtacctcgtggtatatcgcacgagtggcctgtactccgaggagataccatgtcggtagacgcgagcagtgtctgacgagttagatgtggaactgggaggcactttgctgtctgcaatctgaagttgagtggtgcaaaaatgcagagtaataaaacttttaacttgtgagaatgcaaaaccatactccaatgaaatgcatcatcaacatcaccaccagcagcagcaccaccatgcagcaacatgcagcagcctgccaccaccgccaatacctgcaaatgggcaacatgtgccagcagccaaaatgaatgtgcttgactattgacctgaatgaattttagaaaaccaggagatgaagaccttcacccaactgaagcctgtctatttatgttgggaaatcttcctcccgacatcactgagtgacagaacatgattgaaactatattgagaacatattgtgcaaatgtgcatggctgaagtcttcatatcataatgtgatacaatggaatttggctttatcctgctttggaaaccctgaaccctagctggagattgccaaatgtggagcttggacaatatgccactccgtggaaatgcagctgctatgtgcgctatgactgccatagtgcatcccttacagtatcgaaaccttcctcagttatgttgtccaactgaactgcttggaagaagccttttcttgtgtactggccaggtatgagaggggctgtagtcacttgtggcatgatcgaggaagtgcccta

SEQ ID NO: 529454 - DNA, 184 bp, Homo sapiens
atactgataaaggatatatatccataatgcataaagtactctcacaaatcaaaaataagacaaccctggagttcccgttgtggcgcagtggttaacaaatccaactaagaaccatgaggttgcgggttcgattcctcagcgggttaaggatccagcgttgctgtgagctgtagcgtaggttgca

SEQ ID NO: 529455 - DNA, 868 bp, Homo sapiens
gcatgaaggtgcctgctgtgtggggcccacagccttgaaacgaccaccttcctctccagaccacccaggcaccgcggggcaaacccgccatacctggcaccgcttgcagctgtacttgtgaggctccgagtctgcgctctcgtcagaattgtcatcgttttcttccgaggagatcccgatcttgccgataaactcttccctctggtggtcatccatcaacgcgatgtcctggaaaacagccaccacttccggtttctaacagcgcagcagacgcttcactcagttatctacaccgcagggacgaccaatcatttccccagatgcagaagaaaatgcctctctgatgcccgtggcgccctaacgagctacacttgtgccctagcccatcccagcttgtccccagaggtccccacctaaacgctaaagctgcccttgctctccacgccgcccgcggcttcctctcacatgcgcccagcaagatcccaatctgtgcccagggccaggcactgctgggaagtccccctagtgagtctcccataccacctgttactttttcagttcttgatcagcgcttctcccagcctttatcacaccccaagtcctccctgctcccggggcttctgctccgttcctctctttcctcaaaggtggggagggacacagatgccagcaccgggctgagaagcagccacggtgggagagcagtacttcaagcctggcagttggggccacaggaggtgaggccaatgcagtcacagaattccatcttggagagatcaaatgcgaccagttgtcaactattgaggacgctgctgtggtctgaatacttgaaccctcccaaattcccatgttgaatccctaattcaca

SEQ ID NO: 529456 - DNA, 722 bp, Homo sapiens
  misc_feature (371)..(371): n is a, c, g, or t
  misc_feature (515)..(515): n is a, c, g, or t
  misc_feature (517)..(518): n is a, c, g, or t
  misc_feature (532)..(532): n is a, c, g, or t
  misc_feature (548)..(549): n is a, c, g, or t
  misc_feature (553)..(553): n is a, c, g, or t
  misc_feature (555)..(556): n is a, c, g, or t
  misc_feature (560)..(560): n is a, c, g, or t
  misc_feature (566)..(566): n is a, c, g, or t
  misc_feature (584)..(584): n is a, c, g, or t
  misc_feature (587)..(587): n is a, c, g, or t
caaaaaccaaaacctgcagccagtggtcatttcaaaatctttttatgttcagatactgagccttcataagggttgactacctcagatttgctgcactcattgtggacttcagtgtggatcacaacttctggataagaagattacaactattaagtgtcgatgtgaaccttgcgaaccagctctactggattcttatcagaaatcctgcataaaaagtcagccatctgggttctgatctgctgtaacaagatgaagatttaagtgaccttaattaacctgtcctgtgccctacccttaaggaatactctctgtagtaggctgttgttatattagacttcctggaacacaccgctgaaaagaactgatgtgtnccagaatcaatcttggggttaggggctggtgattggtaatttaaactaattggtattctagaggtaaccacaaatataaattcaaccaaagtggggtccaccaagtgggggaaggggaagggagagaataatcttgggggtttntnntttgggtaattttntattgggatagggctnntggntnnggtntaggtnctgcattaaggccttttnggnttggacttgaaataagttcttggacagagcatatggctgggttaattaagtaacctaaagtatgcattaggatggtgaaaggtctcgtgagtatgccaatcctgagggtggaaccaaatagcctttgatgaacag

SEQ ID NO: 529457 - DNA, 427 bp, Homo sapiens
accagtgggcagaggaaatgtcccgagtgtgggtcattacaagcgaagcctaagagaaagtgctcgcagttcatcaagtgtctaagttgccaatgatggcacgtcctatatgaacctcaacaaggtcaagcctctgcctctccttgagccagatagcccacatcaaatagaatcagggctcacagtagagattcaagctctcaggtgtgtgtaacggaatgcgaaaaccattaaaacaaacctacgggaacaataatctgagagtttaaaagtataaatcaaaagattactaccttattaggacaaactacaggtttatgattatcaagcagtcgtagtgactgaaatttcattaatcagaagtcctgctgctcagattataaattaaaatacatctcactgatttcatttaatgcatgtgttcaca

SEQ ID NO: 529458 - DNA, 988 bp, Homo sapiens
gcctagctctctcggtggtccacccgagaccccttgacgtcaccatgcctagtcgccccgcgcggacccttatgcgctccgaccagatgagagaatcaatcatgaaccgagggaaaaaaaactcgcctaagactgcgggcacgagtgcgcatatggtgtggaaaggagctgatcgccgaaagaagaaggaggttcagtagcaacatgccatcaagcatgattagacaacaaaaacatttccaagatttctccgtattatgacagttgcgtgagtgttaacatataagtctctgtgtactttgcatgaaggtgactatagttgtacacatatccaaggggatacacgtgactcactacctttgaaacaaacgcataataggttcgtgcgcatctctggcagctggccacgtatcgccatgtaccggccatgctgagacgagtcagcatggctagaaatagcttacgccagtgatcttgataacctagtttgagttgccgtggtagtcatcgaagtaagttaaagggagactagcgtctgaagctcgtgcctcgaatctagatcgtgtggattggaaatagcgacacctattgcctacttgtgggaggattggtgatcgattgaaggttccaggatcttgtggagactttttgatgacgttcaccgtaatgagggaaattgtaattgagtcaactgcttgaagatgcaacctgcataaagattacctggggagcgagctactgtgatatgatgagctgctatgtgaccgaagatctactgtggatgggatctgatagcatctaggtctctaatatttagacaggccaggcccttggaacacagagggctatacaggagtgcttatacccgatcatcctgtgggctaataacgcgaagagccgggaatctcaaggttgaaccaggaaaaaagttctggtagaaaaaaaaaaccgggggcaaggatccgaggccttgcaccgctttggcacg

SEQ ID NO: 529459 - DNA, 436 bp, Homo sapiens
  misc_feature (48)..(48): n is a, c, g, or t
  misc_feature (80)..(80): n is a, c, g, or t
ggctgcagtgtaatggcacgatctctgctcactgcaacctctgtctcncaggttcaagccattctcattcctcagccacncaagtagctgggattacaggcatgtgtcaccattcctggctaatttttgtatttttagtagagatggggttttaccatgttggtcaggctggtctcgaactcctgacctcaagtgatccacccaccttgacctcccaaagtgctgggattacatgcgtgagccaccatgcccagcccacctgtgatattttgatacatgcatacaatgtgtagtgatcaaagcagggtaattaggatattaattatctcaagtgttatgatttctttgtgttaggaaaattgcacatcttgtgctatagctgttttcagttatatactggattattgaactatagtgacccttctgtcgtcttctc

SEQ ID NO: 529460 - DNA, 107 bp, Homo sapiens
tccgaaaaaagagtttattcaggaacaggacggggattgcagtcaggatatgcgtgcatacactggaatgcattttggggggggtccgtgataacggcaacacttta

SEQ ID NO: 529461 - DNA, 305 bp, Homo sapiens
ttccaatctctcttaaggcggttctatttatcccatcttgagcttgtgatatatgtccaagtttgattttcttaatggccacaatttggttggtgttcttatctctggcctgtgtaaacggtggcaacttagaaagaaaaatagaaataccttaggtttatgggagtttgtgtgtgcgcctttgcgcatttttcacatttcgcgaagcaaagagcccagagtttgtgagcagactcgcggcggctggaaacgtggcgggtcagtctcggtccagctccaggttacttttcagcaaggagaggccc

SEQ ID NO: 529462 - DNA, 346 bp, Homo sapiens
cttctgggcgttgctgaagatgtactttctgttgatgagacagagaagatataaaaatacaaatcataagtcagggtcatatctcagctctccataatccttatcactggccctgtgaattcactactctcttttcttttccttgtgacttcctttttccatcagggccagctattcccctccttttttaaagtcatagagatgtatctgccaaggacagataattgccctacagaaggaaaacaaggagtgagaattccttataccaaatactcctccttcaggcaggaaagaaaaaaaatcaaccttatgttgaaataacacaaaacatagtaagtaggggatc

SEQ ID NO: 529463 - DNA, 660 bp, Homo sapiens
  misc_feature (81)..(81): n is a, c, g, or t
ggacctcgatgggtcgttctacatgcacagagttgctgcggttgataagctgatgtactcaaggtactgagcctgcaccgnccggctcatgcgcccgaagtagccgttttccaggttgatcgggccgggctcgtattcatagcgctgggcgatggcctgccagtgcggttcgttatcagcattccttggcatggcgaatctcttagtgacggggggcaggtttaccgtgtttggcgcgcagcggttcgagcaattcggacaggccgttgtggtcgatttcctgcaacaaggccagtaagccgcccagttccccgtgggggaaaccttcacgggcgaaccaattcaggtaaggcccaggcaggtcggcaatgatccggcctttgtatttgccaaagggcatttggcgggtgatcagcagttcgagtttttcgggattcatgagcgtcgtagggttgaggccaggctttcgaaaatacaggcattctgcatgaaggccaaatgacagatcatgcaaataaccaacatacagatggttcaataattcttaacctattgaaaataaacacaaaaataatttttctaaacctggcacgggcgctgcaataaccaaggcaaccttctaacccgtacaagagaacgacccacgaggggatctctaga

SEQ ID NO: 529464 - DNA, 103 bp, Homo sapiens
aggatcacgatgtcctgtccatctctcatcccagttcctcgggcttcttagcatcagtgctcagtgtatatgctcagggcttgtcccagttcctcaaggcttg

SEQ ID NO: 529465 - DNA, 806 bp, Homo sapiens
  misc_feature (268)..(268): n is a, c, g, or t
  misc_feature (381)..(381): n is a, c, g, or t
  misc_feature (752)..(752): n is a, c, g, or t
ggggtctggctgctgggggcccggagtcagtgacgctcggtagccgcgtgcgccaaagcggggaatctgggaggcgagcagctctgcggttaatgcacgtattttaaattcccggggctgcggacgctatgtgcaggaagcacctccaggagattccagacctggagatagcgaaacgttgccagcagacttgcacgtggggatgggattcccagctaagactatctagtaacatgctgtcaaggcaatggggggtcttccggtccgnctggagagaagaggagcccgcattcagtggagaacatcccctcaggaacgggctctcgaaatctgggccaaccagggagagcaccgctccaacggcaaacgagtgaaggagcnacagagggagtgatcaacagacatttgtgattgtccggcaggtcctagaggctaacatcgagagagagcttaccagggtgtatcatggcgactcccttccggatgaggctgtctctgtgggagtacttattcctggtgctgtgcgcttccctgagtctggtagaaggtctgctggtgtgggctagagagggtggtatcgcgcgtagacgctctgatgagtctcgtagtggcgagaccgttaggacctacagaggtaaatagatctgcgacccggatgttgagtggtctggcttgctgtctcaaggggcgtgattgccttcccgctgcccacgatcatgtatgggaccaaccattgagtgaacattttgagncccttatcggtgttccagcagatggacctatcgaagctcagtgatagaagtgtc

SEQ ID NO: 529466 - DNA, 126 bp, Homo sapiens
agcacgtgtcgtgaacaccacgctcacggactgctgcgacgattcaccagaccagagcacttgggcgcagcgccagatcagtgcagcggttgcatagctaccaggagtccactaatgcagctcact

SEQ ID NO: 529467 - DNA, 562 bp, Homo sapiens
  misc_feature (42)..(42): n is a, c, g, or t
  misc_feature (52)..(52): n is a, c, g, or t
  misc_feature (96)..(96): n is a, c, g, or t
  misc_feature (107)..(107): n is a, c, g, or t
  misc_feature (143)..(143): n is a, c, g, or t
cacagcctgttcttaagcccaggggcggcacctcaatgtcangacccagctncacctgagagcactcagatccaggtggggaggcccctgcagccntccagtgccgnaggcctgagcatggctgtgtgaaaagcgtggttgcnaggcatgtggctctcctgccgcccctccaacctgagatcttgttgggagacttaatggcagcaggcagccatcactgcctggttgatgctgcactgagctggacaaggggagtccgggcaggggacttcttgggctcgggaccaagcttaactttttggccccacccacaaaaaacgtggggttcaggttccttttgccccttcccagcacatgcagaatgactccagtggttccattgtcccctcctgccctgtggacctgcttgcctttttcaagtgccccacctcccctggggtgggccactcacccacagtggaagtggccgggatttgcccttcctcccctttcacctacctggacccctaacctggccctagactgagctttatttaagaataaaatcgtggtggtggtcaaa

SEQ ID NO: 529468 - DNA, 273 bp, Homo sapiens
cttttcccccccgggttttttaaaaaaaaaaaggttcctttggctataatttaaatcccccctttgcccctaaaggggaaagtttggtttaacctttggaaaaacccggggaaacaaatcccccccccctccccatcaaattttaaaaaggttcccccggtttttcaaattgttgaatgggaaccccttccctagggcccgggggttttttgttttgtttaaacgcctttgtcccgcccccgggataaaaaagggtttcccccctgcttccca

SEQ ID NO: 529469 - DNA, 1220 bp, Homo sapiens
tttgactatgctcttcatcatgctggatcagatgagactcctggagcatgagtatcagggagatctcagaaccatgatccttcggaatgcacacgatacatgagcaccgtggggagcaggactggcgattgcttatgcccttgggtagttgctagtggatatcttggccacagatgagtcccaagcttatagccgaggcacagatcgagctaggacaccctagatcttatcgagacagcatgagaaccttctacatgggaccaagaagaacacaaggagcaagatggtgagtgcgagcattcatgaagcaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactgggcacagaccatgcgaagggcccgcatgagcaacgactgtggacctgcaggatgcagaggaagctgtggagtaggtccagtatgcttactttaagacaggttctggagaaggagaagaaacgtaagaagcgaagtgaggatgcaatcagagacagacagcctgcagaggagaaacgccgagaggaccaggagcccgcaagcggcacgagcagggaagaactcgccagcccagaatggccacacatggggaatacatacgaccccctagggactccagagcaccaagaggcaggaaattgcgtcaaaggtacaaacgagccaaagcagggaggaatcacaggaagacaaggatcccggaagaggacatagactgcaccacggcggacgcgactacgaggcgggaccacatgggatggacaccggaacaggcaagtggcagcaacacggcgaaaaagccgacgaagaaaccaaaacgggaaaagggaacaaacccataccacggagcggaacacgggagagcgaacgaacggggaagaacgaaacgagggagaaaggcgagatcaacaagagaacagcacatagagaacgacagacaaagaaaagcgtaacaaccaagcacgaaacgtgacacgaccaacaacaatacggcgacgatgaatgacagcataggcgacgacttgtatcacagagagagatagaacgaacatgcacacatacttcataatctattctacagccctcgaagc

SEQ ID NO: 529470 - DNA, 253 bp, Homo sapiens
  misc_feature (96)..(96): n is a, c, g, or t
  misc_feature (106)..(107): n is a, c, g, or t
  misc_feature (109)..(109): n is a, c, g, or t
  misc_feature (112)..(112): n is a, c, g, or t
tacgcctgtcgcaagtcggtggagagggatgaggatgtggagggacggacgtggcggaagccgcggggacttgcgatggggcgtaggatgtcgcgngtgagtggtnncnagncctgttgggtcagggcggttcgcaggtgctgtcagagctggccggggcacccgggtcgaagaggcgggcgccagtcgcggtcggtggagagggatgaggatgtaggagggacgacgtggcggagccgcgggactgcgccaa

SEQ ID NO: 529471 - DNA, 231 bp, Homo sapiens
tgttgagaagtatcaagcgttgaggaagtataagcgttgagcagtatcaagcgttgagaagtataagcgttgagaagtataagcgttgagaagtataagcgttgaggaagtataagcgttgagaaagttaaagcgttgatgaagtataaagcgttgaggaagtataaagcgttgagaaagtataaagcgttgatgaagtataaagcgttgaggaagtataaagtttttgag

SEQ ID NO: 529472 - DNA, 382 bp, Homo sapiens
ttggcacgaggggtgcacctccatttagagacacagatggcacccacctgattcggatcacagattaatgacgctctccagcccccgagtggcccggatgcagggtggatgctggcagggctggtttaataccgatgatgtgaatagacttaaaacaatgcctggcccacaattgccatggcgtgtggttgcaatggggctcctgtcataacctaatgccccgtgacagccccataccacacagtgagttggtgtggggaccccaaagctcccttcatacaggaatcacatacttcaggagttccccaaatgatacctatgctcaagcagcccctgtgacacgtgcccactgccatcgaagtgcatgttataaggctcagga

SEQ ID NO: 529473 - DNA, 109 bp, Homo sapiens
atctgatgcaccccacctgacccaactaaacacgaacagtcactgacatggcccagctatattaacagactgcgcctcgaaaccatgctgtggcatctgataaacacct

SEQ ID NO: 529474 - DNA, 607 bp, Homo sapiens
  misc_feature (63)..(63): n is a, c, g, or t
  misc_feature (90)..(90): n is a, c, g, or t
  misc_feature (284)..(284): n is a, c, g, or t
  misc_feature (420)..(420): n is a, c, g, or t
  misc_feature (436)..(436): n is a, c, g, or t
  misc_feature (482)..(482): n is a, c, g, or t
  misc_feature (495)..(495): n is a, c, g, or t
  misc_feature (513)..(513): n is a, c, g, or t
  misc_feature (566)..(566): n is a, c, g, or t
  misc_feature (591)..(591): n is a, c, g, or t
tgtaaaaaattcttcatattggttttaatcagagagtagattgtgcatgtgtgagcacccagnctactggggacgggggctctcccacgnacccctcctcctgtgtttgccagagctcccatctgccccacttcggcctttgccccgtcatcgatgattcagggcagagccagattcgttaggtccctgggaggaaggactgactgggaccagagggaccctctgggctcaggagggttgggtccctgggaggccggcagccagggccacagaatccacacgtngaccattgtgggtccctgggaggccggcagccagggcacggaatccacacgttgaccattgtgggtccctttggaggccagcagccagactacggaatccacatgttgaccattggaagtcagtctcttgcgtgtnctagaccttgttggtngcgcccttcataggggagcagggggaacgggtcttatgttcctgtncttgcttagggtnagagcttcccgcaattcntagcttattggattttcttgccttcttttggcattttaaaattaattggcctnggttttaaaaatttcaatggtgccntttaaaatttaaagtc

SEQ ID NO: 529475 - DNA, 425 bp, Homo sapiens
  misc_feature (19)..(19): n is a, c, g, or t
  misc_feature (26)..(26): n is a, c, g, or t
caatggtatcttttcctcnatataanggaaaagctagagacaggcattcccagcacagggtacaaacaaccaacaaaacacttttaaggggacatcaagactttttgaagacacagttttactctgttgctcaggctggagtgcaatggcccaatctcgggctcactgcagcctccacctccccaggttcaagcgattctcctgcctcatctcccaagtagctggaactgcaggtggccactaccacatctggctaatttttgtatttttagtagaggcagggtttcgccatgtggccagactggtctcaaactcctgatctcaagtgatctgcctgccttggcctcccaaagtgctgggattataggtgtgagccaccacacctggccctaggacataaatcttttctttgtgacagagtaaga

SEQ ID NO: 529476 - DNA, 243 bp, Homo sapiens
ttgattcctagaggtaccccgttttgggctcgtgcatgggattatgccgtgtgatcccagtacttagggaggctgaggtgggtggatcacctgaggtcaggagttatgagaccagcctagccaacatggagaatccctagctctactaaaaatacaaaaagtaagctgggcgtggtggcgtgtgcccgtgatcccggctactcgggagactgaggcaggagaataacttgaccccaggaggcg

SEQ ID NO: 529477 - DNA, 1229 bp, Homo sapiens
gtacccatgggattagaagtcccaggcatgtttgataccctccagatgatcctctgcgcgaccgctatgccatctcatgatctctccggcgggcgaatcacacatctcgttgacgtgtggcatcatctgtgctagctgccagaacacgagtctcgtgtccaaaggcgtgcatgttaccccagatgggtgcttcagacttggttatcctctgatggctcgccgttatgatgcgtcgccaggagaacggatgactgagaggtctgcttatattgccggaagggtgtcctaaaatgggctcgttgtaccatggtctgagtagggagacttagtttgtctcccgtgaactgcgttgtgatccgtcacatgcaatacttgaaacgattcaccgaggaagccaaggtagccacggaatttgaggaataccttgaattgcaatcgtaggaagtgtgatttggtagaccatgtaaagacactcaaaatctgaaacgattaatcggctggctgagatcgggcacgactttctaggaggggggtgctcccctttcgtccagtcttggcacaaagcttcggttatggcaacaggactctgcacgaaaaaagtgaaggggaatcccttacccttgtgtgtatctggagtacaaccagtcaggccttccatccttatggtgactgagtctataggcttcttctgggaaaagagtccacttcacatatgggcctagaataccccacggtgcgccctttatccaataaattgggtctagatacccatgtgtagaccgggctctctgtccgattgtttcttgtggtaaacgacattggagttgtgggcgaagttgcacagcgaggaaacgttgcacctttggactccctttccccccaaagggtgccgaggtgctacgagcgatagcacttgaccgctgtgggcagagagagaacggagtttgggggctagtttgggagaacgacttggaatcgcgtttgtaatcccaagccacagggggtttgagaggaattatcggttccaatttggaacggagagggattatattgagttgcgcgaaagattggaatcgagcgaacaggaagaagttgatggagcgagaggactggaaaagacagggagggtagtacttgagaatcccggtagagaccacatagagtgttcaaggccaagtcgacaggaaaatggattttggagttagcgcgtagggatagaacaggtggct

SEQ ID NO: 529478 - DNA, 438 bp, Homo sapiens
gctatccatatggcgggcataacatggtaccatgatcaacctgtttgtatggctcacatgcaggccatgggagcaagtgtaatgatggactataacacattgatgcagtacatacctgatgaatgcactgaagacagacattaatgatccttcatagaatgagaagattatgagattctcaagaattcagcatgatcaaacagcgagagccgctggatcgatcagtcttcaggattgaattagtgctccacagatgaccctaacgtgatctagttgcgacccacaagctaacctgctgccagtgccagtctatgtatgtgatggtgatcctgctggattgagtggcatctgagcttaccatgataacaaggtgttgactgtgatgatcactggcatgtatgatctagaaggtagatgcgatgtagggagtcgactctt

SEQ ID NO: 529479 - DNA, 130 bp, Homo sapiens
ggacgactgcaagctggaactacacacgcgcactcgctcacactacacacacgccactctcacacactctcacacacgcaccctctcgcgcatgctctctcaaagcccaatataaccaaggggaaggaat

SEQ ID NO: 529480 - DNA, 175 bp, Homo sapiens
gcgtttccttactgggctcatggtgctggctttcctttgcccagtgcacagctctcccatctggagagcttttgtgctagctcctcccctctctgtggatgttcctttcagcctcctcacacagatgtgagcgtctcttcgctggccttcaggtttcagctcacagaacacttgt

SEQ ID NO: 529481 - DNA, 263 bp, Homo sapiens
tgcctcggcttcagtggtgggactgcaggcagtgcccacacacctggctaaggtgtgtatattatggtagaaatggcgtatcaccatgttggccagactggtcttgaactcccaagcccgtgatccgccaccttggtctcccaaagttttgggattacaaggatgagctactgtcgccggcctactttaaattcttaatagctatgtgaagtgcatagtgatgtcatgctcttttagtagatcaggaatcttggaggcagaga

SEQ ID NO: 529482 - DNA, 209 bp, Homo sapiens
atcaaacccaactaatttattttattttttattttttgttggtagagacagggttttatcatgttgcccagggtggtctcgaactcctgggctcaagcgatccacctgcctctgcctcctgaagtgcagggattacaggcgtgagccaccgcacccgcccaaaatttttactatttatgtatagaatgtaagcttttcagcatgatttt

SEQ ID NO: 529483 - DNA, 138 bp, Homo sapiens
agcgcgtgcgcaatacctgaagggctcggtgagaactctcaccaggttggcgcctgaatgccttactctcagcagtcagaggctggcttgtctgtgcagatttttaattttacttttttgggccctaaggctgggtgg

SEQ ID NO: 529484 - DNA, 254 bp, Homo sapiens
agttctggtctgcagagcatatccgtcccagggggggaccaggaactagttcctggtcccccactgcgggtactctcctgttccagccttgtgaaggaacgggtttttttttttttttttttttttttttttttttttttttttttttttttttatgggcccccggggggaaaaaacccccaaccaccagggggcgggggggggaacgagagaccccccgcagcgggcagaaaaacagcgggggcaccagagag

SEQ ID NO: 529485 - DNA, 697 bp, Homo sapiens
ggataaccaaggggtgaagctagtgggggccccaaggtagaccccactccatatggacaatcgtttccgcctgctccctaagtgcttcgcgagtggacgtatcgtatgaagagtgggtctacctcttgccgggtcgggcgagcgagttttgcagagggagggtttcggggactatgggggacgagggcgggagcccgaagccgggaattccgcagttaccgagagtttcgaggagatgatgggcgtgaggtgggacagtgggaacaaacaagcctcctgtctccgaggtcgcactgccagcgagacacggagcgagggttcacgagtatgaggaactccccaagcgggccggcagacgggctcaaaacaggcagcgagacccatgagagtgatctggctccttcaacaagaggctcgcacagccacggagggaacactcacccaggtccctctcgctcccgacgcatcaggagccgccagcttcaacaggcccaagcagaatcactgccctggggtgggagaggcttcactcccagaagggtgccatctcggcgtggcagagaggagggaggcccagtaactcagggtagggcaggcaggaggccatacaagacacaacgtactgaggcgtgcacgaggactaccaacagcacatatgaccagcaacgcacaggaggcttgacaggagaacgtggat

SEQ ID NO: 529486 - DNA, 949 bp, Homo sapiens
acgagttcaggagatcgagacctggccagcacggtgaaaccctgtctctactaaaaatacaaaaacattagctgggcgtggtggcaggcgcctgtggtcccagctactcgggaggctgaggcaggagaatggcgtgaacctgggaggtggagcttgcggtgaaccgagatggtgccactgcactccagcctgggctacagagcgagactccgtctcagaaaaaaaaaaagaaaagaaatacccaccgtgacttttgctgtgaggcatgaaaatataaggaggtaggagcctgaggtgcctgtggccacccggctggaggtgggtgggccgtgcttgtcagcttgcttggcggaacgttcctttagttgggagggagtgcctttcctgaagcaatccttgggctggacatgctgatcctgaatgagtcctaagagtacgggtttcccaatacccggagaaaacagcaagcctgtgttcccagccagcgctggtggcagctgggttccaggcaggtggagccgagtggtctggagctggcagcacactctggcacctcctcaggcggttttcaagggtgggttccagccagggagccctatgcaggcgtgcatggtgcacgggaggacggtctcgggtgggtggataaggaccctccttggcctggtcctgacaggccgtgttgcttgcaggccacttttcaattacccggttctcaaaacatcaggtccccttcgctggcccacgtgttcatggggtgtcctgcaggggggacggggctggggacccctgcgctttacccaacccccaccttgggcccggccagggcgttgcggttggacccccccggcgggggtctcccctccggggtttatcgcccactgtacggggggcacctgtgtggggccgccccgcgtttttacagggtgtcgccactgtcttcccccccaga

SEQ ID NO: 529487 - DNA, 219 bp, Homo sapiens
  misc_feature (154)..(155): n is a, c, g, or t
ttattttatcagccccgccccttcctgtgtgcactgtgcactcacacaggcactgtcccatgtcagcatggcaggcacacatgcacaggtcaggcagcgtgtgtgtttgtgtgtggtgtgcgattgctgatccatcccacagggtcaccgcagnnctcgcacattcgtccatccattggtccatcagcttgtattccatgcacgcggcggtctcagatc

SEQ ID NO: 529488 - DNA, 723 bp, Homo sapiens
atcccagctctcagggaggctaagaggcgggaggatagcttgagcccaggagttcgagacctgcctgggcaatatagcgagaccccgttctccagaaaaaggaaaaaaaaaaaacaaaagacaaaaaaaaaaaaaaaaaaaaaaaaaaaaagggggggggggccggggccccgagaaaagacctttcttaaaaccaactgcgcggggggcgggcgggggccccaagagagaggaaagaggagaacaaggggcccaaaagcgggttctcccagagaggagaaaccggggcccaagagaacaagaggggcggggaattctctctcacacaaaattaaaaaaagaccccgggggggacacacaccggagagggttctgtggaacacaaactctccagagagagggagattctcggaggaggccccaaaacgagggggtctctctataacacaagagaggagagcccacaagagagagagacgcccgagaatatactcaaatataagagcccccgggccccgggggggggggaacaacaaaacaaaccgggccaataaactaagaggcgccgcgcaccacacacccagacaaccgacaacaaggaaacacaacaaagaaaagcaaccaacagggagaactacaacacccgacccacacaacgacacaccaacgcacaaccgacaccgtggcgaacgccacacacacgacgagagagccaaaaaacca

SEQ ID NO: 529489 - DNA, 859 bp, Homo sapiens
aggaaaggaggggcgacaagaggcagacctgagccaccccgatgtgagacggtgataacagaaaacaggggcattaagtgaaaggtgcaaggggaaggagttaaaagtgtttggaaaggggaagggcatcaaaaaagggcgtagttcacccgacgagagccctggcatagtcaccaacgtgacacacctaagtgaggccagagacgaataattttggtctgggtttcctcttcaagaatttaggtttgttctgaaatagaggagaaaaggtggtgaaaagacacttccgtagagtggggtcccccccctccagggaataagctggaatcttaactttttggggggtcttttttggtgttttaatgggccccgaactgtgggttaaaatttttatgtaagtatctttgcttttttgtggagctataaattttaaaactggatttgggagcctcaaatactcctccacgggtgatgtattcactgagagttttaaaacatcgtttagttttcacaagtaaactggatatgtggacctctaaagttattgagtttaagctacaaattgtgacgtcacttactggacatgtcagcatcaaccctctccaaatagctgtggtcactttatgaaggggcgttttaaagttgttgtttagcagtgacatttaatatggtcccattgcttttctttttaaacgtgaccaaaagagaataagggaccaacactattgctgccgaaagccataacactgagttgtaccaattgtgattgaggaaatgaaaggtttataattttttaaaaaaaaaaaaccaaaaccaaaaaccaaacttcaaatggaataattattcatgaagcccttta

SEQ ID NO: 529490 - DNA, 451 bp, Homo sapiens
ccagatcgcagtgacagggtatgtaacgtggcagctcttaggtattggactgtccacagtgataaaaaggttctggaataagactagtggtggtggttgcacacgattgtgaattgttggccggggcggtggctcatgcctgtaatcccagcactatgggaggccaaggcgggtggatcacgaggtcaggagatcgagaccatcctagctaacatggtgaaaccctgtctctactaaaaaaatacaaaaaaaattagccgggcgtggtggtgggcgcctctagtcccagctactcgggaggctgaggcaggggaaatgtttgtgaaccccagaggcagagctttgcagtgagccgagattgcgccactgaactccagcctgggtgacagaatgagactccgtctcaaaacaaacagaaaaaaaaaggcagacttgtccatttggaacctat

SEQ ID NO: 529491 - DNA, 489 bp, Homo sapiens
gtgtttttactgttgagttctaagagtttttttatattttagataacaatcttttatctgctatgtcttttgcaagtattttctgccagtcagtggcttaactttttaacggtagtatggcactactagatatccacatgcaaaagattgaggttagacctcttaatcacaccatttataaaaattaacttaaaatgcatccaagacctaaacttaaaagccagaagtataaagctgctagaagaaaacaaggcataaatttttatgatcttgtatcatgcagtaatttcttagatatgataccaaaatcataagtaatcaaacaaaaaacaggtaagttagacataaaattaaaaaccttaattcagcccggcacggtggctcatgcctgtaatcccaacactttgggaggccgaggcaggtggatcacctgaggtcaagagttcgagaccagcctggccaacatggtgaaaccctgtatcaactaaa

SEQ ID NO: 529492 - DNA, 845 bp, Homo sapiens
gtgcctgccggccgtgtggggtgactgtggccttcccccagatgtacctaagtgcccagccagctttggaaggccgtacaagttttcccgaggatactgtaataacgtacaaatgtgaagaaagctttgtgaaaatttccggggcgagaaggactcaggtgatctgccttaagggcggtcaatggtcagatatggaagagttctgcaatcgtagctgcgaggtgccaacaaggttaaattcgtgcatccctcaaacagccttatatcactcagaattatctttccagtcggtcactgtggtggaatatgagtgccgtccaggttccagaagagaaccttctctatccaccaaaactcaactggccttcagcacattttaccacagtgtccacagcagtcgacatcttctgtccaaaagaaatcatgccctaatccggcggagaacctacgaaatgctcagatttgatgtccaggtgggcatattatcgtgtgaaccaatctccttctcaatgtacacaacagggtacaactcattggctcgacttctagtttcgtctaaatttcaggcaggtcctgtccaatgtggagtggaccggtgggcccagagtgcagaggaacatttcttgtccatgcaaccacccacaaatgggagcagtggcataattcacggggaccgtggccatcatggtattgacgcgctgtcacagcatgctgtcaatacagggttcccattgttggagcacctctcttctgcccgcgaacattgcgcaggcatgtgggtggcaccctgtatgggaggaaatttactccagccacaaagttaaactctacaagtccacacaagc

SEQ ID NO: 529493 - DNA, 216 bp, Homo sapiens
ttaacgatgacgtcttgtacgatgacgtcacttagcgatgacgtcactgtagcgatgacgtcatgtagcgatgacgtcactgtcagcgatgaacgtcactgcagcgattgacgtcactgtcagcgattgaccgtcatgtcagcgattgaccgtcactgtcagcgattgaccgtcactgcagcgattgaaccgtcactgtcagcggattgaacctgt

SEQ ID NO: 529494 - DNA, 214 bp, Homo sapiens
gagcagaaatgccgaacaggagcgggagaaagaactggcaaaatgtcactatcaagaacgaagatctcggatgactaataatgactgagatggatatctgtcgagcagcagaagaaggcagggggcgcaaacacagtggacaatgtgatagaggcgctaattgtcctaagcaactgatgcgtgctttctcaaatatacctgtaagaactggctt

SEQ ID NO: 529495 - DNA, 401 bp, Homo sapiens
tatctcaggcgtgcaatatgcggagaaatgtttcatgttacttatacataacattagttcttatatagggtgatagataggtccatcttgggtgtgcatgagttcagatatatgtctgggattttttatgtagtgcgtgtagagcttgaacgctctcttaatagtgttggctgcttattatgcctaccatgggtgttaaattttttactcatctctacaaggtttatccctattgtccaaagagctgttctctctatggactaacagttaaatttacaaggggctttagagggttctgtgggcaaatttaaagttgaactaagattctatcttggacaaccagctatcaccaggctcggtaggttcgtcgcctctacctataaatcttcccactattttgc

SEQ ID NO: 529496 - DNA, 255 bp, Homo sapiens
  misc_feature (29)..(29): n is a, c, g, or t
  misc_feature (66)..(66): n is a, c, g, or t
  misc_feature (99)..(99): n is a, c, g, or t
  misc_feature (121)..(121): n is a, c, g, or t
  misc_feature (227)..(227): n is a, c, g, or t
aaggaagcacgtaaataagtccagcttanagagggattaatatgcttaacatcttaaaggaaaganggcccggttgcatcagaggattaagaaaatgtngcaggaggtgagatctgacccntcagcccccccacattaggtaggtcactggatctttctggcacctgttaaattggaatactagagccgagaggtggtcctgggactgggctttgtggaggtggggngagagagggagatggtagcatgtccagc

SEQ ID NO: 529497 - DNA, 244 bp, Homo sapiens
  misc_feature (31)..(31): n is a, c, g, or t
atcccaaccaacatgaagcacatggcattangttagtcttgtcatttaacatgtagttctctgtgtctggcttctttactagtgttattcatttgagaatcatctgtgcttcaagtctatcagtatttctttttatgacttagcagaattcccttgtatagttataccattcgtttattcattcatcctttgaggcacatttggtttgtttccagtttggggctccatgtgcttcatgttggtt

SEQ ID NO: 529498 - DNA, 313 bp, Homo sapiens
cggtggcttgtgaggctcaagttgaggactccacttaactccccctgtaacctggatggtgaggctgggcgcgtctgaggccgggacacccagcctccctctgactttccgcctctccccacagctcctgggcatggtcctgtccatctgcttgtgccgacatgtccattcccgaagactacacgcaaaggtccccaacgtactgaggcagcatggtatccccatctccctgcctggcccccaatctcagggctcccaggggtcatccctggctccctcctccatgcctgcctcccacttcactgcgaaaacc

SEQ ID NO: 529499 - DNA, 223 bp, Homo sapiens
tactgggtgttaccgtgggcagctgaagagccctcctttcctcagctgtttgtggtgccagccccgtccttgccctgtctattgcccagcagctcccagaagccatctctccgatgtctgggctcccttgagaatgtccaaaccccggcaaggtctgaagtctgatgtgcagaggtagctccatgacgcgagtcacggaataacacttccttttttggtgaag

SEQ ID NO: 529500 - DNA, 113 bp, Homo sapiens
atgtcgaggaaatgtgcattctccccagggaaaacggccatagattggtctctggaacaggttctagacccaaaaacggagatctaaatgctgtgtggcagtgatcttcacac

SEQ ID NO: 529501 - DNA, 115 bp, Homo sapiens
gactgcacaacgccgcgaggatgtctcaggtacagcgcgtgcacagccaggctgcgaatgtgcagcgggcgggagtgcccgttgggggctcagccggctgccagaagctctcggg

SEQ ID NO: 529502 - DNA, 103 bp, Homo sapiens
cttgcgtgtctcatacacagaatgggataggggatacagcatctggatggcctggctcctcattgggcatggttgtggaccacattacttctgctatggtctt

SEQ ID NO: 529503 - DNA, 373 bp, Homo sapiens
aaataattctgtatctctagcttaccaaagggctggagacacagacaatcagtgcatttgtgctaaatattgatgggagggaagacaacgggatgagagtgaaatacagggaaaaagagagaaggagatgaaaataggaaggtgaaaagaaggggagggaaggggaaaggaaagatcggaagtaaagaagagagaagaggcaacgatagagggagggagggacagagagagggtgagggaatgaagaaatggacagaggaaggaaaaggagaaggggaggaaggtagtaggggaggacagaagactcagaaggatggggagaaagacaaagagactttaagacttccaaagtcagtcaccactaagtcgacgc

SEQ ID NO: 529504 - DNA, 420 bp, Homo sapiens
ggggctgtacaactgggacgctgcaaaatggctgccgcaatgaatggtggcaggaggaaaacggaccgatctggcataaacgaagtggtaaccgatgaattcactcattaacatttacatgcgcatacatggaccggtatttacgaatcgtgcaccgtactgactgaaagagattgagaaattttccgtgaactagatggaaacttcggatgtgcacattgacaccaggctcaactaagctgcctggaccaaaggactaaggaatgtgccatacagaatcacgatgcagtatgtaagaaatcgtaatgaggatgaagattcaccaaataagctatttactttggttacgtatgaacctgttatcactttgatctactgactgccaatgtggttgagaactaatcgctgatcgtcagatct

SEQ ID NO: 529505 - DNA, 241 bp, Homo sapiens
acctgcatgattctgataccataaccagacaaagacattggcgggggaaaagaaaaccccaaacaagactccttcatgagcgtagacgttaacgtgctaaacccaactgtggcaaaatctaatctaacagtgtttacaaagggatggtacgacataaccaaagtagggtttatcctgattttgcagggttgatttagtattaatatttgaaaatcagtgtaattcaccatattaagctaaa

SEQ ID NO: 529506 - DNA, 451 bp, Homo sapiens
  misc_feature (22)..(22): n is a, c, g, or t
gaaattcggccattatggccgngggccgtcgacggtggtggtgactgactgaagcccgttgacaggatggttggccacagatgggggttggaattaggagatctgcacatccaacaccggtgcaccagtttgccagttaaattcaaaaaactcctggggccaggaaaaattcagcacattttttgcacaggaaacctttgcaccaaagagagttatgactatctcaggactctggctggggatgttcatattgtgagaggagacttcgatgagaatctgaattatccagaccagaaggttgtgactgttggacagttcaaaattggcctgatccatggccatcaggttattccatggggagatatggccagtttagccctgttgcaaaggcaatttgatgtggacattcttatctcggaacacacacacaaatttgaagcatttgagcatg

SEQ ID NO: 529507 - DNA, 675 bp, Homo sapiens
tcccacaccaatgaaaggactctcccggccagccagggccttttcccttaaacttttaccgccttggatagtgcaagaccggtttgggttccttttcagctggacctctctgtacaataagagtgggggaacacctccccaagggtgtaaaaacagacactacctgacgttagtagtattgtgtttttgcggtgcccattcccaacatgtctgctatatgcaaaaaactagaaatacgtcgtgcatgatcatatcaagatgtattacgctcctccttttctacggttcaaaggtaactgaatagatgtgcgaggtgatcgccctcacctgcacagggtgtgctccgagaccccagcaggtgctaaatccgcgtatagtccagaatcctgtccaggcgctgttttttcgtgtcgccacctgtgatcaagtgtgagatgtgacagcaaaactgccagtacgtcgtgcttccctcttcaaaatgtcacagatgggctctgtgttctccccgcagatattagcaacctcggcatctggctgtttttattataggtcaggagttgcccccttttcccttaaaggaagcgcttggcagcttctctggtgtgtctgagtcgccagcatcaccactgtcgtgttctgggcccattcttgagtcaacagcagcttcttggaccc

SEQ ID NO: 529508 - DNA, 446 bp, Homo sapiens
tggtaaacgctagatacatatcggaacagtgatctgataccaagatggctacgtattagtccgttttcacacgctgtaaagaacgcccaagactgggtactgtagaaagaaaagaggtttaattgactcagttctgcgtggctggggaggcctcaggaaacttacagtcatggcggaagatgaaggggaagcaaagaccttcttcacatgatggcaggaaagagagagctagcaaaagctggaaaaactggcttataaaaccatcagatgttgtgagaactcactatcaggagaacagcatggggcaaacggcccccatgatccagtcatctcccacggggtccctctcttgacacctggggattatgggtattacaattcaaggtgagatctgggtggggacatcgccaaaccatatcagctactaagtgatcgtggggttgtaa

SEQ ID NO: 529509 - DNA, 577 bp, Homo sapiens
cacgcgtcgatcagaggacatgctcagcagatccaagagatatatttggcaactttttctagaaaaggcacattgggtatcattcattacatttttgagtttttttgggttttttttttttttttggaaacagtctgtgctggttttggcccaggctgggatgtgtgggtgggcacaatcacagctcattggcttcctcaatcacccaggcctaagcaatcctcccaccttgtagctgggactacagctcacagcacaccgggctaaaatttttttttggtagagacggattctctatgttggcccagggctgggtctcagggcctccggggctcaagatgggtcctccggcctcagtttccaaagggcacagggccaagttgtacgcttggtcccttgccatcatgcccaacaaggagggttctataccttttaagtgaattggacttctcataaatgggtatatgtgggggggcaagtccttaaagcgggaattggtaaattcctccgtgaaaggtttttccatgcagttaccagtgacctatttactacaataagggagggtctgggggtggtc

SEQ ID NO: 529510 - DNA, 1353 bp, Homo sapiens
ggtgagcgggtccactacagctgttggtgctggatccccggtgctcgttcaccggcgccgattcgcacagatgtataggagcgcccttcagtgtacctgtcatatcatgcagcggacgcgacggatgtgcctctcaggtgtcccttggaggacggaacccacgtctaggtgagcaccacagcctggcagttgccagatggtaacagatatcagtcctataaagaggaaaaaggtgatcgagccatcgtcatagttgatacacatcatccatagacgagaccctgaggtacaaaagcgttccctgcatgcgaaccgtcgatgactaatatgtgggcacacttcgtacagaccctgtctgaaggtccgggtttcatgatcctccatagaaaattagctggcccaagagagggctgtgtgtcttgaaggatatcgactgcctgcacatctgggaacgtcaagtccagatttgacgtggcccggcatgtcagaatcctggcatagccattcacgtgaatcacaagactccagagcaggaactttaccgggggaggcgcaaagtgcttttccttgcctggatttactctgagaccacagaggacctggacgcatgccaactgcgtcatcaagcggaggcgtcgaatcttgcactgcttgtaaagctcgtaacccttacccaatttgcccggcctgcagctaacgatcgagatttacgtcccatccatgcgggctaactgggtgggcaccatttgtggccacttcccaagtggcaaacaagtcaaaacggggaaggcttctagccttcaggatgggcgcttttggacttggtggcgctgagacttcgtgtagagctgtcggcgaggaagtgtaccatggccgacactgccagtgggaaagccaactttcccccggtgtaaaccaccccaaggtcggcacgggacctcggggcgtggaccccggcaacatggcaaacagggaggacaccctgaccagcaaccagtgcgaaaacagaaacgaagcaggctcagcagggcagtaaaaggggcggtgaaagccaacggagggcaattcccgggaggacaagcgagcaggccccgaccccaggcatacccagcgtaattacagtcataaggtatgcgaacacggtgccagcaaggtgacaaggagggccccatgagactaatcaagaacttccgacctgacaccagtctggcaagacggccacgggcgactgctacgaagacaccaatgaaggggcaatgaagtgatccagcaacatgcacagtaacagcgtcagaatagccacagccgctcgccaagtggctcaaacaacacaacctagcagcgaccataagc

SEQ ID NO: 529511 - DNA, 546 bp, Homo sapiens
  misc_feature (510)..(510): n is a, c, g, or t
  misc_feature (516)..(516): n is a, c, g, or t
  misc_feature (522)..(523): n is a, c, g, or t
  misc_feature (540)..(540): n is a, c, g, or t
ataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaggggnactcancaaccnntgatttacgggccgacnataaaa

SEQ ID NO: 529512 - DNA, 353 bp, Homo sapiens
tgccacaggatctgttcagtttatcctgggatggctgtataggcttcaaactttgacattaaagtgaaattataaggatttttctccaagccagggttaataataagatcagtcacaacctattcccattcagcaagttatagaaaataatagaatgcctggttcatctgttctacgtcaatcgattttcacattcacgtcctcctgcctctttcgcactcctaccattcaaccacgtttgtcccatcaacacccactctgggaatcaagacctctttcagacagacagcaatgcagataaattatcatttggacattgcttttcgtagttgaaaaaatgctttgtgaaaaaa

SEQ ID NO: 529513 - DNA, 114 bp, Homo sapiens
cctaaatattgtagccttttctgtaattaagctcgggtacaaattggcataccatggaaacttattgaactagcaattattattaaagaaatattacgattatcattgcttctt

SEQ ID NO: 529514 - DNA, 249 bp, Homo sapiens
aggaatctgaggagacgacgaccattgttccctgtggcccatacatcaaaaccggtctgagaagacaccctggtcgagaggatagaacacctttacagtggccgtgtcctcgggcctcaggctggtcatgtgcaaagacgccctgttctgtgagtcatctctgtaggtggcgaatctgcctttcaccgacgcaggatattctgtcgcgtagttcttagacctacttcggacatggccaacccactccag

SEQ ID NO: 529515 - DNA, 1416 bp, Homo sapiens
tcagtgcacctaattggaagcgccaccctagcgaatatcgaaccattgaaccttccctctacacttatcatcttcagcgaatgcgtagagttctagctgactaatccgtagaaatcggcgtgtcgccgttacactccaagacctacgtttgtcacacttctagtaaggccgtctacctgcacgacaacacataatgaacccacctagatcacaatgccgtatcatatatgtcaaaacaccagccctatggaccccataaacacggggcccttcgtcagcgccttctctaactggactcttctcggcgcgtagcacatggtgatttcgagcgtatcctacttcccagtgaacgctcccttcgagtatcgtaagagcgcgtacttaagcgcagaaagcgagcttaatccagtagtatccaagtgatcgcgccgccgagtggtatacaccgacgaaggcgcatcactaccaagggcacacccacggagcaaccaaccgtgtcccaagaacaatgtgccgtgtcgactaaacgggataaatccgtattttagttagcctcagacagtcgctttttctttcgccaggagttttgtctagagcgcttttaccaactccaggccctaggcccctaagcgcgcccgaattaagggaggggcgactgggcccccgagacatggtcgatgcagccccgtcttgaaggcccccttaagaaagcttcccactccgtaaagacagcattcccgtaatttacgtccgcaattcagggagttactcaatgcagccttgaggctcacccaataaggtcgtaataatgaaacgaacaatcggaaaccaagggtacgttcaaagccaactgggtttgacttacccaacttttcacgtggggatacctcaaaataataagcccttgtgcttaaacagggcctccagaaggtgacattgcggagatttccccgtatgaaacaggagccgacaccatcaacgcgtcaacgcaccagccacaaagccacatcacaatagacacagggacgcggcgcacgagagaaatcacacgcgagagggagccacaccacaccgacgtcaacgcaacccaccgtgatagcaaacggtcggcccacactaaggagccgtgattatgcaccaaagacacgcgcggggggtcaaaacaacagatctggatctaaaagactaactatcgtctatattaggagaaacagcacatgctgggctgaaatgacggcaccaaactacagcacagacacgcgcggccgtatcacatacataagaatcgaacgtacgccagcatagtgccgtcgccgctggtatatactacacaaccatacctgtagtgctgctagtgccgaggtctgcttatcagacacacctcatcagctctcaatagccaggctgccacagcgc

SEQ ID NO: 529516 - DNA, 346 bp, Homo sapiens
gtgtgagtggggaaagaaaacaaggtcctctccttgatcttctcatgacagtgacatgggcacgtttgggaaacacaggatttcaagttcagtgatgggggttaagatctgagggggaggcctggacatattttttgcactgactctgatggttgaggcaggtgatttagttctggagtgcagactaatcagctgaccatttgctctcactcctctgaggtttggatgcctaagaagagaggatttgagccaataaatggctatggggtgcttggaacccagtaagccctcacttctggtggaggagaggaagggcctgtggctgcagacagacctcatgtgaccc

SEQ ID NO: 529517 - DNA, 401 bp, Homo sapiens
tgtggcttgcccgtcaatccgtgcatgagcttatgtccttagataatgcactcactacagggctcagggcatctgcgtgttacagggtacatgaggtacatgagcttccgccatccatacgtttaactacatcccatcgggtaattaagtgatttagcttctttcacgtgatagatctgcatggacagccattcaaatactcgtaagcctaagacagcagatggcgtttactatcgacggcaaggtcggtgcactaagatgctgaagttggcactgcccatgtgctttccagtgtctagggtgaaccgcccgtgtatcgacagcgtcttaaaagcgggccagatctaggtacagatgtcaaggtgtctgtctctctctctctctctctctctctctctctc

SEQ ID NO: 529518 - DNA, 338 bp, Homo sapiens
ggtcgacacccgatatatgttctctaggccttttagaacacatggagttgctcctttggccacatatatgcgaatctatcagaaaggtcatattgtagacatcaagggaatgcgtactgttcaaaaacgcctgccccaccagtgtcaccctggccaaactcgcagagtctacaatgttaccccgcacgctgtccgcattgttgtaaacaaccaagttacggcgaagattcctgccaagacgaattcatgtccgtattgagcacattaagcactctaagagccgacgatagcttcctgaaccgtctgaagcaaaatgatcagcaaaacgaaagaagcca

SEQ ID NO: 529519 - DNA, 456 bp, Homo sapiens
agcgttaaatgcctcgttcgttcagtcaggttttccttgttcccgcatgttcagccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggaatcctattcatcttcttcaccgatatggtctgtggactctgatgagccaaatctgacatcagttctggaacgtctagaagatactaaggagaacagttcggtgaggaaagaaaccaagctattttctcttttcctcatgaacattatatttagaaattaaatgttaagtgataatattatataaaaacatgattaacaactgtaatcttagaggaattaaagtctgggtattttaagtcctccaaaaaaa

SEQ ID NO: 529520 - DNA, 878 bp, Homo sapiens
  misc_feature (121)..(121): n is a, c, g, or t
gagcggagggggaaggggcgatcgcggcggcggcggcggcggcgaggagctgtgccttccacctctccagccccggcaggacgggggcggccgccgcgaacccggggcggggacagcacgnagcctcgaggcgcgcacccccgcccggcagcggccccgacacccggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgagctcatctgccgcaaccggacgggtaccaacatgatgtacttgctggctcattggggcccaggtgctcctgggcatcggtgctacccctgtgcagcccctgggcgtctcctacatcgacgaccacgtgcggaggaaggactcctcgctctatataggaatcctgtgcac

SEQ ID NO: 529521 - DNA, 685 bp, Homo sapiens
gccatttcgtattggccacaagaagttaattctgcagctgcgagggcaggcagtccaatatgttgacgctatttcgcctaactgaatcaggcccctgcgcgttttcgggatcaatagctggtagtacatctcgtccagcaatccaaaggtcattgaagatggagcgcaagatcacaacactttgtcttgtggtcagcaagtcgctctgagacatcttcgagccctagaatggtcgtgctgtcgattcatcccgccagacggtcactgctgtggtcaatgctgatcgcctcatcgaacactttctcctaaagacagtttccattaaactcgctctgactgtccttcccatatagtgtggcacggtaaagataatcaatccccatgctatgatagagctagcagcctacatacaatagtatttctcgtgccagtcggcggttctcagcacagatatccccatctacagttatcagtcggttcgtatggcagtccagagcttgcttgcatccagaagtagcctaatgcatcgacacacatatgctcagcgttcgcatttgctcagatgctcatgtaattccgtctcatcggcgtgagggctgtgccaacatgcgcatggacccagtgctggacagcgtagtgtcgcagacaatactcgtagctagcaagcccaagctgagccggacac

SEQ ID NO: 529522 - DNA, 398 bp, Homo sapiens
  misc_feature (358)..(358): n is a, c, g, or t
  misc_feature (361)..(361): n is a, c, g, or t
  misc_feature (398)..(398): n is a, c, g, or t
ttgtcaaagcccaaaagaacacttaaccctgttgcctaaaaagtactcatccctcccaccctctccccagcccaaggaaagagcccagtggaggcccctgacccttctccccgggaacacgggccccaggaagtgcggagccagaagtggcaactgcaccccctgaaaaggaaataccttcattggatcaagagaaaaccaaacttgagccctggtcaacatggcaaaaccctgtctctactaaaaatacaaaaattagccggttgtggtggtgcacgcctgtagttgcagctatttaggaggctgaggcaggaggatcactggaacccgagaggcagaagttgcagtgagctgaganttncacggcactccagcttgggcaacagagccagactccn

SEQ ID NO: 529523 - DNA, 587 bp, Homo sapiens
cggcccatcgctgtttttttttgtgtgagcagcaaggctgtttatttcacccgggtgcaggtgggctgagtccgaaaaaggagtcagcaaagggtggtggattatcattagctcttataggttttgggataggcggtggagttaagagcaatgttttgcgggcagagggtggatctcacaaagtacattctcaagggtggggagaattacaaagaaccttcttaagggtgcgggagatttcaaagtacattgatcagttagggtgaggcagaaacaaatcacaatggtggaatgccatcagttaaggctattttcacttcttttgtggatcttcacttacttcaggccatctggatgtgtaggtgcagatcacaggggatatgatggcttagcttgggctcagaggcctgacacctgtagtcccagctactcgggaggctgaggcagaagaatcacttgaaccctggaggcagaggttgctgtgagtcgaggtcagcctgggtgacagagtgagactccatcttagcgttcatcttcctttccttcaatttcattgtttcttctgtcattcatataagagctaatat

SEQ ID NO: 529524 - DNA, 146 bp, Homo sapiens
catcgatactgtccaatacaatatactagaactatttcatctccccatcatgtctgccttctagttgccccaaaattatgtgagatgctagaagttgtatgacctgtgattgttcttgcttccttgtgtccttacgtacgagtaca

SEQ ID NO: 529525 - DNA, 207 bp, Homo sapiens
  misc_feature (82)..(82): n is a, c, g, or t
  misc_feature (140)..(140): n is a, c, g, or t
  misc_feature (203)..(203): n is a, c, g, or t
ggatacaggacgggcagctacaagaacagccagtgtcctgaagtcggactcggtcaatgtgggagcgggcttgctcgcgaantacggtgggtcagttaatacatagggtgactgatagaccgcattcgcgagcaagcccnctcgcacattggatcagtgtcgtctggtcgacctggttccaacaaaaaagccccggctgattnatcg

SEQ ID NO: 529526 - DNA, 564 bp, Homo sapiens
  misc_feature (57)..(59): n is a, c, g, or t
  misc_feature (61)..(61): n is a, c, g, or t
  misc_feature (72)..(72): n is a, c, g, or t
  misc_feature (76)..(77): n is a, c, g, or t
ttggcaaacgtgctgctggcgggcaaggcttccggcgccggacagccctgccactcnnngnccgccttttcnacgnngcgcgcgccggcagccccccgccgccgcccccgccgcctcccgcccgcgacggcgagaacacccagcccaaacagatctgcaccttctgcctcagcaaccagagaaagttgagcaaggaccgcgacagaaagacagcgattcgcagttaggaggtggccggcagcagccaggaggcagacgctgctgggggaggtggacgcccggggtgactgcagacagcccccaccttggacctgagctgggcaaggcccaccgcaagcatgcccccaggccagccctggctgcgagcggggccgagggacagacggacgtacagacaggcgccggcagcgggactctgcgctggccccagcacctgcccgggcccactggaactttctgcgctggcttttcttccggccactgtgtgatggcatcttgtgtttttgatatgataatataaagtctgaaaattttgtataattaaaaacaaaacagtatcttcca

SEQ ID NO: 529527 - DNA, 184 bp, Homo sapiens
tttttagatgtctttccattattttaattaattgaagcacagagaaacagaggcaaaatgattaaaaaatttatgtttttagacagggggttggctttacaccaacgaaaaagaaaaacacgatgaataagcttttgatcttacattttctttcccttaatttctcatctggtatggctggaga

SEQ ID NO: 529528 - DNA, 144 bp, Homo sapiens
ggcggtccgtagccgatcaactgagaaacagcatccaggttatttattcatttatttgagttgagaatctccctctggtcatccaggttagactggattgctcacttggcagcctcaaactcctggcttcaggtgatcctcctc

SEQ ID NO: 529529 - DNA, 665 bp, Homo sapiens
ggagtttatttttctctttcgaaaacgtcctgcacggccatggggttggcttgaacccacctttggggggttcgatccctcccttttggtctaaattaatgtatccgggtcctccaatgtgtggtagggtgggggccactccatatagtcactcccagtgtttatgagagggtccttctacctataaggacctttcccgcttcaaaccgaaggtcttctccaaatcatgaaaatcattaatatcacctgctgtcagagaaaatgaatgaccctcccgatgataggatgtccctgtggcgtatgcatcggggaagccgagtaccgtccggggcatccccggataggccgccaaagtgtgggggacaaagaaaagttaacgattaacccgcccgctgaatagagaccccgcggccccagggactctacggcggtagcgaatacgcgacaacgggatgtaaccccgggcaacaataacggtggcccaccgagcgacaggacacccccgcgtaccgaccgacgacataacaagggccaccacatcagcacgggccatcccgcacacgcggcgcaccacaccaccacaggtcccatgtcccacgccaacggccaagagaaggacgcacaacaacacaccgaagctaaggccacacaacgaggcacacaga

SEQ ID NO: 529530 - DNA, 321 bp, Homo sapiens
  misc_feature (11)..(11): n is a, c, g, or t
acgatcccctnagtggtcccgatgcgggattcaaggctgttttggagatggagacgtctgttgggtgagcagccttcttaatttcaatcgcttctgaaggggtgcccaagcccatggcctccagctccttctgggaggatttctctggcacctgcaagtgtgactcttggttaggggccagtccttctgggacaggatgctggtttttcgcagcagtgttcacaagggcttcagtctcttcaaaacttgaccctgaacacggtgtcggggactctgacatgcggacgggagatgacttgacagggctctcctgaatcatct

SEQ ID NO: 529531 - DNA, 431 bp, Homo sapiens
tggtcagattaacatcacatttagattggtcctatgcaaacaaatgcaattgattgcgtacactgtatactgtaaattattgtatctacgaccgttcctaaaaacagcaattatggtataaaaagaaacattataaagacgtaaattattaaaccaaatgccaaccagtattcttataatattactagctgctacccgtggcttcgcccacgattaaaatgaagattattagtcttatttcgttcatatcattatagtttgtaatataaatgtaaacaaagaatatgacacttcattcaaatcaaaatattcaaaagacagatgattatgttgcaaaagtttctaaaacatatgttgattcagtagctttaattttaaccatatcatatttataggtcgacgcggccgcgaatttagtagtaggcggccgc

SEQ ID NO: 529532 - DNA, 531 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (398)..(398): n is a, c, g, or t
  misc_feature (404)..(404): n is a, c, g, or t
  misc_feature (409)..(410): n is a, c, g, or t
  misc_feature (418)..(418): n is a, c, g, or t
  misc_feature (431)..(431): n is a, c, g, or t
tccgngntngcggccatcttagcggctgctgttggttgggggccgtcccgctcctaaggcaggaagatggtggccgcaaagaagacgaaaaagtcgctggagtcgatcaactctaggctcccactcgttatgaaaagtgggaagtacgtcctggggtaccagcagactctgaagatgatcagaccaggccaagcgaaattggtcattctcgctaacaactgcccagctttgaggaaatctgaaatagagtactatgctatgttggctaaaactggtgtccatcactacagtggcataatattgaactgggcacagcatgcggaaaatactacagagtgtcacactggctatcattgatccaggtgactctgacatcattagaagcatgccagaacagnctggtngaaanntaaacctnttcacctacaaantttcacctggaaaccttaaacctgcaaaatgttcctttaattaaaaatttgccttgtttttaggacctcgcaaaaaaaaacacatcaacaaaacaaacac

SEQ ID NO: 529533 - DNA, 231 bp, Homo sapiens
  misc_feature (70)..(70): n is a, c, g, or t
agaacctgccggtgggccagcgggccaaggtgttttccctgcgctacaccctgaccaatgtcggctacgncaccggcccgatgctcggcgtggtgattgccgggcagatgcccctggcaccgttcctgatcgccagcgcgattgcctttggcagcctgttcctgatgatcggcatcccgccgacccaacgcgacgacagcaacaaacccttaagttttctcagcaccactg

SEQ ID NO: 529534 - DNA, 291 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (289)..(289): n is a, c, g, or t
tccgngntngcggccatcttagcggctgctgttggttgggggccgtcccgctcctaaggcaggaagatggtggccgcaaagaagacgaaaaagtcgctggagtcgatcaactctaggctcccactcgttatgaaaagtgggaagtacgtcctggggtaccagcagactctgaagatgatcagaccaggccaagcgaaattggtcattctcgctaacaactgcccagctttgaggaaatctgaaatagagtactatgctataatggcgttatcacgggatcctctgacancc

SEQ ID NO: 529535 - DNA, 834 bp, Homo sapiens
  misc_feature (45)..(45): n is a, c, g, or t
  misc_feature (85)..(85): n is a, c, g, or t
  misc_feature (99)..(99): n is a, c, g, or t
  misc_feature (108)..(108): n is a, c, g, or t
  misc_feature (139)..(140): n is a, c, g, or t
  misc_feature (143)..(143): n is a, c, g, or t
  misc_feature (146)..(146): n is a, c, g, or t
  misc_feature (195)..(195): n is a, c, g, or t
  misc_feature (225)..(225): n is a, c, g, or t
  misc_feature (245)..(245): n is a, c, g, or t
  misc_feature (265)..(265): n is a, c, g, or t
  misc_feature (268)..(268): n is a, c, g, or t
  misc_feature (270)..(270): n is a, c, g, or t
  misc_feature (290)..(290): n is a, c, g, or t
  misc_feature (292)..(292): n is a, c, g, or t
  misc_feature (376)..(377): n is a, c, g, or t
  misc_feature (382)..(382): n is a, c, g, or t
  misc_feature (417)..(418): n is a, c, g, or t
  misc_feature (442)..(442): n is a, c, g, or t
  misc_feature (447)..(447): n is a, c, g, or t
  misc_feature (450)..(450): n is a, c, g, or t
  misc_feature (485)..(485): n is a, c, g, or t
  misc_feature (493)..(493): n is a, c, g, or t
  misc_feature (497)..(500): n is a, c, g, or t
  misc_feature (532)..(532): n is a, c, g, or t
  misc_feature (577)..(577): n is a, c, g, or t
  misc_feature (581)..(581): n is a, c, g, or t
  misc_feature (589)..(589): n is a, c, g, or t
  misc_feature (636)..(636): n is a, c, g, or t
  misc_feature (678)..(678): n is a, c, g, or t
  misc_feature (702)..(702): n is a, c, g, or t
  misc_feature (707)..(708): n is a, c, g, or t
  misc_feature (717)..(717): n is a, c, g, or t
  misc_feature (746)..(746): n is a, c, g, or t
  misc_feature (793)..(793): n is a, c, g, or t
tcttcacttcgtacaaatacttctttaagctgcctgaagcttcangtattttgcaacattcttggcctcaatatctaccccctantttttcacccccgncaaatttgnttgtatcacggtaatttggtgcaagagagtnncanccntatgtatttaatccaagctttgagcgccacattaagatttaaggattanacaaacttggctgtatttccactgcaaccngctaaaacggcttttgcacntcattctgccagtagcaatnaancnacgactaaatttactaaatnangcattgagtttgatgtctattcgtgtatactgtgtgtgttcttgtgcatgaaataggcctgccttctcatcttttctttaaaannaatanatgtttacatatatacattctccctcagattttannattcatgcggagtgatccacagtnataanatntggctactatgccacctggcccacagcgaaacatncaccatanaacnnnngttccaggtgtcacagccccttacattcaagngctgcactttcgtttagacacacacgtagtacatttcattacatnatcncgcgtggnaaggactgggttttctgtagatgtcgaattgctcattccaaaacgcnaaaatgctttgcatcatgggagttaggaataatggcacccangaatcttgtcaagaagctcttttntgttnnaaactttcncaagtttgcattgacctccagggtaatanattttcaatgggttttcattggacagttgggtatgtttttaagcttnttataagggacagatccagctcaaccagggggtgacacatt

SEQ ID NO: 529536 - DNA, 224 bp, Homo sapiens
  misc_feature (5)..(5): n is a, c, g, or t
  misc_feature (7)..(7): n is a, c, g, or t
  misc_feature (9)..(9): n is a, c, g, or t
tccgngntngcggccatcttagcggctgctgttggttgggggccgtcccgctcctaaggcaggaagatggtggccgcaaagaagacgaaaaagtcgctggagtcgatcaactctaggctcccactcgttatgaaaagtgggaagtacgtcccggggtaaaaacaagactctttaagagttattcaaacaaggcaaaacccaaatttggtgcatattctctaaaa

SEQ ID NO: 529537 - DNA, 701 bp, Homo sapiens
ggaactgcaaagcttggctgaggccggggattagaggatactcacaaaccctgcggaacacagtgtctgttcagcaaactaaccagcattccctacagcctagggcagactagatagtataggaagtctggaaagagaaactaaaagacagaatttgagaatccttggaccactcctgtcgctgtagctcagtcatcaagagcgaagagagtctgggttagctctattaagatggggaaaatgtgacactatcgcagaaccactcaggtccacctgtatggagcccgcgagtgctggaagggagagaaggctgttcttctgtggttcaatgcgtagaggctacaggggttagcctggactaagaggcgatccgtggcttcggagcgtattacacactgaggagaaaaggatctaagggaagatcactgtagttcatgttctgtttggctgtgtacactaccgctatggaaatgtctgctggtattgctaattcacacaggtgatgagagtgcctgattgataatatataaagaagaatagacaacttgcatgtcttgctatgtaatcgtgtgtcatggatcggatctgtacatgacggtacataagggtggatggttcctcagggctgaggggcccaatgtatgtgtggtgtgggtgtgggtgggaatgaggtggtgggtaaagaagggagagagaggtca

SEQ ID NO: 529538 - DNA, 299 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (267)..(267): n is a, c, g, or t
  misc_feature (280)..(280): n is a, c, g, or t
  misc_feature (290)..(290): n is a, c, g, or t
tccgngntngcggccatcttagcggctgctgttggttgggggccgtcccgctcctaaggcaggaagatggtggccgcaaagaagacgaaaaagtcgctggagtcgatcaactctaggctcccactcgttatgaaaagtgggaagtacgtcctggggtaccagcagactctgaagatgatcagaccaggccaagcgaaattggtcattctcgctaacaactgcccagctttgaggaaatctgaaatagagtactatgctatgttggcntatcgagggtacnaactcgagtngtatactgc

SEQ ID NO: 529539 - DNA, 886 bp, Homo sapiens
ggctgagaacatatttaacagacaaatggtggcccggagtttgttcgataccttgagggaagtctgcgcatgatgatccgagattgtcttgctgttttggaaagacattacgcagattggccgatgattcacgaaccaacatgatgagcagcggagcatgatggaacaggtgcctcacatcgcaactgtttcggtcactaagaaccggtcttcaataccatagtgctgtgtctctcaaaagttcttacgtaccgtattgtggctctagatacgcttgcgaagatcagaactaatcaggctgaggaaaacaagtcagcgcagactttgcctgactctcttggaagcaggagctcattgaacgatttgatgtggagaccctgtcttgaccaacaagaaaccatcatcacagcacacatctagactagtgctttgactacaaactgtgataccatggcctagcgcgagacattgacacacaaaatagagcatcacagttcccaagggctacaaagtacttactatctgagcctttaacaaaaagcaggatcgccagccactgaagaggaaccaaactggtacccatcgcccatgactagaagcatcaacgacgtcatggcatcatccgtgatgtgcaagacaactttctttggcaggcttggctatcttatcccactaccgcccatccagcatgctagggtacagacaagtgcggattataaagaatctccattcttgctgaaagggcttttaaagacatgggacttgacgtacctggatagcctgcctgggacacccacgcttgtgaggaatggggtcactccagaccattcagaatccaactgcaccactgcgctaaggcctcaaagactcggagatctggatcaac

SEQ ID NO: 529540 - DNA, 431 bp, Homo sapiens
accgggccgcattgagagtgccacgttttgccttccggcggctgtgcttcgcacacatgcctctgcccgtgcttcggagtatgcgtctacttgtgtgtacgttgtgtttatgtatgtgtcgtctctgtccccaccagacttctgctttagctgccaagtttctgttacttgtattttttaaaaacatgctactccgataggtatttctgttacttctaagtcacagaatgacactgataaatcatacatcaaaatagactattaaatctttaatgttcaaatacaatttttctagaaaagtaaaacgcagaaggctggaaggtgtgaccggcactccactctggccttgctccttaactgcaaagtcacacctgctgactgggcgcttaccctaccccgacaccaggaggatgccagtctacgcctcgaaa

SEQ ID NO: 529541 - DNA, 228 bp, Homo sapiens
ggctggagaggccggccgagtgtgcccgtaccaccctgctctgtctgagaggatggcctgggttccagctgtcacggtcgccagctagagactgctcgtcacagatgaaatgatgacaggacgtcaactcgccctatgcagtcggaagcggggtacacacaaacactctagaagccacacttagcagggatttccagccttgcgggcgaggagagggtgccaccagct

SEQ ID NO: 529542 - DNA, 326 bp, Homo sapiens
  misc_feature (5)..(5): n is a, c, g, or t
  misc_feature (7)..(7): n is a, c, g, or t
  misc_feature (9)..(9): n is a, c, g, or t
tccgngntngcggccatcttagcggctgctgttggttgggggccgtcccgctcctaaggcaggaagatggtggccgcaaagaagacgaaaaagtcgctggagtcgatcaactctaggctcccactcgttatgaaaagtgggaagtacgtcctggggtaccagcagactctgaagatgatcagaccaggccaagcgaaattggtcattctcgctaacaactgcccagctttgaggaaatctgaaatagagtactatgctattgaaacttctaaaactagggctattgaaacttcgaaaactagtgctattgagacttctaaaactag

SEQ ID NO: 529543 - DNA, 371 bp, Homo sapiens
gtcgctgcggtgtcttcggccggcatgtcccccagccagaaggggatgctttcaagacagcatcagctgcagtagtatcaagaagatgtaagcttgccctagggttgcctgcataagtatttgggtttctcaggcagtgggcagggccatagagttcccaagagattatgtcttttctctcagaaagaccatcaggtgaaggcagggttaggcatgtctgagagcagactctctttgggttgggcttgttgtggccactgtggcggatgggggtgtggctctcaggccaatggagttatgtttccagggggattacagctatctctgctgcatcatacaggtcaccagggaagtgggggaaagccagcaat

SEQ ID NO: 529544 - DNA, 113 bp, Homo sapiens
gcgaggtatagtaagttataccgaccgagagcttccccgattatagcagcgatcgttactgccgtgactggctaacctgtgccttgcatcagaaagtggtcgatcacgtagcc

SEQ ID NO: 529545 - DNA, 684 bp, Homo sapiens
cattggtaaaacaggattacctagcttgcctgaactttgggcatggaagaaagactgggaactagttggagaaccacatacttatggaaaagagaagtccgcccttttatgctgttaaccagaagtcagagtgattctccccccgaaaaagtttaactatgttgtaacgccagcccactgtaaatagtctattttgaaattccctatgctaagggtgcccttaggatccattgtggtcgtctgtttatcccagctttacattttttgctcccaccatttgaatgccaaagaatcttgtgaagtctaccaggagagaagatgggatataattttcccttctgacaccataatttggggcccaaaaagaaagtcttaagagtttatcttttctctgctgatacggttgcttgataaagacatctccaaatgtgttacccatgttttaagaagctttgtgtgatattcttcccaatgtagttacccaatataatatggtagaaaaggctaaatcatacttaatgagccaattgaagtaagcttttaaagtatatttttcttttggtgaaaggcccatggagaccttgtgaatttaagtgaacctttgcctcacagatgttaactataaacaccctgcataccatttttttttggataaccaatgaatgcttattgctgcatgatgta

SEQ ID NO: 529546 - DNA, 772 bp, Homo sapiens
cgcgctacgcgcccgtggggcccccgctcggttctccttggatttgggcggggggaactctgcggccgccccctctctaattgtgttggtctggtttgccgccgacccgcgtcgtttatacgacaagggtttccgccgctcttcgccggcgtcatctctcgcgcgacactcattgtacccccgcgcgcgagattttcgggggcccctctctgtcgcgccgcgcgcgagttaaactcacgctgcgcaggtaccatcgctccccccacagagattctcgttagacagaaaaataggcggttctacacgacaccttggtaggtaggctataatatgtcactacaacagtatgtatgtaatggccgtacataaaccgtagacttataggtgcaaaagacatttgtgcgaggccgatcttcgtccgcgcataggattgtctagcaaagcccgtccccgtgtagaggattgcttccatttacccgccatgtagagatatcattgcgagtggagagcggcaaggccctcgcccggttctattcgccgcggtggataatcgaaacgtgtctcgtagcacccactccgcgcatgacgtccgtggtaaacaccacaccggagcagtcttgttgacaatagtgctcccgccacgcagctttgcgccgcagctctctgtagtattgcttttgtaatctacctaatgtacaccttctccttcgcgggcactcgctgtggccaccatagaacccgccagttattcacacacaagcaaacaaaacac

SEQ ID NO: 529547 - DNA, 374 bp, Homo sapiens
gtcgcagcagctcagcagggatcaatacggcttaacttcgcgctgacctttgggtctctctctcatccgttctcttggctaaccttcattttggtgccaaaacccaggaaggggataggctctggctgggcgtccttagaggattctttctctctctctcctatcatcccttacccagccaacctccccttcccgaacctgctaaagaccctaaggttctcccaaagttttcccattgttggccacctcatccaccatcaaagcctctggagagggttttttacagggccgtgttagagccttcacccatggtacagtacaagatatgatgctactccgagaataccgacagctccagggaccagagagtccct

SEQ ID NO: 529548 - DNA, 284 bp, Homo sapiens
tgaggggtgactctagcaggatccttacatacgataaaacctaagaatccaatgtcattatgggtcatactatgcctatatatccaaatggttcttttttacctgaatagtaggttacaatgggggagattattccgaaccctggtaggatgagaatatatacttctcgggtgtcccgaaaaatcagaacaagtgttgataacaggatagggtctccaccacctgtctggatcaaacaaaggttgtgttcacggttgcggtactgtcagatagtatatgtaatt

SEQ ID NO: 529549 - DNA, 536 bp, Homo sapiens
ggtcttcccctcgtgtggccctgagcgggactgcagccagaccccctggggcgccagctttggagcgcccccgacagctgctctcgggagcctgcatcccgacaccctgagcccctgctggagcctcccgctcccgtgtccccggcatccagggctccctccgacatccccacgacgcagtcgagcacggcgacggaagagagcgccgaataaacaggggaacgagacgccatgagaacatgacagggaaaagagcagaagagaggatgcctgaaaggtaggcaagtacaacatgagacagagacgggagaaagaggagtatcaaaacagagcagtgccaccacagcacgctaggctagagaaaacacaacaaacaccagaatacgggaccctacagtcggcatacaggcaaaccgtcactgcgggacggcagggagcgccacatgtgacagacatagacgctggccacgcatagcaacgttgcgctggagcaaacagtgagagcatgcctgcccctgacaggcccatgcagaacc

SEQ ID NO: 529550 - DNA, 175 bp, Homo sapiens
tcagcttactaatccgacaaccaaaccggggtgctgatccaggtgtacgaagggcgaagaagggccatggacgaaagacaacaaatctagttggaggcgcttcgaagctagaagcgggcatcaccttccggaccacccaaggggacgttggcccccaggaatcgacgggtgaacc

SEQ ID NO: 529551 - DNA, 436 bp, Homo sapiens
acgctagagtgatctccggcttcctgcttctgccgaatacagaccgttaaagctgggcctcacaattcttcttaccttcttgggttgttaacgcagcgaggttgtcccaaatagttaccacagggatcactggccttgtggcggccaagcgttcatagcgactcttgctttttgatccttcgatttcggctcttcctatcattgtgaaccagaattcaccaaacgttggattgttcacctactactagggacacgtcgctgtgtttcagacattcttgattggagtaacttttcgcgctactgatgatgtgttgttgccatggtaatcctgctcagtacgagaggaaccgcaggttcagacatttggtgtatgtgcttggctgaggagccaatggggcgaagctaccatctgtgggattatgactgaacgcctcta

SEQ ID NO: 529552 - DNA, 392 bp, Homo sapiens
gtccagcctgtggcctctcttgcacaaaggcttcgttctgattaatggcactcatgtcttggaggcatggattgtattagaccttgtttaaaagtgctcgctatacattcacttcccctggaagtgcaccaaactaggacgagaggaaaaaagggagcaagagaaaggccctgcatttggaaagagtagacagaaaagctttttttcataaatgctttctgtaactttctgtgctcttcaaggcattatctctgcagagctcctatgggagagcatggggaaaaagtgaagacagacgtcttgggaaagaaaatgggtttccctgccaaaactgggagatggtgctggctctcttggctttttagaaactccaagaaatctgctgacatttt

SEQ ID NO: 529553 - DNA, 110 bp, Homo sapiens
gaaggtaaacaacccgtactggtttctgtcagataatctgtacttgtatattttgaatacttaagtaccactgaatggttgccatgtctttgagcacttgatgttactga

SEQ ID NO: 529554 - DNA, 203 bp, Homo sapiens
taagcatgctggtgtgttcgtgggatctgatcgcgggttattgaatcttggccgccagttccggaatgaggggattgttttgacgcacaatcctgagttcaccacctgtgagttctacatggcctatgccgactcatcacgatctcatggatattcacggagaatgattgtttcagggattcgtagatgcatagtacaggctg

SEQ ID NO: 529555 - DNA, 748 bp, Homo sapiens
gaccctgtggaaccctggctgtgaccatgcatgtattgccacccacgtggtggtggagaacgaagctatgagctgtgagcagtgactgagccggcgtcagctgggccgcgaggcctttctacatggaagtctgtaagtgtgaacagagtgataaaggtgacctggatataccacacagttgaacgaatgcttgtgagctccgttgagactgggatctgagcctgtttcaccatggaccctaaactctcagcagctgtgacagaggcctttgtcctggcttcacgaggaaggcatcatctatcgcagtacccgccttgttaactggtcctgcaccctcaactcctggcatctctgacattgaggtgtgataacgaatggatgcttgacaggtctgcaaccctgctctccgtgcctggcatacactggagaagggtgagagttcggagtcctcgtgtcctttgcctataagtgtccacaggcctcaggaatagccgacgacggaaggtggctgcgtggcacagtaatctcacgcgatccgaggaacatattcgctgcgaagaatgtgcttgtactgtagtgtagacccccacatgattccaccagtacatgcgacctgaacaccgtgacgaagcgctgatccacccaactcctgccaacggagaccgatttccactagccgtacgacttacttcagtcgaacttggacatttcctgcatgtctcgctgatcactaccccgattactaaca

SEQ ID NO: 529556 - DNA, 1297 bp, Homo sapiens
gcggccgcctactactactaaattcgcggccgcgtcgacaccagcagcagcaggagggccccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctgggcctcctgcatcccctcgcctcagtgtcctcccaccttcaaagaatgaagagccccaggggcccagcccctgtgcccggggaaccaggcagccttccagacctcgggggcggaggcagactatgagggcaggcttgagttgggtgacacggcccattccctctcaggccagatcaggtcacccgggcctctgacccaggcctgtcacttggagaggggcaaaagggagaggggcttttcctagagaaagagaacaaggagcttgccaggtttcatgtagccgacacacgtctcaggatctcaagtccagatgggcctcacactagtagggccaatgcccaaaatagggagtcccagtggggggccaaatgaggagggacacagattctgggctgggatctcgtgtgctagcggccaatgacaatccagt

SEQ ID NO: 529557 - DNA, 358 bp, Homo sapiens
tttgaagatctggtggaaaggcagccacatccagggacggcacatagtcctcaaaagcggggatcggctcctccagcatatcggtcccaactttatcatcttcaactacacacggtattggaagttcctaaattcggtatcccaggggaactagttaagatgagccccagactaagccggcggctggaatggcttctggacgcactcctctaattccgccatatctgtctcatcatcccagggtttcacatctagtaagagggaagactgggcaccaggtgcaggttttggggcttccttggatccaggtggggcaagaggttctccccttagcctctgggcttcttcatttccctcc

SEQ ID NO: 529558 - DNA, 185 bp, Homo sapiens
gggggcccccccccggggggggggggcccccccccccccccccccccggggttttgggggggggggggggttttttttggggggccctttttttttttggggccccccgggggggggttttgggtttttttttttttttttgccccccccccccgtttttttttttttaaaacccctttttttga

SEQ ID NO: 529559 - DNA, 755 bp, Homo sapiens
  misc_feature (7)..(7): n is a, c, g, or t
  misc_feature (453)..(453): n is a, c, g, or t
  misc_feature (480)..(480): n is a, c, g, or t
gaacacnatggatctggtgctaaaaagatgccttcattcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagcntgtgtatatgtctggaagacctggggncaatactggcaagtctagggggccagtgtctgggctgagcattgggacaggcagggcaatgctgggacacacaccatggaacgtgactgtctaccatcgcggatcccggagctatgtgctctgtcatccagctcagcttcacatatgacaggtgcttctcggacggtccagtggggctggatgaggaacagcattctgaaatcagcctgacttgccctcagtcatgacctagggtattgctaagtgacctctacacggaatgggacagagggaac

SEQ ID NO: 529560 - DNA, 149 bp, Homo sapiens
tgaggccacaatcatggctgaaggcaaggagagcagtcacatcttacatggatgacagcaggcaaaaagagagagtatgtgcaggggaactcctcttgttaaaccatcagatctcgtgagacttattcgctatcatgagaacagcatga

SEQ ID NO: 529561 - DNA, 171 bp, Homo sapiens
agatacgatcgagctcggtaccgcttatgtgattttgagagagaggagagtcgaaatctcattgatgaagattccactattacagagcagttgttgctgttattaacttagcgttgagacaatatttttcagagcacgaagtcaattcattcacttaatctaatactcatg

SEQ ID NO: 529562 - DNA, 888 bp, Homo sapiens
gttcagcccggacgccagcagccccggggagccaggcggcggcgccctgtgcccgggcgcgtgggtccgttgccgtgggcggcggagacgtgcgttttgccggggttctgggctccgggactgcggcggggctgcggcgctcggccgcccggggaacggcggcccatggcgcgcgggtgctgggctgccccacacccggtagcagatcgctcggatttctgcagccctgcgacatgacggggcaggtcagagccctggcatgccaccatgtcccttgacagccctgggcaagcagctgcgcgctgcagcgacccctggatgtgcccactggcgcatacacgtcatggtcgcccattctggaaacaacctacctggaaatcatgggggcacgcaacaagccatgtgacccccacagcgcacacatcggcaggtgcccgcgcagccaggatggcacaggatgacagcctccagcacggcctggcacatgcacttcccacttggcgcgctctacgagacctcccggcggcaccaaccaggactccctgctgatcaggggacatggcccagccacctcactctccgaatccacaaacctacttccgccgaaccaacgatcctgctctcctgtcacccacggatgcctacccctgactgaccaggcacactgccgccgcatgcaagcgagaaccgcgtgagttcccgcaccggccccggagacacggaccctgacaccatcgcacagagcgaatacccagcaactgagcatcgtagaacgcgcaaccactcgcacaaccccaactccaacacagacgcccagtagtcgaatacgcgcacaccgccagcggtacgcagcgcccagccaccaaaccaacaacccccgcagcccca

SEQ ID NO: 529563 - DNA, 1818 bp, Homo sapiens
  misc_feature (180)..(180): n is a, c, g, or t
  misc_feature (346)..(346): n is a, c, g, or t
  misc_feature (348)..(348): n is a, c, g, or t
  misc_feature (466)..(466): n is a, c, g, or t
  misc_feature (484)..(484): n is a, c, g, or t
ataacggagctaggatccatcccaccttgaactgtgtcacactactgtatctataatagctgctgtgctgtgactccagacaattagtaaccctttagaaaacattatgaagcaacgcgaaggctatgcttagtcaatggtgatcaagagtgctcctgtctcatagtctaatgccgtgangatcatatgtgtcatgatatcatgtaaaatacatggatggctgttaagcgtgtgggatagatctatccctattgtgtaatattcttctctatcgatctgccgaatctgtatctgaaggtacctcaatgacacacgcatatcttattgtttgcatctataaatcgantncgtatgtgttctctcacatgtgtactatctaggaaacgagaacttgtggttaatttccactaaaacatcaagtgtgaactctacccatgtcggtgaccatatcctatcgagtgcgatnggagcgatcgaatagccntagctcgcggtgtagcttttggttgtcgcatgcgcataggagctaaagatatagcgtatcgaacgcatatgtcagacaccgaccatagagatcacttcctcgcagaaaattgtaacgttgtgtgcctatgggaatcccccagaacgtatgtctaatagactccttgtctttgtgtgcatattatccacctagaccttggtgtagcttgtcgtagcgattacaacttaaaaacgataagaaattagtgaggtttcacggtggcgccggtaacgatagcaaacaacagtatctcgtgtcgggtatgcgctatccgtttccatgactcaatgtgctcttttacggatgtctcccaggagaaattggaagcatttgtttggacgggggagagcacttcggttgtgcttgcgtggaccccgttccaattcctatctttgcaacgggttctcacacccggcttcccacattttagcgttctacatcctataagctctcccccgattatcacccacgctttagtgcggatttccagggggtggcccccccttttgttggcatttgggtgttttgggatccactttgtggtttgtaaattggaaaccaattgttgctttgccgcacgttccccttctcgagtttttgggcttccggatcgcattgtgacgcctttgttgaagttctctttctcaaacagcggcgtattatggggtcgagaaagggttctagcaccgcctgtttaccatttgccagttggggcatagtgcttccaggttgtgggacacccccacttttccctggcggttttgagggaggtcttcctagtgggacttgggccatttttcgtttatcccaatctccttatcttgctggctgccaacacttcggtgtcctttttgggcgtccctttgtgcggcgcttttgttcctttttctcccggcgtgaacgttggttctcttctcacacccaagtgttgctgctgggggtaccatctccgggtggtgcccccatgctgatcccccttgctgtgtgggcgggaggcgttggtgcacgcatgggcgtggttcctccccaagccctgcttttttttgttgtgtgtcccccccgctcttgctgtcccccagggcagcacgcgtttccaactgcggcggcgggaaacgctgtggtcgtcgagtgtccccacggcacaggctttggtgtgtggagacgccatcccccttgggcgcaaccacatctgctcgttgccacgctgcgccacacggcgtgcctgctgtccacgcccgtgtgtcggtctgccggccgcacccccccgtcgtgttcctgccacgcctcgccccttt

SEQ ID NO: 529564 - DNA, 485 bp, Homo sapiens
gctcagcttcccgagcagctgggattgcgggcatgtgccaccgcacctggctaatttttgtttgtttgtagagatgggattttgccacattgctcaggctggtctctaactcctgggctcaggtggtccatccacctcagcctccaaaagtgctgggattagaggtgtgagccactgcacctggctcataaagtaaactttaaaaaattaaattagccaggtgtggccaggtgcagtagctcacacctgtaattaatcccagcactttgagaggctgaggctggtggatcacctgaggccaggagttcgacatcagcctggccaacgtggtgaaaccccacctctacaaaaaatacaaaaaaattagctgggcgtggcgacatgtatctgcaatcccagctgctcaggaggctgaggcacgagaatcacttgaaccggaaaaggttgcagggagccgagatggtgccactgcactctagcctggt

SEQ ID NO: 529565 - DNA, 116 bp, Homo sapiens
  misc_feature (9)..(9): n is a, c, g, or t
gatcgctantcccacttggttgccggagccagtgataccggcgccgcttcatgagctatttgcagttacactccagtcatctacaagcacaatctgcccatcagattggactttct

SEQ ID NO: 529566 - DNA, 363 bp, Homo sapiens
  misc_feature (15)..(15): n is a, c, g, or t
  misc_feature (28)..(28): n is a, c, g, or t
  misc_feature (55)..(55): n is a, c, g, or t
  misc_feature (74)..(74): n is a, c, g, or t
  misc_feature (78)..(78): n is a, c, g, or t
  misc_feature (91)..(91): n is a, c, g, or t
  misc_feature (174)..(174): n is a, c, g, or t
  misc_feature (180)..(180): n is a, c, g, or t
  misc_feature (201)..(201): n is a, c, g, or t
  misc_feature (219)..(219): n is a, c, g, or t
  misc_feature (223)..(223): n is a, c, g, or t
  misc_feature (237)..(237): n is a, c, g, or t
  misc_feature (272)..(272): n is a, c, g, or t
  misc_feature (287)..(288): n is a, c, g, or t
  misc_feature (299)..(299): n is a, c, g, or t
  misc_feature (302)..(302): n is a, c, g, or t
  misc_feature (345)..(345): n is a, c, g, or t
  misc_feature (348)..(348): n is a, c, g, or t
  misc_feature (356)..(359): n is a, c, g, or t
ggaaactcgctgggntctccctgaaggnagagagtgagaaacccctgattgaacntggaagcaggaagtggccngggntcaaacccaccgnagtcaccatccaaaacaagattcttctccagccaacatcatcgatttccaccaccaaaaccaccctgggccacctggcggccntggaancccgagatgctgtgtacctgnaatatttagcatcatttnaggnggagctaaagaggntccgggatgactgtacatctcagataaagggggcncaggcgctggaaggnncagctggaagnagnccctgcacactatccaaggcctgtatgtgtgaccctccgcccnacnatgaattnnnnctaa

SEQ ID NO: 529567 - DNA, 1088 bp, Homo sapiens
gaggagcgcgcgggcacagggtgccgctgaccgaggcgtgcaaaggctccagaataggagggcatgatgaagactctgactggctgtgttggtgggggctgactggcatgaccgtggtgatgagctgggcaggtcctgggggaccatgacgggtctcagtaccatgagctccaggaaattgtgcaggtcagggaagtaagtacgtcacataaggaaattccaaaactgctgtcacacggggggtgaacacgagataaacgactcgtcagtacgcaaaaagacaaccgaagagcgcaagacactgctcagcaacctagaagaagcccggaggaagacagaggatgccctaaagtgagacgcagggagatcagagacaacagctgaaggagctcccgggagtgtgcaatgagaccatgatggccctctgggaacgagtgtaagcgccggactgaaacagaccggcatgagagttctacgcacgcgtctgcagaagtggctcaggcctggtcggtcgccagcttgaggagttcctgaaccagagctcgcccttctacttctggatgaatggggagcgcatcgacgtccgctgaatgggagaacgatcggacagcagacggcacatgctggaatgtcatggcaggaccacttcagccgcgcgttccgcatcatagacgagctcttcaaggacaggtgcttacacccgggaagcccagggatactagcaataactgggcttcagcgtggccccacggaggctccattttacttaccaagtccaggttggcagtagcttgatgccctttacagggagaagccttgaaatcccacgccagggtccaaccctccatggaagagaacggaagagcacaagcgcggggacacagtcaagacagcgacaagccgccgaaagagataaaaaagaggaaaacagcaggggcgaagacacaagacacagggagtgggaaaaagaaaaaacaggagagacaagagacaagaccaaccagcagaaggggcacatcagagcggacaaaggcacgagaacccgaggaacaagaaaacaaagaaacacaccagacggtaatagacgc

SEQ ID NO: 529568 - DNA, 195 bp, Homo sapiens
gagatcacaccactgcactccagcctgggagacagagtgagactgtccaaaaagaaaaaaaaaaggaaaaagaaaggaggggaaattccacacctgaaaaatacggtatctgaagtaacttcacgggatcgggtatatataaggtaaaaaagcagggtgcagaacggtgtgtatgtgtgtgtagtgtccatggtg

SEQ ID NO: 529569 - DNA, 568 bp, Homo sapiens
ccaacacaaagaaatgatcaatgtatgaggtgattaatatcctaaagaccctgatttgatcattacacattgcatgcatgtaccagaatctcacatggaccccataaatgtgtacaattattctctatcaaaaacatttttttaagaaacatgcaggaatacactctacctcttccttgctgtgtctggatattgtcacatgaggacttgacatgcggattgtggcagcctctgtgaccaagagcggaagacaacagcagcatagaaacctcaaatgaaaaatctaacatctcaagctactaatttagccaaccttggcatcagctatctctggtcttagtatatgaggcgataagcccccactgttcaagttgggtgtctatcaattgctgcagaatagaagttaatgaggcttcctcctcctggatcccctactagaccctgacatgcccattcagtcacaggcagaaagggaagcacagggtaaggagacctggctgactgtgccagacgcagatcttacctgtcctgcttagaacactcaaagctcaattggttaaacaaaaaa

SEQ ID NO: 529570 - DNA, 229 bp, Homo sapiens
  misc_feature (222)..(222): n is a, c, g, or t
  misc_feature (226)..(226): n is a, c, g, or t
ggctaacattacggcaggcagtacgtcagtgcacctaatgggaagcgccaccgtagcaatatcaagcattaaccttccctctacacttatcatgcttcacaattctaattctactgactatcctagcaaatcgctgtcgcctttaatccaagacctatcgttttcacaacttctagataagccgtctaccgtgcgacgacattgtgcactggggatccgtcntagnagc

SEQ ID NO: 529571 - DNA, 141 bp, Homo sapiens
tcatcggccggccgcgtttgctgacatgacagaaggcacgagatctcgagtcttgagcctctcattctttcaccacgccattacccgcctgcatccttctccagaattcttgtaccataaaataaatccccaatccccggt

SEQ ID NO: 529572 - DNA, 890 bp, Homo sapiens
tttcctggtttcggatcccagcggcggatggtgaaatcctccctgcagcgtgatcctcaatagctcagctgttcgcacagagataaatcggaaggggataatacctcagcgccaccatccaacgccagccagcaccatgcacgctcctaagcctgcagcagccgcggcgagtgcatgagtgagagttccagtgtctccctccactgctgtgttagaccccgtgtgtcccgtgggcctcggtggtagctcctgagtgccccatcacctctcccctaggaaaaatcccgaaggttgtggcggaggggaatagttccgagggatcatcaatcgttgcagcataatcgttattctacatccgatgatctgtcgtgaatgtaacgagaggaattaatgtccaacgataagacgagggattctcaacgtccagtccaggctcacagaagccgaaacagctgttaactggcgaactagtgctgatgtgcgcggcagcctctacggatcgagatctcgcgggcgggcgctggccctgaggggagcaatggacagtttagcagttctcctggagtttggctgaggagcatgtggagccgacccatgttgtcgtttggctccgataagaagcgggtgaggacagagcgggctgtgctgcgaaccttcatgcattatagggcttgagatgttgagacgggggccatccccggtttgtccccaagagacccgaagcgttgtgacaagggcctacctgttcgccagagagtctcggcaagaggagaggagtccgggcgctcggggctgggattcggcctggggcaaccctgttgcgggtgggggaacgggaaggcaatccccgggtgggccggggtgctgggaaaaaaccccccggaaagaga

SEQ ID NO: 529573 - DNA, 557 bp, Homo sapiens
aactgctgtacaacatccacccataccgggcttcccggtgctgtgctggacaccgtaccctggtatcttgcggatgtatgttcactacccgtcatgcatcaccttccaatggtgcaaggagaacaaaccaagttacatccactaccagcctgcccaggaccggctgcaatcccacctcgtggagatgctgattacagctgccgcgccacatctcagtcaccaaggtttccatccagtttgagcgggcgctgctgaagtggaccgagtacacaccagattcctaaccatggcttctatttcagtccatctgtcctcagcgcccttgtgcccagcacggtagcagtcaagccagtggactgggaatagagtcccctcttcaatcagcctgttcccagtctctgatggctctaactactttgtgcggctctacatcggagccgctgctgtgtgaacctgccgacaccggacttcagcatgccctataacgtgatctgcctcacgtgcactgtgttggccgtgtgctacggctccttctacaatctccactcccttaccat

SEQ ID NO: 529574 - DNA, 232 bp, Homo sapiens
tatgtgcagtactgaagagcaacttcagctattgagttatacctcaatgcaacctcctggcaggccagccttaagcccagcagggggggggtgcatctaagctgagttctcatcagagccaacttcaattataaacaactgagatgatgccagaggccataaaccctgagaacccaatttgctgtcatcaccatggctgaaacaaggcgcttggcatctaaaaaagctgatc

SEQ ID NO: 529575 - DNA, 686 bp, Homo sapiens
  misc_feature (397)..(397): n is a, c, g, or t
ggaattcagtttactataatactatgatagtttgttgaggacttttgcatctgtgttggtcagggatattggcctgttgtttcctttttttgttatgtctttgtctagttttggtatcagtgtaatgctggtcttgtagaatgagtttgaaagtatttcctcctctttggagcttgcagtgagctgagattgtgccactgcactccagcctaagtgacagagtgagattccatctaaaaaaaaaaaaaggaaaggaaaagaaaaaaagaaagtttttcctcagggtttaaacattactttgagtagacccgggtttttggtttacctggttgggtgggaattcagcagtgaatccctcagctgtggggcttttcttcgctaggagactttattactngtttaatctcattacttgttatggccctattaaagtcttctgtttcttcatggtacaatcctggtagattggtgtccagaatttttcccatttgtgtctaaatttccacttgtgttagcatttagcttgtccataatagtcctctaatgagtgtacttcgtggggccccagtccttatgtctccttttcattggtgacttcatccattcgagtcttctctttttggtagtctagctaaggtttggtcatttttttccttttttttttggggcacagatgtccccctggt

SEQ ID NO: 529576 - DNA, 910 bp, Homo sapiens
agcgaccctttttcgctgcatgtgctccttaggcactgtacagtgcccttaggaaacctgtaccgccaatttgtttaaagcggtttgcgcgtagtattttcgccggctttaaatcacttcccgtgttggtctcttccggacactccggaagagcggtttacgaaatctcggaagttcgcttggaacaaagaagagatttgggcagccacaggggccgatgtcggaaacgcggcccgccgaccttggcgttaccagagattttggcagaaacttctggcactggacgatcattcacagaacatgcggtccccggacagatgcccccggtgtcacagtaaacaaacagggggggaccccaaaaacgatagaaacccatttggcttggaccccccgccgaaaaacatttgtactgtctgtaagctcgccgcactcttgtgcgttcaaattgtgcttctttgacggaagcactaacgcggccgccttctggtgtagaccctcttttctaactctgggttcagtctgcagcacacgaggttttaacgccccgttagagcaaaggcagctgtttagtatagattcggggagcagaagaacaccagaaataatcttatcccgaggggggggcaccccaccctgtagcatgacttccccacgtggcggagaaaccaggcaggccccagatccgctgtggttcctcgaggcgaggcacacagcgctatcctttttagacccccccctggcttttaagagccgcggaatcccggccgcccccctgcaaaacagtgtcgaatcgggcctttcatttcccataatagcaggctcgattgtggcgaacggtagcagatataggggtccacgatacgcctgtatgttgggcgcagtgaaacccccttttacaaaaaacatgaca

SEQ ID NO: 529577 - DNA, 198 bp, Homo sapiens
tgttgatgatggaggaaacaggggaacatgggaaaatccgtacctaccattcaattttgctaaaactactctaaaaaataaaattaaagaaaaaaaaaagctcccctccttccccagttttacgatttatttatgctttgtgaaatggagtctcactcttgactccctaggcgacagagcaggaccctgtctcaaaaa

SEQ ID NO: 529578 - DNA, 782 bp, Homo sapiens
  misc_feature (249)..(249): n is a, c, g, or t
  misc_feature (256)..(256): n is a, c, g, or t
gaaggccgcggtagctcgagggaggcaaggtcgcggataaggagctgcatgcactgtggccaagcttgaggcctggcttggatctaggggccttgaatcgagtgataagtcccttgcaaggagatcttagtctcgttcgtcgcctgactcactgaagggaaccttgtgatgagtcagttgatttatcgtgtcactgggaggtcgtctcgtcgatatcgcactgagggtcttggcaaaggatgtatgagncaagacngccatcgcacacgcggaggatcctgtgtgcccgagaccaatgggactacgcaatgtattgcaatggcctattggggttagagctcagtctgcggtggatgttactacattggtgcacagctggtctgtggtcgttgtcagctggtgtgcaagttgcttccgctatatgagcataggtgagtgaccatgctggacaattccaggctagggcgcgactccgattcgaatgcgctttgtggcgcgaagacagacttacatctccgattcggttcacctccggtatggggccgccacggtaggagctttatcgtgggcgggaggaaaggggaagaacttcggtggaccaaaggtaacgcaaagcgataattgtctcccgccgtctgggtcagaaggggttgtgaaccgatgggggcgtgggtattggccaggtgcggatcccttggttggctgttgggtttactctggtctctttccaggttactcccgcttggagaataggctccaatggcgcggggtcgaaccattgg

SEQ ID NO: 529579 - DNA, 805 bp, Homo sapiens
gttgttagtctaattccagataacaggagaggcttcgccctcgtccaacgcagcgacctgtgccattggatcgccaagcttcatttaagcattctccacgtttgagatccaaagttgggcagcaacgtaaagtggccttcttctcacgctctggatcccttaggggcgtgtttattctgggcacaggaaaagcggcttgccgatcaaacagttacaactcgcagctaggaagaggcagcctgtgatggtcggatgcccgagttaccgttgacgcgctagtcggggcacccagacacagtttaccttctgcctccggctacgggcggtccctatgaaactctgtgagcttgttcccccttcccacaggaatctcttctctgagcgctgggactgacgggacatgtccacatgtactccatgctgcaggccacactcccttgacttcgctgcagctctccctcaagtatactgtttgctgtgcgctggtccccagtgcggacccttaggtttttgcagctgcctactgggaaaggatgacgtggacagctgtattgatctccagaaaagctcccagaaacccacagtttgatcaagcaaacccaggagtgaaaggcctgtatactgtctggagttcaacagccagcagactcagctctggcgcgggcgagcccagggcacagtgaaggtgggcagctgagcacagagattcacggaacagggcccgccgggaagcagaggacgtggactgcctggcagcagaggtggcggcctgaggtcccgggatacggcgaggccttcgtgtgcc

SEQ ID NO: 529580 - DNA, 353 bp, Homo sapiens
cctagacataataagaaggacattaattttttgtgtgaaactcctgagtcttgacggttgagtaccagcatccaaaatgaccaaaagagggaaaacagcatttactatatatatcagatttctttggttggggttctccccatgtggtattaatatttcttgttccaatatatattttaccaaaacagtaaaaaccaggaaaaaaaatagaaaactagcggtatgctgaaactggagaggctaatctctagtcttccgtgcaggaattccccaggtactcagctatggtggaaaaatttgttgaacatttcactatttggtaagatgtttcttaaagaataacagtaaacatt

SEQ ID NO: 529581 - DNA, 1309 bp, Homo sapiens
  misc_feature (174)..(174): n is a, c, g, or t
  misc_feature (194)..(194): n is a, c, g, or t
  misc_feature (248)..(248): n is a, c, g, or t
ataattacaagtcaacagctatcgaaagttagcacagcttgtctgtggtcgctgttctcttattccaccactgcacgtggtacttatgctgttttcactgtcttaggagaaccaaagaaggttttccatgctgaatatccaatgtgtgaaagaatgactacagttaatttgtancatctcatgtcatctcatgntaagatccctccatatctgcccatctatactccctcagatcctgtcaccacatnttatggtctggagcactcaaaattctatgtgcagttctactgactcagatgatactttattatgcctcaggttgggacggttcttacacttaatattttctttctaatttcatggccccttggtaaacacattaaacaaggaattggggcgaattccttatgcgttaaccaatttttttacaaccggggaaatttcataatttattccctatccattaaacctttccaaggagaaaaagaacacccatctatgacaccaaccacaatttccagggggacaagtattataaatatcacccatattaccacgtgaggaccatctgagcacaaaacaacaccatcattataaaagcacaaactaaccctaagaggcatccaccatatatcatacaaaatcataacaggcgcgccttattaatatgtgggtactgacccacctatatatacctatccaagccacggcatatattgacacaaaagtggcgagataccccacccaaaagaacatgcagagatgctcaacacatattcaccaaccgataactgtttccatcccaccgtatggaaacaacagggcggcgggcgcgtaccccacgcaaccacacatgaaaagggatactatgcaagaatcgcttactacaacacaagcaaaacacacccatattattaacccgacatgaatagataccgcgagcacaacaggtctttcaccacaccgatcttcacacgaatttctccggggacggaaacctcaaaggagtaacgcccagatatacggctgtatcgtccaaaacatgctttgggcgacaatgttaccagtagacaaacgggggaaaggcggcccaattaaacctacttcacaacagtgatcaaaagtcacaccccaaacggtgtccgccacaaaatcgcaaccagattcacaaacacacgaccgggaaaaatattttcgcgatcgtgataaagaccccccttatttataagaccaccgcgttgctaccaaacattctcattactatgtcaccgccaccactatatttccgaaaatttatacacctttagag

SEQ ID NO: 529582 - DNA, 246 bp, Homo sapiens
ggcaaactgttgttcgagttaaatataaatctcaggctctttaaaggtaaaaggtttaaggataatccattttgaagaagaaaagagttaggcttaaagtaaagccacatgacaagcatattaaaaaaaatgcaggttatacaaatatgaaagagggccctcagtgtttgtttatttaagaatctctaatgcagagttactgtatggattaaaaacagctcaacactgtctgtaaaattatgtgta

SEQ ID NO: 529583 - DNA, 417 bp, Homo sapiens
aagtacacgttccgtcagccattgaccgatgatcgacggccatcagtcttggatgacctgcgaccggctgcatccaggccgtaagcggcggccgcatccatcgactctaacgtcatatggttcctatcggacagcgcctccaaccgaatgtcggggaggatgatcagcttgtgaggggtcggggttccggatcggttcaacttgccgatcttggtctccccggagattcccacgtacagagagtctacgaccttgatcgggtcaccgtggctgatcatggcgatgaactgccaatgacccctgccaccggtgggctccttcttggacttcggtggctgaggtatgtcaccgaacaggtcgaaatcttcgggtcccatcatctcacctcagaactcatatccatcgggcaccgagttg

SEQ ID NO: 529584 - DNA, 1589 bp, Homo sapiens
ggttgctgtgggtgtgtgcgtggttggttctgacgccctccgacggcgtctggtcgtgtttgtcggttcttctcacttatgatgtgctcttgtgcttgggctggtgctgcttgctcctcctctcgtcgcggtgtttgttgtgggtgcggtggtggtatgagatctttcctgttctctcgcctgtggttgtgggagttaggtgttgtgtggtccgtgcagtgtgcgctcccagggagctttttgtgtgccctgccctgtgtggctgtctgtccgtcgctggggggttgtgtcgttcctagagtgggtgttagtctccttctttttcgccctgtttggtgggtctgcgcctatagtggcctcatgtgtggggccgcgttttcccctggttttctccgtgggcgccaaggggggcctctgctccgactagtctgtgtcagtatctatattgcgggggttcatattggggatattacgtctcaaggcgccccttcttcaggaagacgcgcttgccgcgtggggagttgtaccttctggtctttttaatggttaaaggcccaaggccgtggacgacagtgttgtaaaggactttggactccccctcggttgggggcaacttttttgggggaaccgcgtgtgttgtggcccaatttgttgggagcatctgtaaagaaggtgggccgttgtcttcccgggagaatgttttaggaattgtgtagaatgttggttaccgacgggccacagcatctttggggcgtcgtataaaactcctcccggcgtgttctcccctctccacaaagggggttgatgaccttccaccaccaagtccgtttgcgccccccagtggcgacacgcctatgagtggggatttatatacacccgggatgtctttagtaccagaaaatttcttgtggaaaagagccccctcgggagagtttcccctaaagggagaccccctttttgggagcacacccacagccctagagagagtgatgtcctcatttcgccaagagagtgtctcctctaaaagagagagggacccccccctttgggaataactttttggaggagattctatttggttggagaggcgtgtatacacctcatgatctgcgcaagagagccccattgccgccacggtcaccacccacatgtctttctacgccacaaggcaccaaggagattctcaccacaagcgttcccgggttgtgtattaagagcccagactgcttgtctcagaccaacgggccactttaccaagccccaatatccagatatgtagaaagagcggcgcgttgccagagcccaagaatagacctgttgtgttagagttaagagaaagagtgaaagaaaggctgtctgttggtgttatagaagcacgaagaagccttctggtgggagaaaaaggcacgcacgctatcccagagaaccacgcccctgaaaagaatgcctgcacagagaagaaacctatctaccacgaaggagaatgaagcctgctgcattaactttttaatttgtattattccctaaagagtccaaatcattttggacaacttcttttgaattaagacctgattattaccaggcccatg

SEQ ID NO: 529585 - DNA, 371 bp, Homo sapiens
atcacgagcagcaggaattttacctcatctagatgaagaaaacactcgagggggcatatgaacgaaactgtatatttttcttgaacaaagaaaaatcaggccaagacacagatggctacatgcctgtaatcccagcactttgggaggctgacgtgagcggttcacttaaggtcaggagtatgagaccagcccaggcaacatggtgaaggggcgtctccacaaaagtacaaaaattagccaggcgtggtggtgcacttataatcccagctactcgggaggctgaggcaggagaattgcttgaacccgggagatagaggttgcagtgagccgagatggtgccactgcactccagcctgagcagcagggaaaga

SEQ ID NO: 529586 - DNA, 1228 bp, Homo sapiens
ggaaagacagaatggagtgtgctgccggcactcggcacatggggtccaagggtagccacaggatggctgcacgccttcctcatgatcagttgtctcaacagcaagtttgaggcacttgcaagatggcagaacctcaacaactcttgcgacccagcacgctacgacacgactacattccacatcactccttaccaacaacctggcacaccctgacgcgccactcctacatacttgaacggaccgtaacctatcacaccaacctaccaagcgaccgcaatccgaacgacctgacccgcctctgggcttctctctctgggacacggacgttggcttcaacttacgaggcctgtcctaaaccaccgacgcttacagccttacgcactcgccacgacctttgcccccttggacgataaccccactggcgggccccaaaccagctcgtcccccattcctggctacccactcattgccacacgcctcgggggcaaggggacccttggctctcatacgccccggtcccctggacagcagttgcaacgttccctaggtcaccccacacttgcgacgtaccaaccctttcccacacgacaacgacggtccgtcctgcacccaacttgggctatcgtccagccaagcaaccgggctacgcttggtggatatcttccacggccaacgaaacctcttggtggacacaggcacacacggctcccgattgcccgcgctccttcggccctggaacttcctgtgaccgcacacggcaagtgacaaagggtacagcacagaacgtgggcacctaagcggcccacgacacttcccacacgaatcctccacgtaacacgactgaaatcggaattacggccctacccctttcacccctggcaacacacctccactcccgttaaacccacacaggcacatacttggacgcccagcaaggggcaccatttgtgaacacatttgacagccaccgtgccacaccccacagtcgtgatcacttgccactaacaccaccaacggtataccgtcggccagggaaccctttggacaccacccgatcacccaggccccgcacaatggcccacgaccactcagccaaatctcagacaggcgccaccccctggcaaataccagggcgatcacagcgcccacgggacacagtgcacacacagggccgtccatcgaacggcgtgatgaggcgcccatcggatcacggggacaagacagcaca

SEQ ID NO: 529587 - DNA, 920 bp, Homo sapiens
ctcagggtagggcgaggtgagcggccttatgcgcaatgtgccacgatgtgagccttgaacgcctggacctggacctcacagctgacagccagccacccgtcttcaattgtcttcccaggcagtaacactgaggactacaaccttattgttattgaacgtggcgctgccgctgtagctaccggccagccaggactgcgcctgctaggaacccctggtgccgcacaccctggctggcatggctccattgtcaaggaggaggacgacggaggctggcaattggagccccttcctattgtcactgagggccctgatatcaaacctgtgcttatggctcttgcggatgtgtcctggtgctgagggtccccgcctggcctcacctattgtcagcaccagctcagggctggaggtggtggctcctgagggtacctcagcctcccaggtgtgtggcccgggaaccctggcatgacagtgccaccatttgccgtgttctgccagaagccaggctgatctggttgatgtgcaaccgagtgtgacgtcctgtttaccatcctggactgtcagctgcccgacctgcaggatgtaccagggcgcagggaccgtggagctgtatcaagtctgccatgttgctcccctgtacctgaatggaggtagggatggcatggcgtcagaccctggagtggtggcatgaacaagcacttggcggtggttggtccgaaagggtctcacccaattccaaccaggcggcaaattgttgacgcgttgatctgggtggcgcttagtcttgtggacagaaccctgtgcgggcccctggataagttggggcatcgcgggagtccaccatctccgtgtaaaaaacccggttggaccctgtgatatttacccttatactgctgcccgcccctccggaaaatgtggcgcct

SEQ ID NO: 529588 - DNA, 429 bp, Homo sapiens
  misc_feature (340)..(340): n is a, c, g, or t
  misc_feature (375)..(375): n is a, c, g, or t
ttatggccgggttaatgaattcaatcccatggtggacacgttggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgcgggactgggacacttttatgttaatgctctggacttgcctccagagactgctccagagttggtgacacagttgtcccaagggcacccnttgtgggggttaaaaattttccccccttttttaanttggaactaaatgacttttctcctctcagtgggtggtaggcacaggcatcaagc

SEQ ID NO: 529589 - DNA, 322 bp, Homo sapiens
  misc_feature (144)..(144): n is a, c, g, or t
  misc_feature (149)..(149): n is a, c, g, or t
  misc_feature (224)..(224): n is a, c, g, or t
  misc_feature (241)..(241): n is a, c, g, or t
  misc_feature (266)..(266): n is a, c, g, or t
  misc_feature (298)..(298): n is a, c, g, or t
catgctgtgcaggtcatccagcaatggagaatatagaaaacttccagagatagagaagcccttctgcttccagccccctgataaggtataagagagacagatttttaataatgtatatccaaataggagagaaaaagattctgnaactntaaccttgagacgactctaaccctacatatgatatatgaccagcagccacatgttttccatcattttaaaatagncttttatgtattttagnaatgttttccataagcatgtatttnttcaacaatcacaaaacattaaatttataatnaaacgaatatgaagatgaaaaaaa

SEQ ID NO: 529590 - DNA, 115 bp, Homo sapiens
cagaatgtaccccaatgatggacactggtataccaaactgtggactccattattacagtctttgattggtctttttgaggttacccgaagatgattaccattcctgatgaggaca

SEQ ID NO: 529591 - DNA, 154 bp, Homo sapiens
gactatctctacaaaccacaaagacattggatcaccatacctattattctgcgcatgagctgtagtcctaggcacagctctatgcctccttattcgacccgatctgggccagccaggcgaccttctaggtaacgaccacatctacaacgttatc

SEQ ID NO: 529592 - DNA, 115 bp, Homo sapiens
  misc_feature (1)..(1): n is a, c, g, or t
nactggttgcacgggggcagagcctcctagggagaggagggtggatggaattaagggtgttacgtcatgttagcttgtttcaggtgcgagatagtagcagagttcttggtgtggg

SEQ ID NO: 529593 - DNA, 705 bp, Homo sapiens
  misc_feature (551)..(551): n is a, c, g, or t
atgatttagaaaataatactattaaattctaatgaaacaatggtctcagtctggggccagcatccctgtcagggagatcagtaattattaggaagtcactagtgaataccaggtcaatgaaaaaaagagataactctttggagaaatgctctgactgaagacctgaaaagagaataatttgatgactgcataatcccatgtgattttatgttctatcagagtgactgtactaccaagataatagagtatcaccaaaaagtgtatttagtaccacgtgcgtagattactgtataagctcacaaatactagcaaggatggcttgcaactgacgtgttacccacactgactggaatgtgagcccagtgttgccagaaatctcctatttaaacactggcaataaatgcaaattttcatgttcaatacagaccaaacacagacatctgtacctagcctgtgggtagcctgctggaagcccgcttgtactgagtcacttttcttcttctagtctggactcttcaaacacatgtgtcatgagatatagaataacaggngcgggaagggagcatttctaggttagaggagacttaaattacaccattgacaccaaatgaaaatccgttaggtcttaaatgtggttgataggttcttgaaaactgtgactttaagccaaatgtttttggtctccaattaacaacattttcctcg

SEQ ID NO: 529594 - DNA, 815 bp, Homo sapiens
ggagcaccgtaaagggcgagctggccgagtacggcctgggattctgctttcacctgtgcaggcgacgactcgtgcttcgacgagaccttgaagacccatcatgacatccagagcatgttccggaacgaccgattggcatgcaaatttgcgtctttagcgatcaacagacttactgcggtctcaggaggaattggccgaattatctggccgaaatgcgaatttgaaaccatccccacttttggcatgctagtgcatctgaagcgagatacgacgacatcattaagcagcagcgttgcattgcaagtttagcatgccgaattgattgcagtcgtgcactcccttttgggaacgcaatccgtggcgtcaaactatccccaagtttgcaagcctctgtcttttggcgaaacatgattgcatcaatggggggtgtactttatcataccgatgcgtggagaatagcatagtcttgtaaccattttgcagtgcttgcagtacacatgcattatcccaaggacgccctttacatcacactgaacgtgcaaatgccggcttgtggcctatactccaatctgacacactctcttcgcatgggaaaccaaggattatatacatgactcaccggataggaccgcatattttaattccagggtaatattcccaaaggcacattgttggcaattgaatggcataagcacattcggggattgggaggaacaggaccgagcaaggaggaataacgagtagatatgatggaaagacagacaaaaaaggacattcaaatcactgggctaacacataaataaaatggaaactgg

SEQ ID NO: 529595 - DNA, 545 bp, Homo sapiens
  misc_feature (332)..(332): n is a, c, g, or t
  misc_feature (386)..(387): n is a, c, g, or t
  misc_feature (396)..(396): n is a, c, g, or t
  misc_feature (429)..(429): n is a, c, g, or t
  misc_feature (441)..(441): n is a, c, g, or t
  misc_feature (454)..(454): n is a, c, g, or t
  misc_feature (466)..(466): n is a, c, g, or t
  misc_feature (473)..(474): n is a, c, g, or t
  misc_feature (476)..(476): n is a, c, g, or t
  misc_feature (489)..(489): n is a, c, g, or t
  misc_feature (496)..(496): n is a, c, g, or t
agaatgacattttattgtgaagatgggtgtggtccctcttcccttgaaatcttgtagtttctttttatattagctcctcactgctacagcctagaaggtgagaagcagattttaaccccatctggcagccattcaaggaaaacccagccctggctgtttactcaggctctcttagaatgagagtggagggtgtaggatatgagggttaggcctttgccacattatacaaaagtttataatttgccacatctggacaagtaactttcttcttttgttcataggcaagacttctttaatggatagtatcattcactgaacctactgggcatggncctcatggagttttgggtcaactggaactctgtgccaacccaggatccaaactnncatccagangccatggatacaaattccatacttccgggctgntttaacagttgntttcagcagacgngtttaacctttnaactggnntnccaattatttccnaaattcntttctggaaagactccctggcgtaaaaggaagtttttatttaccaaggt

SEQ ID NO: 529596 - DNA, 611 bp, Homo sapiens
ggccaggcatcctgtcccacgaggagggtcaaggacatacaactttcccccagttccgaggcccgagggccctttttgaggccacgcaccccgatctttataagcgacggggccgacctcctcacccaagctggttgcacgtttgagggtcgaaaatcggagtctccccaagagggagtgccctgaacatccactttgtgtcctcacgtctgggggagagcggaaatccaccacaaacttcctgacactacttccataatttgcacctaaaggagagttcaggtacacaaaggagggccacgccttcggttgtcgtcgaatgcctgaactcacggcaaggccacgctttccgcgtggtggacaccgaggttttaagccaccatgaccgagggccccatgctaggcacagcggctggaggggagtgccacacccctcacagggcagccccccacatacattttttcctgcttaatttttgcctacctgcctgagccatgtttacctgcccacttgtcccctgctgcctgccccaacaccccaccattggcctgtcaacccacccattggcctttttgtctgggtgcttaccaagcttttatcactcccttta

SEQ ID NO: 529597 - DNA, 102 bp, Homo sapiens
ggtaggtgaaggatgagtgtgatggagcgaatagatgaggtcaccgaagaaggggaatgaagctgtagcttccagagacctgatgtgaaaacacacgaccag

SEQ ID NO: 529598 - DNA, 187 bp, Homo sapiens
atacaaccaccaatctcaccagaaaaggctttatgtacatattaggaggctatcaaattcccactggtagactgaaatcttccaaaattttaattttcacttaaaagctcaacttttaacattggaacaaatactgttagttttccttgaaatgccattctcacattgttcatctttttttctcttt

SEQ ID NO: 529599 - DNA, 955 bp, Homo sapiens
cggcgacgaggaccatcatgctggctgctggctgacacccagtggaatggctggcgcgtgcctggtgtcccgtaaactcctgtgctgtttccatcagatgccctcgtgacactcccatgccctggtgctgatgcactgcatctgtctgctccccgtgctggatacaatgggggctccgccatccgctccctgtcagttcggcctccatctcctgggacccgcgccggcagccaggccaggcctctgagtggccccagagcccaggctggactcgtccacggcaggcagcgatctgcccagagggtctcgagaggccatcccttacagaagtcaggccctgtgctcgccaccgtcacctgctggttggattccggaaacccactgtctgaagaccacagaggggtgtcgctgaccaacccaaatcggatacgtccagacctcaagctcccttcccctctctggctgccctctgcatcttatatcatctcttctctcaaccttaaaggggatttctgtgtcctgacacaacctccccatccaacaccaaagtagccggggtgagccccaaaccttactgggtgtgcatccacctgtgcctccaaaccagcgaatctgacagcttcgacccaattctgcacacacccaggaagttctgcctttacttaactaacaggtgtctcctgtacttcccaaaatatctcctcctcctgtgccctatacagaacccatcctaggagggccagagaacctgaaagggagaggaacaactaaatacaaacattggaaaaccaggaaccgaataccaagaaacaaaagcagagaagaccatgttaagaggacagagaaaccaaagtacccacaaaacataataccaagaagcgcgacacacaacaaagacaagaaagacagagaaacgagagaacctaaaaacaaagaaagcaccagaaaagaccgg

SEQ ID NO: 529600 - DNA, 1077 bp, Homo sapiens
agcggattgtgagccccggcgacagcgggggaggggaagccccgggcgaccgcacccccgcctcacagcatgggatcggacttctcctcgactcgctcacgaatgtggcgccgccagcgcagtgcacacgatgcgcccgtgacatcccaagccgcggagtcccgacgtgggtccagcaaggctcgggacccggtgctgtccaggaactttctgcaccagtatcctgagatgatcccccgatggtccaaaccccggcagcccgtaggcttggacggaacttgatgccgattccatggtgccgcaagcagccactcgctcctgggatgcagaacagtggatgcccatggcacgtgtcgactcgcctgcagatgacccctgtgaaggcctgaagcgagccccacagtaagtccccggttgtcgagagaactacaggatcctaggtgacctgctagactcgcactccgggtggcatccagtatcgcctaatagacccctggcggtaagggagagaacttgtgacgcatcgccggcacttctataagcgcccacaaagccatgttgatcggcgcttgctaactggcactagtcgcatttcgcttgcgtggacctcaaaggcgacgttttcggcgaccccactcctttaggttgcatcccacacactcgtcggacggaggcagtctcaatctctcataagctccatcgtgaccgaatttcagcgtggcacacatcacatgataaatgcacaagtctccccctaaactccctactgggccccattatccattacgcaaacgtaccgcttgatgcggacaggtagtcgcgcggtttccaccaccgaagcccgaacaacgggcgccaattccattgtagtgaacatcgcctaacaagcctcccacaatggctatccgcttaagcccaatctcccccttaacgtctttggaaacacaacctgtatggcataacgtttgccgaacacttgtcagataggactcaccgtgggttcgctcccgtccactaggaacccctcacgcgatttgccgtagtgtccctctgaaaggccctggtattaaggcgccg

SEQ ID NO: 529601 - DNA, 178 bp, Homo sapiens
gttccccttctgtccgagccgcttcgagccctgcggcctgacgcagctctcccgcctgaaatacggctcgctgccgcctagtgcgccgcaccgtgcgggctggctgtgacacagtgtgttcactgcgccgctgtcacaacctggtccgacggcaccgccagcgtgcttcgtcgttcga

SEQ ID NO: 529602 - DNA, 837 bp, Homo sapiens
cgcgtgccgagactctgaggccttgtcacccccagtgatcccgatacgatggccgtcaagaagatcggcgtatcttctgtgcgcctactgtgctcagactcgggctcactcactcctggcgcaggctggtgcaagcaggttacgaagtgacagtgctggtgcggagactcctcctgtgtctgcctgtctcgtagtgggccccggtcctggctccatcgtgggtaagtgtggatgatgttctgccggcagccgatgttgcacaagaccgtggctgtgcaggacgctgtcttcgtgctgttgggcacccgcaatgatctcagtcccgcgactagtgttgtctcgagggcgcccggtacattgttgtgcctagacttgactggctcatggtgtggacctggtcgtgggctgcacctcggctttcctgctctgggaccctaccacggtgtgcccccatgatctggaggcttgtgactgagtagactacgatcgcggatgcacaaggtggtgcgtgaagtcaggcctgaagtacgtggctggtgatgccggcatacttgggagtaccagccactaactggggcgtactacaggtgaccctgggatggacggagggccctcgacatggtcatctccgtatatgacctgggccatatcatgctgcgctgcgtctccgaccgatgagtacgacggacacgggcacctacccctctcctagcagtaccagtatcactctgtccccatctgggagggtggcattctgggacatgaggagcaaaggaagggggcaataaatgttgagccaagagcttcatattaaagaaagcaaaaataacaacaagg

SEQ ID NO: 529603 - DNA, 113 bp, Homo sapiens
gtcggtaccgactgtatcaacgccgccagtgactgcatcaacgccgcatgctggaagctcaagtgtgagggagataaatctgcaggacatcaaggagcggcgttggatggagt

SEQ ID NO: 529604 - DNA, 789 bp, Homo sapiens
gccggagatcgagtcgagttagcagcgaggtactagcatctgtctgccgctggagcctacagttatctggcccacgtccgaggctaagccgctgttgtcgcgatgtgggatctggctttgtctcgcatgtaaactaggcatcgaggccccagatactgtgcggagattatatagatcggacctgcaatacttgaagttgataggcagatatatgcaagactagaggacccaagtaccagaaggtactctctcattgctaattgcttgaaggcgaggatgtacaccaagaagataggaagaccgacattttcacttgtgtcactagtacggggtcttcgagcgcttcgggggttgcgacgagtagggagtcccctctggcactatgatcaaggaaatgctctgtgcgtatcgatcgtcaaccgagggaaagacttgccgtagaaaaagccttatggtctgccgaaacctatactgagctaagttccttttggttcgctaaacccccaatttgcaaaagcgcgtccacaattttccccatgaacaccatgaactcagaggcgtgggggcactgtcgcaagtaggccagataaaagcactgtcgcttgcgtggtgagttgccacccaatgtgatatttagtcacattcttaaggttcccatgggttgagatggtctttcgggatacttcccaaattttttgcgcaaagttttaaacatttctttgggcggtgtaacaatttaaccgataggggattacgggggaaaattggcaggggggggaacagaaacag

SEQ ID NO: 529605 - DNA, 93 bp, Homo sapiens
  misc_feature (92)..(92): n is a, c, g, or t
ggctggtccgatggtagtgggttatcagaacttattaacattagtgtcactaaagttggtatacaaccccccactgctaaatttgactggcnt

SEQ ID NO: 529606 - DNA, 311 bp, Homo sapiens
tcctgtgcctgagttcccacgcttcgactgtacttctagctactcagaaggctgaagtgggagaattgcttgagcccaggaattccaggctacagtgatcatgctactgcagtcattccaatgctgggtgacagagtaagactgtctccaaaaaaaaaccaaaaaaaaaaaaggaggggaaattgtaaatttcaccaaaacattaaataagggaggccccaaatcccagtccccacacagacgtattgggtaaccaggtgggacctttgctggacccacttttggtcagagctcgggaacacagtcgaagg

SEQ ID NO: 529607 - DNA, 406 bp, Homo sapiens
  misc_feature (139)..(139): n is a, c, g, or t
gctcgaccagaaatcttgctgggatgaggagctgcaaacatgtgtggtcgactttttggccttctgcctcttctactctcagggatgggggattacaactaaagaagttgtcttttggccgggcgtggtggctcacgcntgtaatcccagcactttgggaggccgaggcgggtggatcacaaggtcaggagatcaagaccatcctggctaacacgatgaaaccccgtctctactaaaaaattcaaaaacattggccgggcgaggtggcgggcacctgtggtcccagctactcgggaggctgaggcagaagaattgtgtgaacccgggaggcggagcttgcagtgagcccagatcgcgccactgcactccagcctgggcgacagaggaaggctccgtctcaaaaaaa

SEQ ID NO: 529608 - DNA, 164 bp, Homo sapiens
cacgagggtgggtgaacgtgcacccgtacccatacacgtcgcccaaccgccagatgcgtccggtagacgccaacctcgggtacggctcctgtatcgagggttaggtttccaagaactggttccggaacctgctctccttctcgaccatcccctaccagtcgttg

SEQ ID NO: 529609 - DNA, 177 bp, Homo sapiens
aggggtggggggaaaaaagggataaaaattccccccccctcctccgggtttgaaaaaaggagctgaaaagctttttttgttcctgggctaggcaaagaataaaccccaatggtttttttttgggttccaaataaaaacctaatttccataaaatggggccagaaggtcccctttcca

SEQ ID NO: 529610 - DNA, 211 bp, Homo sapiens
  misc_feature (20)..(20): n is a, c, g, or t
  misc_feature (94)..(94): n is a, c, g, or t
  misc_feature (125)..(125): n is a, c, g, or t
  misc_feature (127)..(127): n is a, c, g, or t
  misc_feature (134)..(134): n is a, c, g, or t
ggtgtctgactttggcctgnccgcgtgctggaggacgaccccgaggccacctacaccaccagtggcggcaagatcccatccgctggaccgcccngagccatttcctaccgaagttcacctctgcnancgacgtntgacctttggaattgtcatgtgggaaggtgatgacctatggcgacggccctactggaagttgtcaaccacgaggtga

SEQ ID NO: 529611 - DNA, 535 bp, Homo sapiens
  misc_feature (67)..(67): n is a, c, g, or t
ctactactactaaattcgcggcaggtcagacatgaagccaaacagagggttccacagaagtctccantcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagaggtgaggagacacctgtcctgtgccacacatctatgtagttcagcaatttccagccccttagtactccaggggctctaagccacccctttgtaagtcaggatggaagtagatgacaccacatttctatctgctgtagacattcttcccagtgtctcaaaatgttttggcatctttcagtaaaaatcttcaagtttaaaaaaaagtcgacgcggccgcgaat

SEQ ID NO: 529612 - DNA, 234 bp, Homo sapiens
gcggccgcctactactactaaattcgcggccgcgtcgacatatcatctaacctccagccagatcaagaaatagaacatggctggatgcggtggctcatgcctgtaatctcatcactttgggaggccgaagtgggcagaaggtcgggatttcaagagcagcctggccaaaatggtaaaaccccgtctctacttagaatgcaaaaattagccgggcgtggttgcaggcacctatag

SEQ ID NO: 529613 - DNA, 108 bp, Homo sapiens
  misc_feature (39)..(39): n is a, c, g, or t
gaccgatgatactcacctacgcttatcttgggaatccanatatgcagtcaactctgataaacaggagtttctgtgcccatttcaccaaatttcttgtgcccatttcaa

SEQ ID NO: 529614 - DNA, 670 bp, Homo sapiens
  misc_feature (67)..(67): n is a, c, g, or t
ctactactactaaattcgcggcaggtcagacatgaagccaaacagagggttccacagaagtctccantcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagaggctcactcccgtttgtattattaaaacacacgccaataggacataaaaagaagcaagagtactgggctttaccatgagttcaaatctcatttctgccaattcctatgtctaaaaaaaaaagcttcctaatctctttgagcctcacattctctatctagagaatcacttgaccagaatgttcaatgcagataaaaatactagaaggtattttaattcattccaagattccttaaaattctgtaattctatgtcctcttgattctgtctatagaaaaacttggaatacataggcagcagagtttgaaaaaaataatagaacaaaagaaacaccaagaaaaacagagaagaaagtttt

SEQ ID NO: 529615 - DNA, 1864 bp, Homo sapiens
  misc_feature (920)..(920): n is a, c, g, or t
tttttttttcagtgacttattttcatacaaattcagaattacttagaaaatgactaggctaaattagtagaatgtctgagttattgagcatttgtggaaagctgctggcttattactttcactcacatgtagtatccatttgcttgccaacaaaatactggtgctactgctcttaaatatatattgcatttgcgattaatatattcattcttgggatggtaatgtatattgctatagtccttgaaaacagctttttcctcctagctaacttaaacctttttacacattcttaaccgcttctctctcccattcacccaaccttgtcaccaacttgtgattttatttgtgttattagtcgtctcttggtatccatgggggattggttccgggatgccctgcggatgctgaagttctttataaaaacatgtacatgctctcatatcttaaatgatctctagattacttgtgatactgaatatatataagcgctatgtaaatagcatgtcataatgtattggttttttatttgattattcttatggtattgtagtattattttttatattttcaaattttacaaccagaggttgattgcagattcgaaatccacaaatatagaggtccaactaatttttaaatctatatttaataaacatttgtttaacccttgttaattgtcatgaaatttaaattagtggattcgagttgaaagaaattttaatgtggttccaaagttcacttaaaagggtgaaaactactcacctttgacaacagacagtttatatcatattttattccatccccataataacctgtcaaataaagagtaatacaggcagtaaatagtacctttagtaaataagtaagcattaaaaattactgtttagtgcaggtgtgctacgtggtaggcatggtacaanacttttatataattctcacttacttttcatatcgactctaagatgtaggttttattattttttcatttgcagagaaggaaactcagggtcatttaatgatttgtcacacaactaactatacagcaagttagtattacagaaagaaaatctagagattctctcctactaagactgctggatatatttggaatgagtactttacagcatcattgtacaacatcctgatttcagggttgtgaccaaatctgacactcgtccttccttaaaagccttgaaatagagggagctgagagctatgggacatcctggaaaaatggctctgtaactttggctttgatgttccaaacatatagcaatgattgataaaatataaagatagaaaaacaaatggacttagtcaagtccaaaacagttcttcgtctttgagatccagaaaccaaataagaaaaccacatggttattaaggctaaagccaggggtctgctgaacattttccagcaatagaaagtggtaattagggtttaatccctatccaacaaatccagatccactatttgaagcagggcctgggaggaaatttcttgttcacagcaagagactgggaaaaagtaattctgttgaccactaccaggaactaggatttttacctggaggattgaaggagtaggaaggaagacacggttttgtgacataaaactgaattacccatgtgttgcctctgtgatttaccttgcaatgtctctctatccctgcagcacagcagataggcagcaaatgcccctctgagacccagctctggtacagtagcctgggatgccctagtagaaccaatggcgaaactactagaaagggagaaatgagcacatagaaaaaaaaaaaatcactacaaatgggctttcaaccaagattccaaagtatgtgaatgaatcaaacactagtaaagc

SEQ ID NO: 529616 - DNA, 105 bp, Homo sapiens
ttacggggaagacggagactacgagccacagcttaaaactcaaaggacctggcggtgcttcatatccctctagaggagcctgtttcataaccatgaatcccggaa

SEQ ID NO: 529617 - DNA, 111 bp, Homo sapiens
ctactgatgtaaatgttaaatgtacctgggcaactagagcaaaactcatctcagaaaaagaaaaaaagaacagattgtgggctgattctcaaaattcaccttagagttgtt

SEQ ID NO: 529618 - DNA, 926 bp, Homo sapiens
ttacgaatttattaccccacgccaattttggggcaagaacagtgtgaaattaattttagagcgcatgctctttattcctccgcgccttctcaatcgtcttttcctcccagcattagtagccgcactctacttgtttggggctcccataatcgaaggtccacaacatatatttttatagcgtaaagcggtgcttcttacaaacctcccttctggtgtatcctcgcaccctccgctctcgcctccagtgatttacacgtcttccccacgcctcttgttacacctaacagtatgaagattcgccctctctagtataaacttttttcttaactgtagtgcttgttggccctcactacagaccagtgaatacccctaggtccttcatccgcaagacgctcctcttagccgtactccaaagacaaattttgtattactcctttggcaaaacaccgctggggataaaccccctccctcctccctacgcgctctcccgaattagaaatttctcgaatctcggtgcataaacacaaatttctcccacaaacttctgctcacctatacgacgacatatattaaagagggactccttgacccggcatctatcttcgggccctcctcctctttattcggcacccgcatttcaatcccctactctctccgttatctcccccaaccccccacgacctagtatgttttacgcccccctgagcgccctcctccctgttttgtacactcgtcttatgcgaatacgtccctcctgtttgaatacgcgagtactccgagggcaccccccaaatgaagtccaccccttaccatccatcattgcgaaaatgcatgccctgggattagctatgtcctccaccatattgttttgtctttaaataacacacctaatttcccctttacccaaatacctcatgggcccatca

SEQ ID NO: 529619 - DNA, 397 bp, Homo sapiens
  misc_feature (321)..(321): n is a, c, g, or t
tgctctagaggatccatccccggctctgggtacaaaaaaacctcttagaatgaacagacctactacttgatagaacaacagggtgactatagtcaataatactaaaagagtctcattggattgtttgtaacacaaaggacaaatgcttgaggggatggctacctcattctccaagatgtgattattatgcactgcatatctgtgtcaaaatatctcatgtaccccgccacacgttgtggctcatgcctgtaatcccagcactgtggaaggccgaggtaagcagatcacttgaggccaggggttcgagacccgcctggggcnacatggcaaaaccctgtctctactaaaaaaatacaagaattagctgggcatggtgacacgtgcctacagtcccagc

SEQ ID NO: 529620 - DNA, 356 bp, Homo sapiens
atacgagcgccaactgggaaaactgcgaatgtcgctgatcatgcctcccctaaaacagggaagaacgtgcatgtggcacatccgatgaacacgcaatactccgcaggaactcaggcaacaatcaaatgcctggggcaactatactttccaaatcctgaatattaaaaaggttttcacatggtactcatcttaatatttactgtttcattagataaaagtaagctcttgttgcccaggctggcgtgcactggtgcaatcttcgctcacctcaacctccgcctcccgggttcaagcgattctcctgcctcggactcccgggtagctgggattacaggaatgtgccatcaccatctgag

SEQ ID NO: 529621 - DNA, 653 bp, Homo sapiens
  misc_feature (29)..(29): n is a, c, g, or t
  misc_feature (107)..(107): n is a, c, g, or t
ccatggcggccatgagctgctgcagcggnttcggtctccgcgctgacagcgtggtcttgccgccgcgctggtcctagactcggagtcggaagttttctcacgcggantttccgaagactgtcgctcctgtgcggcacagtggggacatggcaagagactgtttgtcgtcaagccttctttatactatgacgctcgcttcttgaggttaatgaaattctaccttatgttgactgggatcccagttataattggcataacactggtgaacatatttattggtgaagccgagcttgcagaaatcccagaaggctacatccctgaacactgggagtattacaagcatccgatatcaagatggatcgcccggaatttctatgatggccctgaaaagaactacgagaaaaccctggctatcctccagattgaatctgaaaaggctgagttacggttaaaggagcaggaagttcgaaggctgatgcgtgcccgaggtgatggaccctggtatcaatttccaacccctgaaaaggagttcattgatcattctccaaaggcaactcctgacaactgatgattcatttgtctgtccaagaacagtgtgtccctctagtgggaagaaatgaataaatactctgtatttttgctctgatgtacac

SEQ ID NO: 529622 - DNA, 180 bp, Homo sapiens
gtcaaacaccgcagaacgcaaggcactcaggttagaaaatatatatgttcagaggccaaaaggccatccacatacagtgcctattacacagtgaagagtacacagggatggccgggaggacattcaagagccatgtgcttgttcactagaatagcataactgctgtcagaacctatctcc

SEQ ID NO: 529623 - DNA, 109 bp, Homo sapiens
cacacttcaattaccaccattagaagtaaaatgcagtgactgggttgcgatggctcacacctgtaatcccagcactttggcaggccgaggcgggtggatcacaaaggtc

SEQ ID NO: 529624 - DNA, 1026 bp, Homo sapiens
gcagcttcctcctgctgcagcagtctggtgacgcatgggcagctcgggctgaggtggaccagtgctggtggcccagatcgtgcgagacgctgcacgctggacgctggcgcaggacagccctgtgcctcgcctgtgctgctgcccccgtggggtgccgctgcgtgtgcccctggggcccccatggcctgccggactggtgcccggcgtgaccacattgccctgtgaacccgcgcgctgtggatgcctgcgtgcctgcattgccggcccggctatcgcgctgacgacaggtaggggcccctggctgcccatctgcggtgcccatgccgcttgcgcccataagcgccgaaccggcagagaacaggcggtgcagcagcagacccacaagccagcaggacacatacaaagcagaaagggcgggagaagagatcgacccgacacggagacacccacgcacggacacagagacacagaaggcacacccagaaggccccagagccggaaaggggaaacatgcgcgcacacacccggaacaacgcacagcaggaaccaacaccaatacccacgacccagacacaggcccagcaaaccacagacacccacaaggaggaagcccacagaggcgcccagacgcaacacacacggccgaccaccagcgaccgagacggaacggcgaaaaccccaggcacactctcggggacatccacaaaacccaagccaaaccgccaaatcggccaggacgaacatagacgcgccagaaaacgcgaccaaacccaagtacccgcggggggaacacaccccccgcccgcccgccccccgcgacacgacaacacaaaccacgaatgaaccaagcgacagaccacgaacaggggcatacagagcagaccacacacacggacgagccacacaaaggaaacaaaagcgacgggcagcaaccacgtaggcaacacacgacgagacaagacaaaaagaccacacagcaaacgcaccgcggcaaccaccactgaacaccacgcagcgcaattcgac

SEQ ID NO: 529625 - DNA, 830 bp, Homo sapiens
  misc_feature (183)..(183): n is a, c, g, or t
cccggggccaagttaattggcgcaccagttgttttaataagaaagggtttatgggtgttgaaaagagaaaaggtgggaaaggaatccacgtgttgtgaccccgcagccccacggtttaccagagggggtaatctttctcccccggttgggggtttacccgctccaccctccagaggacctccnccaagagaagtgattcacccaacaacacataagggtggaatagattgtggtctctggacacgaaagtgtgtgtaccccgcaggtggtgtctcccgaggagacaacctataagtgcggtctcttggccacttttctctgggtcgcacccgcgggggggtttctctgccgcgggtattaattgttggtggatggggtctcttatgttggtgttggtggagacctttttggtgttttgttgtttttaataagagaaaacaacaccacaacaacctataagggtgggggacaataatgagtatgttagagaaggtggtgcctccgcgtaaccccaaaaaggagttattttctccgaatcgcctaaatgttctgattgtcccattcaagtgctttttaaacatctttctctgctggatagccaagaaacattttattttcccacatttcctatattctctaaaaagtgtggcaccaatgcgtttccagttggactgtattgccatacattttttgctggaagacctttttcctgtaaaaccaccattgccttgttcagttttgttgtaaactgacttaccctaagaagccctgttgattatgctttttgaagggtgtttgataagagggattaaattaaagctttaaaatta

SEQ ID NO: 529626 - DNA, 176 bp, Homo sapiens
ttaaagaattcctgtccaagttatctttggccctttggtaggtgcttctttccattattctcatagttgttgctctaggaattgcaatttcaaccttgcttgttctagtctacttggaactagcattataccactttatacaatcatgtagaccatgcgggtaaacgcttgggtac

SEQ ID NO: 529627 - DNA, 881 bp, Homo sapiens
gaactgcactgatactggaactcaggcgcctcttcttattctgatgatactagttgattctctgtagtttgttccatgtgttgatgtgcggtatttaccctatgttggtgccttgtctaactggtctgacactactgatttaggctcgtcatgttcactcttcagtgtttcctgcttatttcactgaacggcatccgtgtccccgtatatgccatcattatctatgggacttgcacataagacatgtgctcgatgctatggctaatatccaagctaaattgtccctggattgatgcgcatcagtgtgaatgaaaacgccctatgtattgcgtaggagttcatctttaataggggatattcctctgattatacggggggagggtccgcgccagaacggacccttgacgtcgcccgtgcaggtgtgcatcagatccgtcgtgacgatctttatctttacgccattgcgcgtgttgtggaggaatactgcacctgtcttgatgccatgtgttcatcatcttaatgtatttgtacacgctgcttatgtatggatcctatgcgtcaatcatatctttttgctatctgagggcactggtggacatacctaacctgtctcttttgactttcgcttgcagactagtcttgtccggcatcttggaagcttgcagagatgttgggagctcgcatgaaagtaaaacgaagcccttttactcatgagcgccgggggcgtccctcctcatttggtgcgcgtcttccgaatgacagtttgttgcccccatctcccgtatacctcgttagaatctggtttcgccatgtaacgggtgtgggcctacgggcgcataacggcgaacgccattatttttgtattttgccacacctcttca

SEQ ID NO: 529628 - DNA, 103 bp, Homo sapiens
aatggaccctagcaatgtaatgtccagtgagtgaggttctgtaccacttcatcaaaatcatggatctggctgggtgcggtgcctcatgcctgtaatcctagca

SEQ ID NO: 529629 - DNA, 129 bp, Homo sapiens
ggaggtcgatgagcagatgcttaacgtgcagaacaagaccagcagctactttgtggaatggatcccaacaatgtcaagacagccgcttgtgacatccacctcgtggcctaaggtggcgtcacctattgg

SEQ ID NO: 529630 - DNA, 533 bp, Homo sapiens
gggtgactctaagatcccaaaaccggatctagtatgatgtgattattctaacctcccttttttcttatatgtaaactcctattccaacagagagaaatctgtgctcctaacatactggcatccttttatatatatgtgcacttttagtataaatttgtgagtggctttagaaatgatactccatattccttggaatgggctttaacaactcaagtacggcgctatacattggtactattcctttaatcttatattctccattgtcaaattgattttaaaatttacactgacattcacaggacctagaacagaaatagtaaaacaagaataataacattggagaatttactacttgctttaatgtcttaattaaaagttacaataatcaacctactgtgatatggtagaagggtagaataatggattaatagaatacagtaggttacctagaagtggacctataaaagtttcttgagattgcggagttttcaggcgagagtggtcttcaggcatggttggatccaggtgtcaat

SEQ ID NO: 529631 - DNA, 836 bp, Homo sapiens
ggacaactgagagctcctaggttccatctgccccgtggcgctggttatagttgaagcccgagaactgcccatcgcaggcgatgctgaaggccgcttctggggtggttgctgacggctgcagctgcctccctttcgcaccaaggtacccctaacccttcagtcgacgcatccgcgcgtcccgcccaggctgggaggcactgtagggatccgacgcttcagcgtggccaaagagcgagtttctctgtattccagggccctggcggggtcaatggctccaggtacgcgaacactcggcggaggccgaatgtctgtggggcaggacaggagttcctcgtgccgtcggaagggccgagggacggatagtgagggcgctaattcactccccactgggctggcggaaacgccgaatcccgcagtgaccgcggaggggccaaggtgcatggctgctccatggatgccacacggtggcagcggggataaaagaacgtgattcggtccctggcgagggttgctgccaaccagcgcactgttggcgtgactcagtgccaggcaggcttgatggtcaggcaacgtctaacccaggaggtgggacacatcctcggagtcaccagtgagatgtggcgagctgggagacaagtcgggttccgtgcatttgtcgaccttctggctcagccatggtagtaaaacaccgcggcagtcctgaccatcccggatcctcgggtctcactgcgaggtctccagacgggggcgcgcagccggaggcgcaaggaactgtcccagattaaggaaaccgaaatttttttggctgggtggggctggggagcatgatgctatag

SEQ ID NO: 529632 - DNA, 134 bp, Homo sapiens
ctataccaggcatcaacattcgagacagtctctggggaaaggaatggtggcacagaccatgttccctggttccgacgctgcccttgccaggcttcctatattccattactcatgggaagcaggtcatatcccta

SEQ ID NO: 529633 - DNA, 1125 bp, Homo sapiens
  misc_feature (1008)..(1008): n is a, c, g, or t
  misc_feature (1125)..(1125): n is a, c, g, or t
ggcggccacagtccaccgcgcggaggagggtcatgcttccccagtgagcaagacctctgagacccgcctaagtcgcggccgcagcggccctcggcagcagatggcactgaaggactacgcgctagagaaggaacaggttgacgaatgttcattagcaagagttaataccagtgatgatgatactctgggaagaagctaggtgcaagtagtggagaagccaggttggttcgagtctggcgtacaatcgagtgacacagagtgtgctctgatatgtgtgatcgctggatggatggtatgcgcgaggagtgagccacgagttgggctggacttcaatttcgtgaggaatgcacaggaggtactgcgaagactctttgctgatgctcgctacaatgagtgatgctgccatcagtatcaaggaacgagggaaggtggctaaataaagaatggttctggcgaatgctagtgacatatggcagcaatcaatgcataagctgtaatggaaggcaaggtcatatcgagcagatctatgggcgcaatgggtacagaaaaagcagaaagcaaatgcaggtatgattctgaagtgtacaccgtcaatgggaacaagagaggtaacgagttatgatgtagccaccacgtgtgcgcattgacgccaaagggaaggtatgtggactagtcatgctaggaatgcaaggggatatacgttggctgcgacattgaattattcctcggagggagcggagatgaaagggaatagaaagaggactcaacggtagtgggtacgccgaggcacaggggagggcgcattgtaataaaaagagcaatgagaacatggacaaagaaatgaaagcgcgttaggtgccccaacagtcttaaagagaatctagttgaaagaaaggtgtttggttagtcagttagtcatgatcgttcgacaaggaaaagtcaacagagcttgaagatagagaagggtcactatgaacagggtcttttggcactatggaaagatcaccnacgagaatacattgggagtgtaccccatgaggagtagaaaacagaagttatgggataggaatagagaagactctcggagaaagaggggggaccagtggatttggaaggtggaaactn

SEQ ID NO: 529634 - DNA, 305 bp, Homo sapiens
ccatggtctttcccccctttttgggtttttttttttcccctttctttcaattgcagatgccaaaaaaaatgcccccagcccctccattcccctaatgggtgctccccagaccctttttaaaggttgtttttaattttttggttgttgttgtccaagctttccctttttttttttttttagggtttgggccccgattttaaaatgcctttttttatgggtatgggttgcccaagctggctttttgtcaaataaaatgaatacgaccttaaaaaataaaagcgggttttttaaaaggtaaaagagta

SEQ ID NO: 529635 - DNA, 1422 bp, Homo sapiens
gtggcgggcatctgtagtcccagctactgggagcgctgaggcatggagaatggcgtgaacccgggaggtggagcttgcagtgacccgagatcacgccattgcactccagcctggcgcgacagagcgagactccgtctcacaacaaacacaagaaaaagaaatgaacaggaaaacaaaacactatcccacgtgccgatgaatcagtgctagcgcactaacacagataaacttgcactccacacaggaccacactgcaacagggccaatgctgccacgcagcatcatgagcacgagcacatcatccgtggctgggccaacaacaggacattggcacacacagctgcctgcggggcacccagcgatcctcgaggcacagcacagcatctgagaatcgcaacgttgggatctccccagaacctttgcacctaaggaacctggaccagaccagaagaggtacaggggcacagcctggaggggaaacactagcagcagccgtccgcatccaacgatgagaccgccgacgcaccacgtcctggctcacacccacggcgcaacgcgaccccactgtgcagcaacgccacacggccacccaaaagcaagcggtgacaacacacccgcgtgccacaacaacatgccagaaccaacagcgcaccacccacacgcaggcacccccgcccagctggacagcccctggccaaaaacccaagggcccaaaaccctacaagcgccaaaagcgagccacgagcacaaaaatagccacatcaaaccgcgcgcgcaccccaaccgacagagcagcgactagacacccacaccaaacgcgagccgacgcacacgccggacgcaagacacgccaatacagacagacactacaatgccgcgccacggcgcaccacaatgacaagagcaaaccaaccgcccgcgaacgacctacaacgaaccaccgacacagcctacacaaaccaacacaactccaaggaaggtggacacagagcagacccgcaccgacacaccaggacaccggcagcatcacacgctaaggagattagcgcgcgctagccagacgagttcaagccacgcacgagcctctccacaccaacaatcacgcacatcagagagccagcccgaaagagacgaccagatgagcaaagtgagaaggcggccaagcaggccggaggccgtagagtagaaagtataccaagcagtcaaactgacactggcaactaacgaacagcctcacagcgcgctgatgcagctgatacaagcatgcgaagcaagagcagctagagagagtagaaccaccgaagccacgaagagacagagagaacagcaagacacgagcaggacgagagatacagatggcagcagacaaacacgttgacgaaaacagcagagacaaagacacggcacgggcagacacaacaa

SEQ ID NO: 529636 - DNA, 527 bp, Homo sapiens
ttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagcaaaaacattaaa

SEQ ID NO: 529637 - DNA, 1706 bp, Homo sapiens
  misc_feature (1706)..(1706): n is a, c, g, or t
gcgctataaaaacttttataaaccccccggagcccgagcagtgtgaagaagaggcgagaacgacccccggaccgaccaaagcccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529638 - DNA, 401 bp, Homo sapiens
gcccttgagtgcttgttagagagaaagagaactactaaggaaaataatattatttaaacctcgtgccgaattcggcacgagcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagcaaaaacattaaa

SEQ ID NO: 529639 - DNA, 1707 bp, Homo sapiens
  misc_feature (1707)..(1707): n is a, c, g, or t
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529640 - DNA, 898 bp, Homo sapiens
ggtggtagcggttattcggcggcccgcggcgtgaccatggccctggccctggcccggcgttcgctgggctttcctcacggcgtcccgagcatcgtcgcagagcgggccgacttccgggaaggaactgaccagcgactgagcggaggcctggcgcgcgttagcgccctgaacatgcggccagtccctgtcgggcgacccccgggctccgtgacagtgcggcggctggaggctggcggctcggcgagggaacggaggcggcgtgcgcccggcggagtgtggcggcggagacggcccggctgcccgtgtcgcgggagccccttatgggaaggcagtctcacacgcgctggccctcgggccttcgttcgaagaaaggattgcttgtctccccgcaaaggaaaacccaacaaacgaaggtgtccacagcccggcccgaggtgcagggcgaaagtaccgtgaagaacggcagacgtctcgcctcctgcttccggaatgccgttcgagatgtgcgtcatgttttgcaaaacattgcgggtgtctctcgcacttgtgctgcaaggttgtgccggaactcctggggccagaattcctttagttccttgcttgccggatgcagaccttgagaacgatccttatgcctttcattcatccggcatggtccaacaattccaagacgaactgatatctgtcttccagattcaagcccttaatgcctttttcaacttctggattcccgatattcattattttcagcaccaatttttctggattggtcacgaaaaaagcggccacttggagattcgtgcccattcacggactacagatattatgaattcaaccatgatctcttccaaagagttgccccggactcagggcaggcattgttcaggtattgcgagcg

SEQ ID NO: 529641 - DNA, 131 bp, Homo sapiens
tagcctgtctgtactatacccagtactccttgtttgggtgctctgtcaagctgctagggtggccctgcctgtcctagatgcttcttcctctacctcctccctcgtgctctgcttctgcccagaaggagcta

SEQ ID NO: 529642 - DNA, 411 bp, Homo sapiens
ggctgccccagccagcagtggcaacccgcttgggtcccctcccacactgtaaaagctttgttctttcgctctttgcaataaatcttgctactgctcactctttgggtccacgctgcttttatgagctgtaacactcaccgccaaggtctgcagcttcactcctgagccagcgagaccacgaacccaccagaaggaagaaactccaaacacatccgaacatcagaaggaacaaactccagacgcgccatcttaagagctgtaacactcaccgcgagggtccacggcttcattcttgaagtcagtgagaccaagaacccaccaattccggacacactttggctattacctgtaaagagtgaaaggcccttgcttttcttggaatcatgtgacattaaaagaaatttccctcta

SEQ ID NO: 529643 - DNA, 1747 bp, Homo sapiens
  misc_feature (1747)..(1747): n is a, c, g, or t
aaagaaaagacgaaagtaggcaggagaggcgggtggtggaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttatagtttttattttaaaaagctatgtggtatagcaccacaggaacacttcatggtggtcatggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529644 - DNA, 1484 bp, Homo sapiens
taaaaaaccaacatctttttaaaggagaaaaacaccttctgtgccacaaaatattgtcgcgcccaaaatatttgagagagaccccattaaaaaactttaaatagaaaaaaaaaaaaaaagggggggcgcgccgcctacaaaaatcatctcccccagggggcgcgccacaattcttcccctcgtccccccctcgttattgtgtgtgtgtaaagagagagggcgcccccttttagtaggaggagagcgctctttattataaaaccagagagagacagggggcgcgcgcgcgtttttatacaacacatcgccgcggagagagagtggaaaaaaagcgcgcgcaccaccgaggggagaaatcatcttggagagagagagagcaacactctcaataaatagagagagagagagaggggcgccacactcatatactggcgagagaacaaaacaaatcaccctctaacaagagaaaacaaaacaacacaccctactaaaaaagagagaacacatattaaacaacctactagcccagcgcgtgtgactctctagagagtgttgagttccaacaaacacatagcgtcgcgcgatcattgtgtagtcggtcagcgcgacgacgaggacgaagaagtcgtatcgagctctaccacaagcgagagataatatatcgctacttaagaagaaaaaaactattcatctacaccccgagggggaccaacacggcatcgaatcctcacacacaccaggcggcgacgagagagagaggaatgtacgaaagaagatgaggtaagaagagaatagacacgacaagagagagaaagacggatagagaacagggacgagagcaggacggaggaggacaacaatcataaacaggagagaagagaaacggacgatgaaacacacaaaagagagggaagagaagagacaaaagcgaggactggacgaaggatgcagaaacaaagagaaagcaaaaagcagacagaactacacgcaacaccacaaaagaggacacaacaaaagagaccaagacgaaacaatagacaagaaaacagcgaggggagagagaagagcaagaggacacccagaggaagagaagaacggcgaagaaacgaaaaaaataagaaagaaacagagaaggagaacaaaagagaacaactcgacaagaagaatagcaacgagcacaaaacgaaaagcaaaacagacaggaagagaagaagaaaagaagaaaaaaagaaaaagaacgacaaataacaaatcaaaaataaaaccaaaaaaagcatacaataaaaaaaagactacaaacaaaccaaaaaaaaataaaataacataacataaaaaaaaaacaaaatcacataaatactaaacagaatacaaacagaaacgcaaaaacaaaacaaaataaaaatcaatataataataccaacacacagcacgcaacagaaaaataaaaaaacaaagaaacaataacaaaaagacgtagaaaaaaa

SEQ ID NO: 529645 - DNA, 1897 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggaaaaaaaaaaaagactaaaaaaaaaagggggggggggtataagaaagaattcccgccgagggggggccacatcatgaatggccagcaaccgcggtatttctgagcgaagaaggggccccaaacaaaaggggggcagtcacaatagataagacaatggcaccgggcccagctcttgtaaacccggtccggcagcggggaacaccgggattccgtggggactaccctggggaaggcacaccagcaccccgcgggcgggtgcgacgcagatggccggagacacctccccaacaagggaattacagccctcaacggcaacatatacacgcacgtgtatacgtggtggacccccaccggagatgattcgtcgccggggacgaacatgcgcgcccggggctgtgctttgagaacaatattaccaggagcgcgcgagaaacaaacggcgttcacaagtagcgactcacctagggcaagagactaacgtcgacaatatgtgaggacaagactacgcacaagtgcaagacagacaaagatcagctctacagctaaggggggacaacagggggcacgcacgagaagaaaaccacaccaagaaggacaagtcagagcaatccgaggcaacaacacagatacagagagacgacagatgaacacgacgccaacaaaggg

SEQ ID NO: 529646 - DNA, 733 bp, Homo sapiens
gcttcggagacgggagtgttcgttgtgccatgtgactaaagaggagaattaagataatgggtgatgtctgatgcaaatgggcaaggaagatgatgatcatcgaagtgtgcccaagtgccagaccgttgaaaaggggaggctaagctaggctaaagtacatgggcctaaatctccatggtcatctttgggcggaatgacgaggtcaggcccctgtgatacgtcttacacagcctgccaaatcaagaaacaatgggctatctatccatggggagaggatacactgtatggagtatctggatgaatctacaagaagatacatcccgtggaacaaaaatgagtctgcgtcgggcattaagtgaagaaggatcgaacgggcagagcttaagtagcttatctcaagaaagctatctgaatgagtaactaacttggcccacctgccgtatatggattacacaaacagaacatgtctcatgatcttattctaatgtgtagcaatccttgaatagcatctcagtacaccaggaattcagatcatgagattgactgactgaatatggtggttgggcatggcctgatgttacattctaagactgggcttgcgggttaccttgaatatgtacaaggttaatgaacttttggaagataactccacatgtcagtaaatgggtatcactgtttaacccgttttcaagattgtgattagacttccggagttattgtccaggttttaaca

SEQ ID NO: 529647 - DNA, 1273 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctgatacgtgcgggtggggtggggcggggggggtgggtgggggggtggggtggggtc

SEQ ID NO: 529648 - DNA, 1879 bp, Homo sapiens
  misc_feature (95)..(95): n is a, c, g, or t
  misc_feature (616)..(616): n is a, c, g, or t
atgcttcggtgggcgcggcagacatgaataaagttttgttggggagcgacacatacgtgtgattgattagcagagggggctggtttatattgagntggtggtcgtattgttttatggaggatggggggctcttttcagcgatcattgatgctacaacgaagctgcgccgcgggatattggagggttggcggtcatgagatcacgcctgtctgggagatagtaggctgtcttctctggctcgcgctgtgatagatgagtttgttgtcgacgatatgtaatgccggggggtgctgatgggcgcacaccacccgcacgaagtgtggcgccgcttgtgtttttgttacatgtgtggcgcggctccaggaaagtgaaggggtgcctcctcctcttgctttttgggggagagttcgccatgtggtgttgtacatcgctgggagggcgtgacatcatgttgtggggcgctccgtaagagagaatgatctttgtgggcatcgatttggggggcgcctcgtcgcgataagaaggggggcgttgttgtgagggcgtctggcatacgtgggtggtaccgcgtgtgtgtggtgagagtcatcaccatagaggtgtttgttgttgtggngccgaacgaggggtgattgggataggaggtttgtatttgtccgggacgcgtgtgttaatatgacgcgggggggggggagacccaaccagaagggggcgcgctaagtaaagggggggtaatcagacaacaaacgaggagggggggtactacacaccccacaaagagtgttggttgtgtggggcggcaccgacgccggctacgacaaggagaagtagcgttgttccgcctcccctcgcgacgaatagtagccgctgctcctgcatggaagaaggccgcttggtgtcgtcgccgaacaagagggtggccgcgcggctgtgtgatattgtatggggggggcgactagtggggcgagaatacactcttcgtggtttttgcggtggttatcaggccgcgttgttttgttgttttgtggtggggggcacaacacgcgcgcgtggtgggggcgaacgaggagaagagaggtgccgtactgcgtcgacgggtgttctcctcgctgcaccgctgttgagaggatgatgctctacgacacagcagaggagaggaggatgttgtattatagtagagaagattgtggcggcacacaaggggggcgtaatacgctctggattgcacagagagagcgggggcaacacaagagtggtgagtagtcacagagggaacactaatatgcgctcgtccccacctgtgaggcttgtatatgagcgctctattgtctgttgacacacaagtggagagcgactgtcacgatccactctctctgctgcggttgggagcgtcttgtgtgtcgcacactatattatgtgtgtgagaaagtgtgggcgcacactaggagtatttttgtgtcacatgggctgtgagaaaaaggtctctgtgtgtgtggtgtgggggagactacgcacacaggagagaagccggggtgtggtgtatcacacactctctcctctgtcacatattgtctcttttgtgctgtggtgtgtcactagagctgagatagtcgcggggggggctctctgtgagagaaagagattgagcccttataaggtttactttgagcacccaccctctcacaagtttgtgccacatggcgcgctgttcacgagccacatggagagagagagagaagaaaagcacatttatatgggagccacctgagaagaaaagagccgagacattgcacaagagaaaaagagaggttaaagcccagggacacaggattttgcagattggtggggtttccaaaaaaagagtatttttccactgtga

SEQ ID NO: 529649 - DNA, 358 bp, Homo sapiens
gagtgacctagaggatccccctaggtatatgtcgtgcatagaattctagctgctttctctattgagcgcagagtatactatgtctctatgtgaatatggacagttagcatttaccaacatctccttgtctactgtgtcttttttttttggaaatggattctcgctctttcgcccaggtgggagtgcagtgccgtgatctcggctcacggcaagctcggcctccggggtttcatgccatttctccgtgcctacagcctcccaagttagcggagaacatacgaggtgccgtgccaccagcgccgcggctaatttttttttataattttttgtttttaatttttattgaagggggcgagaa

SEQ ID NO: 529650 - DNA, 371 bp, Homo sapiens
  misc_feature (53)..(53): n is a, c, g, or t
  misc_feature (83)..(83): n is a, c, g, or t
  misc_feature (160)..(160): n is a, c, g, or t
  misc_feature (164)..(164): n is a, c, g, or t
  misc_feature (189)..(189): n is a, c, g, or t
  misc_feature (237)..(237): n is a, c, g, or t
  misc_feature (281)..(281): n is a, c, g, or t
  misc_feature (287)..(288): n is a, c, g, or t
  misc_feature (290)..(290): n is a, c, g, or t
  misc_feature (358)..(358): n is a, c, g, or t
aaaacaaattggtagaatcagaacatcgcctctgagcaggagaaaggagagantaaccagaaagaggcaggaaggaactggcnagcatgagggaaatgtgctgtatctggactgggatatagtgacgtgagcgtttgcaaaacttgtgaaactgtatgcntaanatctgtgcatgtgtatatgagaatnatacccccatttaaaaaacagattatagaaaacatacagatttgggcntgccctgtgtgcgcgggatacttaaattggctctttcttttttnttttcnntnttgagagagggtctcgctgtgacccagactggggtgaaactcatctcaaaaactaaaaaaaaataacntataattatttca

SEQ ID NO: 529651 - DNA, 1715 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaaggagaggggcgaggccccgaaagaagcgcaaccatccgagcgacagagggcaaagaaagatcacaaggacagcacgaagactgaacgcaaacagagacagcagcaccagtggaagtcggggaacgcacactccacaagcaagagcgcgcgcgcggccggcgacacaaaccaaacgacgggcgggaggagcaaaaggacgccagcagacgagtcgagacgcatggaggaacacacccaccctggcccggcgccacacccgacgtcgggagcccaccaagccgaaacgaacgaaccgcgagcgagagaaggaacgatagcaacgcgtgcaggggagcaaccgacacaaactcggcgggggcgaaaaagaagaaccgcacaagagacaagaagaaaaaaag

SEQ ID NO: 529652 - DNA, 449 bp, Homo sapiens
  misc_feature (2)..(2): n is a, c, g, or t
  misc_feature (12)..(12): n is a, c, g, or t
  misc_feature (36)..(36): n is a, c, g, or t
  misc_feature (210)..(210): n is a, c, g, or t
  misc_feature (223)..(223): n is a, c, g, or t
  misc_feature (251)..(251): n is a, c, g, or t
  misc_feature (253)..(253): n is a, c, g, or t
  misc_feature (403)..(403): n is a, c, g, or t
anaaaaaaaacncccctgggaaatcctggagtttgnaaaaacaatgcctcctatgttaaatccctgccttccccagtcctcctaagtaaacaagggccatttaaaaagccatagtctccttaaaggtcccactatagtggttcctttatttaaggaaataactcagctgggtgccaagttgtcacgccctgttatccccagcactttganaggctgaggcaancagatcacttgaggcccaggagttcganantctggcccaacatggtggaaacccatctctacaaaaaatacaaaaattagcccaggtgtggtggcgtgcacctatggtcccagctatttgggaggctgaggcaggagaattgcttgaacctgggaggtggaggttgcagtgagccaagantttgccgctgcactccagcctgggtgacagagtgggactctgtctc

SEQ ID NO: 529653 - DNA, 166 bp, Homo sapiens
cgacatgaacgagtctgaagacgtattcagccttatcgaaacccatgaggcaccgccagtgaagctgcttggctacaacacagacactgataactgctgagaagcgattatcacaccaaactctgcgtgtcgcggggaaggcagccaacgctgtggcactgcagat

SEQ ID NO: 529654 - DNA, 1914 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctgaaaaaaaaaaaaaaaaaaaaaaaaaaaaaaaaaaaaaaaaaaaaaaaaaaaaaaaaaaaaaaaaaaaaaaaaacaaaggcagaaacaaaagaacaaaaaaaacaaagaaacgaaaaacaagcaaaaaaaaaacacaaaaacaacaaaaaaccacgacacaaacaccaggaaaaccacacagcaccaacccgcagccagaccgcagcacgaccagcacagaacacaccacgccagcagacgcgccagccacaagagagcaccacacagaaccaagccgcccgcccaccgacgcgacacgccacaacacgcgcagagcgaaagacacacgaccaaccccacaacgacacaacaccgcccacacacagcgcgagaagacagaacaccaccaacaggcaatacacgcacacgcagacagtcgccagcacggcgcagcaaccaccacccagacgccgccacacgcacacgcgagcgcagccagcagacacaccaagcgaccgccgcgacgcaacacacgagacagaacacagcaccgctcggcaccgcgcagacacaccgagcaagccacacaagccaagactgccaaacgcacgaacacagcaacgcgcgacaagcaacagacacagaccacgacgaacagacaacaaccaacaccgcgagcagcacacgagacgcgcctacgagccggtctacagcca

SEQ ID NO: 529655 - DNA, 342 bp, Homo sapiens
ctggacagtatctacactgctaacaggagcataagtaagcgcgaccagtttagaaaacaacttgtcattacctagcagaggtgatgatgtacatagtaagtacttctgcttctagatggaaaccccagaggagtagcaaacatgactataaaatatgtataagaatgtttataggccgggtgaggtggctcacacctgcaatcacagcactttgggaggttgaggcaggcagatcacttgaggccaggagtttgagaccagcctgaccaacatggcgaaaccccgtgtctactaaacaatacaaaaatttaccaggtgtggtggtgcatgaacacaccgcgt

SEQ ID NO: 529656 - DNA, 1724 bp, Homo sapiens
  misc_feature (1724)..(1724): n is a, c, g, or t
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctgaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529657 - DNA, 1193 bp, Homo sapiens
  misc_feature (1193)..(1193): n is a, c, g, or t
tgcgtcagcccccgttcactgcgtttggccagctcgcctgactgacttggcggcttgggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529658 - DNA, 530 bp, Homo sapiens
tgccctgtcccatgaaactttccggggtgtggagacgattcttagcactgagggtcgccacagccacgtgagtgctgggacacaaccactgcaactgaggagcggagttttaattctgttcactttaaattaatttaagtagccacatgtggctaagggcccatactggacagtcggttcttcaaggaggtgaatttgagattttccctcagaagcctcctctgagttctgcctgtgctctcgggggtctcagcatctcgggcgccttccccgccaggcacccccggggcgaacgaggaccgtgggcctgtcctgccaccatcgctctggaggtgaggatgcggctcccggacacccgagggcgccctcctgagcctgagccggacagagcgggggtcgcgggagcttcccggcgccggcgcagccccaggaggagggacgggtcctcgcggtgggtgacggtgtcaccgccagcatcgcctctcccgggtttcggggtggccggggcgcctcctcaccggggcggccgc

SEQ ID NO: 529659 - DNA, 1175 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtgtaaactgattggggatcctctagatcacctcc

SEQ ID NO: 529660 - DNA, 227 bp, Homo sapiens
  misc_feature (127)..(127): n is a, c, g, or t
ttgtagtagtctatgagagaaaacaagagaaataaagacttcaaacaaagtgtcaaacatctgagctagtttgtttacactgcaattttcaaagtattttcgtttatacagtgttacttgcaccccngagattcccacgaaggcatgtggaaccccaaaggcgcaaagtaacaacagaacacatcaaagcaatatcgcatgataaatcaatagaacaactacaaccg

SEQ ID NO: 529661 - DNA, 154 bp, Homo sapiens
tggcactaattccactcaatccaaataacaatgcatcccagagactgaatatttaaggtgaaaatctatcaggaatgggaggcattcaggttttaattttcatgtttgtggtagagttaggatgtgagttttcatttaacaaatattcctttat

SEQ ID NO: 529662 - DNA, 1380 bp, Homo sapiens
gaagtacacgatcttgaaaggaagtatgctgtatctctatcagcctctcatttgcatcaagcgcatttgaacattcattcaatgcgaatttcatgcaacctcacggcacagcaagcaatgtgcacatggcacacaccagcatgcaagcaagcatgcagcatttcggcagagcaattgcaacagcaccacaggccacagcattgacagcatgagcacaacaaggcatgcaagcacaacacagaagcaccccaaacaggcacattacctgcaatatattggctctaactagtatattcacagcaatgcttgcacttgcatctagttgcaatatgcgcttccagagcaacacgcatgaacaccatcatatcatagcacagccacattgcaacagccatccatctcaacaagtagcaaagctctcgtcacagcattgccgtagcgcgcaaggccctcatgcagctcctaccgtcacttcacgcaatattcccacctaatagcaacacccacatgccaatcatcttcatcacagcacaccactgcacacacagcatgccactagcacacaaccacatctcacagcaataacgcaacgcgcacatgaacgagaatacgacggcaaaacccgacaaacatcgcacatactcattggcaaatacccacctacatacacactcccacagcacatacgagacaccacaagcacacacgtctaacctgcgaggcacatagcaacacacaggagacaggcaccgcaacggcaaacaaaggcaacatctacggcagacacacacacatacaacagcggcacaacacacggaacacactcggctgcacagacaatcagaccgaaacaaacgaacaacctcaaccttcaacaacaccaacacggacacacagacaccagagaaaaacaacagaccaacaacggaagcgacacacgagacgagccgaaaacacaagccacaccccacaacaacccacgcacgagccacacccacacacacacatccccgccagcccgccaccaatcaggccaaacacccaatataacccacactgactcaccagccagtcaccagcataagggaacgcccaccgtaccacataggccaacacgagcattatcacacatggacacgaccagccatgcagcacagaaacacccctggacacaacttggacacaagacagtgtgccattgacgaccacaagcccaacatacacatcgcgcccatctgcaccgcaacctcactcgacaacagcacaccacacgccgaccacacaatgcaagagaatcgagctcgaccagccacgccatagataaaacactccccacagcgcaactcgaccagcaggaaaagctacaattccaactaccag

SEQ ID NO: 529663 - DNA, 374 bp, Homo sapiens
gtataatctgtgaagaaatgcaacgacaatctcacctgcataaaatctgccgataactacattgaatctactttgcttctatataacaggcaacaaggtaccaggctccccaggtaagtttgatgtggagtgtagtgaaataggcgccgtcagccattgtaggtcgggtacagacgctgggacagcttttggtttttgtttttgtttttgagacagcctcactctgtcgccaaggctggagtgcagtggcactatcttggctcaatgcaacctcagtctcccaggttcaagctatcttcttgccttagccacctgagtagcttggattacaggcgcccaccagcacacctggcaaatttctgtgcccatttcaa

SEQ ID NO: 529664 - DNA, 122 bp, Homo sapiens
acagaggaaacaggtcttattcactctcagagaaaaccttggagattgcacgcggggcaccggctgtattctccaccaggaaacagcccagagaggcctcaagttctagcggcctcagagaa

SEQ ID NO: 529665 - DNA, 431 bp, Homo sapiens
  misc_feature (143)..(144): n is a, c, g, or t
  misc_feature (146)..(146): n is a, c, g, or t
  misc_feature (151)..(151): n is a, c, g, or t
  misc_feature (322)..(322): n is a, c, g, or t
  misc_feature (350)..(350): n is a, c, g, or t
  misc_feature (367)..(368): n is a, c, g, or t
  misc_feature (406)..(406): n is a, c, g, or t
taagaagttcacagtgttatataagtcaaaaaacaagacagaaccacccctaaacatatggctttatgtacataaaaaattcaataatgttgccataaccccctaatacagtgctggatcaacctgctttaagaagcaggtgnngnaaggnctcagcattgtagaaccccagtatttaggtccgtgtcccgattcacagtaaggcaaacattgacacatcagcgcttaggagcagagaaagatacattcaatttgccaaagcaagaaggcgggagacctaactctcacaaccgctgcttaactctcacataactggggcttnatgagtaggtgggtaccggaggtacatncccaatgataacactgnntgacccctcggtgaacttctgatccatcagggaggctntatgcctaaagattgttgtcgttta

SEQ ID NO: 529666 - DNA, 184 bp, Homo sapiens
ccttagagacgtgttgcatgtgacaaaaccctgttctatgaaaaatttaaataaaattagccgggcgtggtggcgcacctgtagtcccagctacccaggaggctgaggtaggaggattgcttgagtccaggaggtcaaagctgctgtgagcttccaccaaaggctgtgtgtccccagttaaaaa

SEQ ID NO: 529667 - DNA, 274 bp, Homo sapiens
  misc_feature (41)..(41): n is a, c, g, or t
  misc_feature (123)..(124): n is a, c, g, or t
gtagcgatctagaggatcccagtgtgatcagttagtggcanagtacgagccgtgctgatcgagatctggtggaggtgatggatccttccttcgtgtgcttgaaaattggagcctgcccctcgnnccataagcccttttgggaactgacgaagtgtatatgtgggcccaagctaactggtgccagtaacacagcagacagcagcccacgtgcaatgctgctcgacgcattgcaaagcgccatgtagtggaactctggtcagacggtggggtaccg

SEQ ID NO: 529668 - DNA, 467 bp, Homo sapiens
  misc_feature (1)..(1): n is a, c, g, or t
nggctcggtacctttcattcagcgtcaagaatgctcatagagttgttttgtgaagtggtttctttgtacagtcctggtaatgaagacgctgtgtatattacatgcttatgggcggctcccccggccagcaggagagtgcgtactactgtagccttctgatttcctgttgtttactttgcagaggctggagcttgggtagtgaacacgctgagcatactcggcgcactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacccgcaggtg

SEQ ID NO: 529669 - DNA, 236 bp, Homo sapiens
cgtcgacctctctccctccattttcaaatgcataagaatgtttctttgtcaaaagagcgtgtcaggtcagagagcgtgtcaggctggtgggaaccgtcccctttggccaaagtgcataaaaggcttggtaacgagattaacattagaccaggaaacgtaaggcggtagctacaggtttgaaatggttggaatcctgaataacacttctcgcctcagaatctccctcctgtcgacgc

SEQ ID NO: 529670 - DNA, 480 bp, Homo sapiens
aagcagttatacagactcaattgtctctaatgctttcatcattgatttctgtgttatcacttcttgctgtacacacctgcctgagagacactagattcaagaatgttccaagaaccagatcatcatacataacaaattcgtaactgctagaaaatacagcctatcttttccgaagaaaactatgtgataaaaccattctcttcacttgaagaaaaaggttatcctaattaaaggaaattaagaactcaaatattttattctactagattgatgaattcccttgatttagaacatttataaacactgtagaacagctgagaccatgtcatctggaaatgaaattaaagttgatagttcataagcagaaaataattccacatgccagttaggtcctagtgatttcatcattatattttctgacttttctccttcaagagagtaatcgcttactcaaatcggtgagtctgtattaactgcttg

SEQ ID NO: 529671 - DNA, 218 bp, Homo sapiens
cggttcgcatgtttccacggctggtgtgcagtgcagctcggtcactgcaactctgctcctgggttcaagcaattctcctgcttcagcctctcaagcagcagctgggattacaggtgtgcaccaccacgcacggttaatttttgtatttttagtagagatggggtttcaccatgttgcccaggctgatctcgaactcctgacttcagatgatccgccca

SEQ ID NO: 529672 - DNA, 281 bp, Homo sapiens
aaaagatgttacctcctacatataatatatcaaagaaaagaaagaaatattgcctaccagataggaaaaatattataaggattcagggataggcagactataggcaaacaggcattctatactaatgatggagtatgtaaattgatgaaatctatttggtagtagtaatcaaaacagcaaatgtgaaacctgatccaataaatttctagtatatacatcctacagaactacccacacacgtagccaaatacatgtacaggaatgttactatacactatact

SEQ ID NO: 529673 - DNA, 620 bp, Homo sapiens
ttttttttaaacggaagaaatggaagccagagacaagcaggtactccgctccctgcgtctggagctgggtgccgaggtactggtggaaggactggttcttcagtacctttaccaggaaggaattttgacagaaaaccacattcaagaaatcaaagctcaaaccacaggcctccggaagacaatgctgttgctggacatcctgccttccaggggccccaaagcttttgacaccttcctcgattccctccaggaatttccctgggtaagagagaagctgggagaaggcgagagaggaagtcacagccgagctgcctacaggtgactggatggccggaatcccctcacacatcctcagcagctcgccatcagaccagcagattaaccagctggctcagaagctaggcccggagtgggagcccgtggtcctgtctctgggactgtcccagaccgacatctaccgctgcaaggccaaccatccccacaacgtgcattcgcaggtggtggaggcctttgtccgctggcgccagcgttttgggaagcaggccaccttcctaagcttacacaagggcctccaggcagtggaggctgatccctccctgctccagcacatgctggagtga

SEQ ID NO: 529674 - DNA, 944 bp, Homo sapiens
actaaccgttgggttcccccggtgctccgttggtgagcccccatttgttgacacaagatgtctcgtccgtcgcatatcccgggttctccctcgcgtggtgccctccccccatgtggtccaacgctctcccccctctaagacgttcccctcttggtgccgcgcctgatgcatgtcccgatggcgtgcacgcccgtgatgcgcctgtcgtggcagcgccgcaccgaacgtcgcttatactgtcacttctcgcgccctgccgcggttatttagccgcctcttggatgtttcctgcccccccaacatcctatgttcgttttcccgccttcgccaattctcttccgactcgctgttgcaaataacccacaagcgaggggctcacgaagactccgctcgcccgttggcagacactcaaagacgcaaatggcgcccccaccaaggggccctgacaccttcgggaggacaccccggctttccggcgcgcggctttatatttctcacatgcctcgacgaaaaatgtcgccgcccccgtattgttccttggtgaccccggcggagaccttggagatctcctttagagctgttcgcaccaaccgggtgtggtgacctccccgcgttgcacacgcccccactctgtataataatgaccatccaacagacagtcctttccgaaatctatgaggacgctgtctccccaccacaatgtcgccttaaaaccagatgccatttctcgagagttttaacacccacaccccctttcttccccgtacaaccaaccccggggtattacataccgcggctcaatcctctctgtgaaacttttggagcacaaccacacatttctaaaccccctctcgtccctaaaatttattctccctctaaaatatttttaaaaaggcccctttttcccctcgccccccctttcccccctttaaaccccaaaaaaa

SEQ ID NO: 529675 - DNA, 80 bp, Homo sapiens
cctgaggaaagagcagcgggtggaggagcgggcaaaggaggtaagggaagatggcaatggatggtgcataggagagccgg

SEQ ID NO: 529676 - DNA, 338 bp, Homo sapiens
  misc_feature (150)..(150): n is a, c, g, or t
gacggcctccctctgctgccggtagacctcctgcagcctccgcgtcctcagctcccgtgtgcgcagggccgaggcattctcctccagggcctgccgccgccgggcctgcgccttctcagctgaactcccgcaaggactcagagctgtgangggtcccaggagcccccgggacctggggcagggcgcagcgtgtccttctccttcccaagtgggttctgagggaagctcccggtgggccttggcagggcatgcttggcagccgagacgggggagccgatgcctctgcccttgccctgggcgctggccctctgcacgccggagctgctccagggccgctg

SEQ ID NO: 529677 - DNA, 428 bp, Homo sapiens
tagctgttctagaggatcccgtcggcgcaagtgtctggcgttattcttctgttgtagtatttcgtagggtctctgcatttcctgaatttgaatgctggcctctctaacaaggttgaagaaatttttatggactatatcctgaaataggttttccaagttgtttgccttctattcctgtatttcatggatgccaatgagtcatatatttagtctgttaacaaaatattatatttcttggaggttttgtgcattcttcttcattatttttctttatttttgcctgactgagtaatttcagaggactactcttgagctctgagattctttccccagctttgttgattctgttgttaacacttgcattagtattccaaaattcgtgaagtgatgtattcagctctatcagatcagttggattttttcttaaa

SEQ ID NO: 529678 - DNA, 883 bp, Homo sapiens
cgatgcagctgccgatgtgcgcgctcctcgtgtgacgtgagctgcgcccctgtggggccggtccggtctgctacgggaacgcgcctctgatggcccagccctgtctccttttagcataggggcttctggcgccagctggccagctgctagtcggtctggtaagtgcaaagcggagctgaagatcctcaaacggcctagtgcttcgcgcttcctggagaaacatcagcggtctaattaattcctctggtttgtttgacgcagttaccaagaatcttcaaccctttcccacaaaagctaattgagtaacacgttccttgttgagtacactgtcctgttgatttacacaatggtgccggtatgagcaggtctgaagactaacattttgttgacgttgtaaaacagaaaacctgttagacatgtggtggttcagcaaggcctcagtattccttccttcagcccttgtaatttggacatctgctgctttcatattttcatacattactgcagtaacactccaccatatagacccggcttttacccttatatcagttgaccactgggtacagtatgctccagaaaccatgcttatctggggcaattgctacatattgcggcagtttatgcattgctaaccatgtattgtccggtaataacgcaagtctcatgctcctgatatccttgacagagaacgttactcctcacaatttaacacaatggcttggccatatgttactttggacacttccttgaagtttgtactaaggcacttttctaatatgtgggcaactttcccagcaaatacgaacccctttcgagcttgccccgtggtactgtttgtaccttgtgtatacacttttggtaatggtgcgacactaattattag

SEQ ID NO: 529679 - DNA, 304 bp, Homo sapiens
  misc_feature (73)..(73): n is a, c, g, or t
  misc_feature (110)..(110): n is a, c, g, or t
  misc_feature (112)..(112): n is a, c, g, or t
  misc_feature (118)..(118): n is a, c, g, or t
  misc_feature (121)..(121): n is a, c, g, or t
  misc_feature (239)..(239): n is a, c, g, or t
  misc_feature (294)..(294): n is a, c, g, or t
ccagagcatcctggacatgatgggcctcatggaggtccttccggagcgctgcgtgcagatcgccaagcgggantgcatcttcctggggcccgtggctccatcatgtaccntngggggncgntcttcttcatcaaccgggcagcgctcgtagcacttgccaatgacagtgatggccgacctgggcgagccgcatggtcagggagaacctcaaagtgtggatctatccccgaagggtactncgcaacgacaaattggggaccttgctgcctttttaaagaaagggcgccctttctnaccttggcaa

SEQ ID NO: 529680 - DNA, 562 bp, Homo sapiens
attcagggacccatccccacccctgccaaccttgggaagcatccagttttcaaatggtttttgttagggatttaaactaacaagaacattccttgatttccctccggggggggttttaaacccccaagtagggaaaatatttggcaggcaaaaaaaagtttgtgattataaccaatgatggggatgccctgggccccctccgttagtgtgaaaagcctgcgccccaggaaggatttgtgttagtccctgggaggggtccaaggcctgttttaggaaggcagcatgttcagtgggaacccagcaagatttagaatttaaagtagttgttttaggggtttgggcactccctttttttcttcgcagcctccctaaaatgactccagggtgcccctgtgtttagtgagcaaaagtgattgagttcatgttccctgcaagggccatttcttttccaggaggggcctttaaaaataaggcctgggtcaaagcctgtttgcccttttttttaaacaattgtaaaaatcccttaaattaaaaccctttgcaataaacaccccccaggtta

SEQ ID NO: 529681 - DNA, 1204 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtacgacagttacgtatgatgtcattcctgcatatgctggggggatactctagatacaggctaa

SEQ ID NO: 529682 - DNA, 218 bp, Homo sapiens
tgcatctcgccagtgcgcgccaacgcagcatctcaggctttcgttgggccaggataggttttgcagcagcagaagactatgaactgggctttgggagataggatctctgggggggttggggctatccacactctgaaagaggaccgtgacagagaatttgagtatcctaccaatatacctacaaaaggatgaaagaagatttggagtcaagggaaaac

SEQ ID NO: 529683 - DNA, 252 bp, Homo sapiens
attacgggtaagaagcatagaggcttctgtgacagttcagggtttagttcctgatttctatcctcttccacctaccagttgttgcatttccttcactgtcagaatttgattgttctgtctctgtatcttcagatgcgtttttcctagcgtatttgacaaactgttgaacagtcccctctgctcagggagctaagagcgttacacaatcaggagcagagactctgatatttctctctccagacctagaccctg

SEQ ID NO: 529684 - DNA, 1242 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgatcgtccgcattcgtcccgactctcatcgcccttttgtcgctagtcagtcccatttccccttttggattcagtttggaatgaaaaaaa

SEQ ID NO: 529685 - DNA, 1881 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaatctcaaacacatttgctttatgtcctctttccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529686 - DNA, 1878 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaattggtttaatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529687 - DNA, 483 bp, Homo sapiens
tggcttggaaatgtgcctgcaccactgtgtggtgcctccttaagttgccccagactccagatggtcaaagaaaaggtgaatgtccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaaaaaaaaaaaa

SEQ ID NO: 529688 - DNA, 889 bp, Homo sapiens
agagcttcaagccaaagttattgacactcaacaggaggtgaagctcgcagacatacagatttgaacagcaaacagaacgaaaaagcatgcacatcttacagatacagagatcatgactttggtagatgagactaacatgtatgaaggtgtaggaagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcaggggaaacagcttctcctctgccccgatggatgctttatttggatggcctggcaagatcacattttctgcatcaccctgagaccccatttgcttcgccagccctggagtttttacccggctttgcctgccagctctgcccaggacactcttccctctcgggatgtgtgatgaactcccaggagagggaagatgggagccacgggcaatgataggaagctctggctgagctcttccactagggacgccagggcagatgcgaataaaaagacgtatgtaccaactctgctaacgcactggttttacttgtagcaggagggatggaacagagggtgagagaggcatggggtacgtactgcacgctcagctcctggtccctctgcatcagagcccttccttcctatggggggatgggccttgccctcttctcttttcccttactgtacctttgactcaacgctcagattccgggcctgatgcagtagacagaagagga

SEQ ID NO: 529689 - DNA, 348 bp, Homo sapiens
agcgtatcctcctttcacctgagctcttctcctacacatcacaaagccccatagttcctaggacagctagtgacacgcaggacagccagggcagcaactgatgcccacgatggggatggtgggctgggaagacggcttccatctcagggtgaggggctccggcagcccctcgtgctgaacatggcacgtgtatctctgctcttctccagaaggcaccaccacagagtgtccacttcttgggaagggtgcctcttccttgctggcctgggtctcccacaaagctcggggtactgagtttggggtcttaacccaaaaccccgggggtaacggagctcggatttcgggaac

SEQ ID NO: 529690 - DNA, 1539 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529691 - DNA, 5590 bp, Homo sapiens
  misc_feature (2079)..(2079): n is a, c, g, or t
  misc_feature (2554)..(2554): n is a, c, g, or t
  misc_feature (2565)..(2565): n is a, c, g, or t
tgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggntgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggcacctgagccttcgttcttcagcccgactgaggaacagcagctctgggaggcacagagtgcaggtctcangggcagaaganatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccggggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaaaaaaaaaaaa

SEQ ID NO: 529692 - DNA, 921 bp, Homo sapiens
gggcttacagtgcaccaagatggcgcccccgtgatctagagctgaagaaggtttattcttcagtccaaggaagcaattcacagtcagctgttagagaagcagaaaatagcagaagaaaaaattaaagaactagaagtaagtttttattgggcaactaggagttcacttttgggagaacgtagtactcttatggtgtcatattaatgtgaaattgtatgcctgcttgcaaagtactgtcatataattcatttttaataattacgttggagccgtgaagctgtcatattcatattcatagtgcatataagacaaaaaaaaaaaaagggaatagtctcttcttttggaacgttgcagacagacattttggattgagatggttaaaacccttgaatgtatttgggtacatgggcccttagaatgtggttaatctttataaaaaaaactaaaaccattaaacaaagtggtagggtattttaaccaacactgggttgacgttgatgtgtggtggaatggcatggagagtggtacatatgataaatttaagaaggactctgggaaaaagggcctttgttatacaccattggaattgtttaaacataaaatgagggtctatatagggccaaggatggcatgtaataccaagtaagtatcggaggatggtgccaaatgagacagtttctttagctaggaacagataatgtacaggtaggcaatgtggaatatagttataattataattaaagaataatataagacattgagagatattttgggtgtggaggcacctgtgtgtaagtgtaggacaactgggtttttgggcaacttcaagtgggaatgtgtgagaataatgtgatatgagacgaaaaaaccctgtgaatatctgtataagagcggagcattatatatatatgtagttaaaat

SEQ ID NO: 529693 - DNA, 128 bp, Homo sapiens
gctccaccttaccaccagacaagccttagccaaaccatttacccaaatacagtataggcgatagacaatttgactaccctggcggcaattagaatattagttacccgcctaggggcacaagatgtaca

SEQ ID NO: 529694 - DNA, 279 bp, Homo sapiens
  misc_feature (224)..(224): n is a, c, g, or t
ggggtcacttagggctggtgtccattcatcgcgttttctcttgagtattcctcacatttccctatttttatgaatgtctaattctagattgtgccattgtgtgtgattatagagtttccagcttttctcatgttctgaagagtgttgtttctctcttgcaacagggaatattgtctggacaaggtcgaggcttctgctggtgggggcaggcagcagatggaggngccttagtccttagaccgcaccagctgtgcaagtcggccctccaccgtggctggg

SEQ ID NO: 529695 - DNA, 1825 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagataactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529696 - DNA, 5185 bp, Homo sapiens
  misc_feature (1674)..(1674): n is a, c, g, or t
  misc_feature (2149)..(2149): n is a, c, g, or t
  misc_feature (2160)..(2160): n is a, c, g, or t
tgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttccttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggntgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggcacctgagccttcgttcttcagcccgactgaggaacagcagctctgggaggcacagagtgcaggtctcangggcagaaganatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccggggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaaaaaaaaaaaa

SEQ ID NO: 529697 - DNA, 1285 bp, Homo sapiens
caagatactgaaacacagcagagaactaccgaggcagctggcgcagatgcttgtaggcactgttgagaaaggcttcagacccacagtctgaagagatggagaacccctcctccaggagcaaggaataagaatgacaattgttctgtaggacagttgacttagattcaggaaagttcttcagaaaatatattcagatcacaaaaaaggtgttaaaatcccaggatctttcagccaaggatggcacttgcttctttcagcatcactcatcaagttgaaatttatgagtgtccttggttatcacaaacaaagcaagcaaactgaacaaatgagaatgcttctttagtatctacatagcaccttaaaagctctgttatctttacaaaatgtgtgtatggaaaggtaaaatgggaataaatagtattaaattctgttcttaggaacctactgtatagtgatagaccagctacacagaacgaaaaagcatgcacatcttacagatacagagatcatgactttggtagatgagactaacatgtatgaaggtgtaggaagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcaggggaaacagcttctcctctgccccgatggatgctttatttggatggcctggcaagatcacattttctgcatcaccctgagaccccatttgcttcgccagccctggagtttttacccggctttgcctgccagctctgcccaggacactcttccctctcgggatgtgtgatgaactcccaggagagggaagatgggagccacgggcaatgataggaagctctggctgagctcttccactagggacgccagggcagatgcgaataaaaagacgtatgtaccaactctgctaacgcactggttttacttgtagcaggagggatggaacagagggtgagagaggcatggggtacgtactgcacgctcagctcctggtccctctgcatcagagcccttccttcctatggggggatgggccttgccctcttctcttttcccttactgtacctttgactcaacgctcagattccgggcctgatgcagtagacagaagagga

SEQ ID NO: 529698 - DNA, 215 bp, Homo sapiens
ttctacctgacctaggctgtatgtgttgctacactcatctacaaagtgtaggcagcatcaaccctgggaaatggcacatttgaaccaggatcgccctgacatgggcttgccttaattgtatgtgtatccccacccctgacctagcttggtatcttgtggatgtatctgtgacagtggtaaaagtacataaaattgcattcaaggggtaagcagga

SEQ ID NO: 529699 - DNA, 1393 bp, Homo sapiens
taaaatcatagccatatggtaaattttctatttggttatgggttctctgtttatgtgagtgggcattgcaggtggggtgttactgtggaaagtggccaatttttattaaaatatttctggaagaaaatttaaaaagaaaaaaaaaaaaaaaaaaaaaaaaaaaaaaaaaaaaaaaaaaaaaaaaaaaaaaaaaaaaaaaaaaaaaaaaaggggggcgcgagcgcgacaaaagaaatactccccgaggggagcgcccacactatgaagcccaccccaagttttgtgaggtcaaacagagaggggcgacaaataagaggaggcgcctatattatataatagataagaaagcaggagaagccgggtctattatatacaaaacacacgaatagagtgaggaaaaacaagcgtaaaagacgagagaaatctttagtgaaaaaagaaccttatatatatatagtggggatggagaaaaaattagtatggacaaatacacacactacacaaaagaagagatatatattaaagagactagcaaaagaaggacaaatctaactacacaacaaactgagagagcgaagattaaataatgagagtgtgataaaaaaaacagacgcagactaatataagatgacggcggtaagaaaaaaacgtattgcgtcataatggaatgtctattaaatcaatatagaagaacacacaatctactcacaaacgccgggaggaatacgccgcaagaccaaacaagaggaaagaaacaaagaaacacacacacaaaaacgaacaaaaaagacagagacagagaacaccaaggaagcagacaacaaacagcatacaaacaaaacagacaaagcgaagaaacagacaacccaacacaagccaacagacaggggcgagaacggagcacagagagagaagagcaagaaagaaaaagagagagaaaaagtaagaagcaagacaaaaaaaacagaaaagaggccgagaggaacgagaaaagaagagaggcaagacggaaggaaacaaaaacaaagaaagaaagaaaagaagaaaaaaaacagcaaaaaagcgtaaagaaaaaaaaaacagaacgacaaaacaaacagcgcgaaagaaggaagaaagcacaaaccaggcacagcaggcaacacacgacagcagcacagcacaggcagagcggaaaaccacacccagcgacagagagagacgcgagaagggacgcaacagacaagaagagcagagcaaacaagagcagacccacgcagacaagagagaggagataaagaggagaaggaaagaccgaacaacgacaggaggaccaagccaagcaaagaacgagaaggacgaagacagcgaggcgaggaagacagagcaagagacggcagcgagacgagatcag

SEQ ID NO: 529700 - DNA, 200 bp, Homo sapiens
agctcccccgattggcatacaggcagagccaatgatcgggtagatagacaaggtagaatatccatattatattctgtattaacaacgtggatggacacctctataaacttgatggacgaatgccttttccggtgaaccatggcgccagttcagaggacaccctgctgaaggacgctgccaaggtctgcagagatattcac

SEQ ID NO: 529701 - DNA, 1806 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529702 - DNA, 957 bp, Homo sapiens
cggtgatctagaggatcccgaaggcgcacgatggcgcgtcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaaaaaaaaaaaa

SEQ ID NO: 529703 - DNA, 780 bp, Homo sapiens
gggcttacagtgcaccaagatggcgcccccgtgatctagagctgaagaaggtttattcttcagtccaaggaagcaattcacagtcagctgttagagaagcagaaaatagcagaagaaaaaattaaagaactagaacagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcaggggaaacagcttctcctctgccccgatggatgctttatttggatggcctggcaagatcacattttctgcatcaccctgagaccccatttgcttcgccagccctggagtttttacccggctttgcctgccagctctgcccaggacactcttccctctcgggatgtgtgatgaactcccaggagagggaagatgggagccacgggcaatgataggaagctctggctgagctcttccactagggacgccagggcagatgcgaataaaaagacgtatgtaccaactctgctaacgcactggttttacttgtagcaggagggatggaacagagggtgagagaggcatggggtacgtactgcacgctcagctcctggtccctctgcatcagagcccttccttcctatggggggatgggccttgccctcttctcttttcccttactgtacctttgactcaacgctcagattccgggcctgatgcagtagacagaagagga

SEQ ID NO: 529704 - DNA, 1823 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctccaggaggagggattccctgactttgacacacatggccaccttggcacaaaagccttgtggtatagaatctcaaacacatttgctttatgtcctctttccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529705 - DNA, 5536 bp, Homo sapiens
  misc_feature (2079)..(2079): n is a, c, g, or t
  misc_feature (2554)..(2554): n is a, c, g, or t
  misc_feature (2565)..(2565): n is a, c, g, or t
tgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggntgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggcacctgagccttcgttcttcagcccgactgaggaacagcagctctgggaggcacagagtgcaggtctcangggcagaaganatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccggggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggtttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaaaaaaaaaaaa

SEQ ID NO: 529706 - DNA, 1701 bp, Homo sapiens
  misc_feature (3)..(3): n is a, c, g, or t
  misc_feature (54)..(54): n is a, c, g, or t
  misc_feature (90)..(90): n is a, c, g, or t
  misc_feature (98)..(98): n is a, c, g, or t
  misc_feature (112)..(112): n is a, c, g, or t
  misc_feature (568)..(568): n is a, c, g, or t
  misc_feature (571)..(572): n is a, c, g, or t
  misc_feature (577)..(577): n is a, c, g, or t
  misc_feature (579)..(579): n is a, c, g, or t
  misc_feature (581)..(582): n is a, c, g, or t
  misc_feature (585)..(585): n is a, c, g, or t
ctncaaagtgatttttttccccacaaaagttcaacacttaagctagactttcantgttaactttgccctaaaaagttaagacattctggntaaccatnacagtcacatgatntctgatgctatctggtctgttaataataaagtctttatttggatgtatttttcctcaattaaattacaggaaactggatataggatttcgttgcaacgctattaaagttccaaaccaggagtgtgcagcactggaaaaggagatcagtactaaaacttacaataaatatcagagaagccgttagtttttacagcatcgtctgcttaaaagctaagttgaccaggtgcataatttcccatcagtctgtccttgtagtaggcagggcaatttctgttttcatgatcggaatactcaaatatatccaaacatctttttaaaactttgatttatagctcctagaaagttatgttttttaatagtcactctactctaatcaggcctagctttgctcattttggagcctcactaaaataacagatttcagtatagccaagttcatcagaaagactcaaatanggnntgatnangnnatngaaaccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529707 - DNA, 4149 bp, Homo sapiens
  misc_feature (2079)..(2079): n is a, c, g, or t
  misc_feature (2554)..(2554): n is a, c, g, or t
  misc_feature (2565)..(2565): n is a, c, g, or t
tgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggntgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggcacctgagccttcgttcttcagcccgactgaggaacagcagctctgggaggcacagagtgcaggtctcangggcagaaganatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggggggggctgccgaccagaggccttaaactctggtgtcgagtactactgcgaccacctgaacgagacgagcttcactgtccatttcaacagcatgg

SEQ ID NO: 529708 - DNA, 87 bp, Homo sapiens
  misc_feature (28)..(28): n is a, c, g, or t
aattcaagcttcctaacgatgtacgggngacatgttttaaacaatataaaatagaaattaagaatctaaatatttagatacaaaaaa

SEQ ID NO: 529709 - DNA, 469 bp, Homo sapiens
aggcatgcatgctggctgttttaggtcttatgctaaggcagcaggcccagcgtggtcagaccaccggtagacatgagtctatcagaaggctggacattaagccagctccgtagattgtctaggcatccggttactaacctatagcttagcgatagggatttaacatcagattcataggatcagctcttatgataaaagctgaagactgagagtcgtagcatgcggactgcaaaggcatgtggctgcatggagatcacacagtgatgagacgacactctttgatgaagaactactacggtttaccagttgtgtgaaaggactaaagaggcctgatatatatctcgttgaactgcatggctgttagattaaattgaacgcgtctaaacaagcttgctgtagagatgaaaggttgtaggcgcttaactagggtcttgcgtttgcctggcactaggctgacagttatgccgcc

SEQ ID NO: 529710 - DNA, 797 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaacaattgttttattcctcttctccctttccatctagcatagctactcctaacgatacc

SEQ ID NO: 529711 - DNA, 382 bp, Homo sapiens
  misc_feature (2)..(2): n is a, c, g, or t
  misc_feature (69)..(69): n is a, c, g, or t
  misc_feature (75)..(75): n is a, c, g, or t
  misc_feature (121)..(121): n is a, c, g, or t
  misc_feature (156)..(157): n is a, c, g, or t
  misc_feature (159)..(159): n is a, c, g, or t
  misc_feature (161)..(161): n is a, c, g, or t
  misc_feature (205)..(205): n is a, c, g, or t
  misc_feature (225)..(225): n is a, c, g, or t
  misc_feature (228)..(228): n is a, c, g, or t
  misc_feature (232)..(232): n is a, c, g, or t
  misc_feature (272)..(272): n is a, c, g, or t
  misc_feature (301)..(301): n is a, c, g, or t
  misc_feature (318)..(318): n is a, c, g, or t
  misc_feature (341)..(341): n is a, c, g, or t
gnggatatccttacaaatattatcttgctatcacatcaactattatacatttaatcgtttacatgcgcnctaganaacatctacatgtacatttcaaaatataaaaatatattacaaatcngctgaattatttacaagcaatgttctattatctcnntncntcatttgttttatacgaatactaacagagttacacatatttccntttctgttaagtcaataganaantcgntatggcttcttagcttacgcaagcgaagaaagtgtttttnttttccttttcaagaccaactttggtgcntaaaagattcagtttgnagatacttgtaaaaaaaatacantttttcttacattaagaaaaaacaactcgagaaaccaaatg

SEQ ID NO: 529712 - DNA, 116 bp, Homo sapiens
gctgcggtgactctgaggatcccctgcggcgcgagcacttgcggcgcgagccctagggtcgacggtatcgataagccagtaattctcaattactcactagtgctcggggccgcaag

SEQ ID NO: 529713 - DNA, 1310 bp, Homo sapiens
agctgctgccctcgtgtggtgtcccctttcggactgtagctcatggtgcttcgtgtcaaggctgttggtgtcaaccagatgagtctgtccgctcgtatctgtgtagaccctgctgtccgccgtgtgcccgacccgtttccatttaccgccttgtgtgacacccttgtttgccgcaggggcgccaagccctgtcgggttgccctccctttctcagcgggtgtagtggggcggactccgcgcggtctttcgttccgtcgtccgtgctttccgttggttgtcaggcgtttcgtagtagatattagtcctcgggggggccacggggtccgaagtggtccatgcatttccacgagtatcaaggtccatgggaagtatatccccttgcaatatatgccgtgatgaccacttgtcttaaagcgacattccccctgaggtcgttccacagtcccggcaagacatctatccctgtgggtccaacgctgttcccgaacacgtctctgtaagtttggtttctgtgttgtcgatcagatattgggggcagagattttccttggtccagggctaagggtacgtttctctgggaggctgtagttatccctcacctagtgatctggctgcggtgtacatgtctcccactttatggtgactgacttatgggcagtgcttagtctccgggcatggcacctatgctatatcgtcagggcacgagggctaatcctcggtgtattctggttgagatgaggggagcttcagacggagcctgatgctcaaaaccctagttctgctctggattcaatgggggaaccttgggcaagttactttccttttaactgggcctcatgctgccccatgctgttaactgtgtgagataaccgtacctcccttgcaggattataccgaagagtttaaatccaaatgtatataaagattgaggccaggcacggtggcttacatctggaatcctagcactttggcaggccaaaacacggaggagtcgcttgagcccaaggagtttaagaccaacctaggcaataatacgtgagaccccggttcaaagtaaaaaaaaataaaagattggctgggcagcagtggctcatgcctgtaatcccaggcctttgggaggccgaggtgggtggatcccctgaggtcaggagtttaagaccagcctggccaatgtggtgaaatcccttctctactaaaaataaaaaaattagccaggcatggtggccgggtgcctgtaatcccagctactcaggaggctgaggcaggagaatcacttgaacccgggagaaaccagcggcagtgagccaagc

SEQ ID NO: 529714 - DNA, 614 bp, Homo sapiens
cctggacggaactgggctcgcttttctgttgggaatgtgaggctctccctacggtcgtggtctgcgttcgtccggatcttccgtggccgccgctaccgccgctaccgccagcaccatctgccatcaggccgcgcgcgcacgcagaggcccggcagccgggtccgagaggcgcgcgcacgcccgctcgcccgcgtggtcgccgcccctcggaagcctccggagcctcacacgggttcgctacggagggaggcggaggcctgcgggaggaggcggaggaggagcgagggaagatggcggccgtggagctcgagtggatcccggagacgctctacaacaccgccatctccgctgtcgtggacaactacatccgctcgcgccgcgacatccgctccttgccggagaatatccagttcgacgtttactacaagctttaccaacagggacgcttgtgtcagctcggcagtgaattctgtgaattggaagtttttgctaaagttttgagagctttggataaaagacatttgctccaccactgttttcaggctctgatggaccatggcgttaaggtagcttccgtcttgccctacttcttcagtagacggtgctcttacata

SEQ ID NO: 529715 - DNA, 524 bp, Homo sapiens
ctggtgacggtaccaacacaccagcccaggccagacttaggaccggggctgtaccggagaagtacgcacggttctgggcttcagggagaccaggctccatttctgcggtgaagtcttggagagaccaggatcaggggctgagtgcaacctcctccccatgccatctgcagagccggaagaggaaaacacaaatacaagtggaggccatctcttcccctagggcctaacctctaagcctagcagcacaaactcaggagctgtggtttcatttaataataaatatgcatccttgaattcaacggaggaacatgctcctggaatttagaagcaagaggggctgggcgcggtggctcacacctgtaatcccagcacttggggaggccaacacgggcagactgcctgagctcaggagatcgaggccggcctgggcaacatggtgataccgtttctactaaaacacaaaaaattagccaggcatggcagcctgcgcctgtaatcccagctactcagaaggctgagacagg

SEQ ID NO: 529716 - DNA, 270 bp, Homo sapiens
aaattggtatttatcttggaaatggcagtctcatttctcataaaagccaagagacctatttaacctgtgatggctatcacacttcaaagatagcagaatcttttagaactgaagctccttgaagcaggctgaaaatacatataagcaaacagaaaagataagtttaaaggcgacttcagtaaagatccagctggtgatctgacctcccagtgagtccctgagtgcttggaaatgttatagtcttgacggaaatatggaggttattggcat

SEQ ID NO: 529717 - DNA, 533 bp, Homo sapiens
tcttgagtatcccctaattggacagcgcgtgatacgattagggcagttattttatgtaaaggggtattgttgtgtttggtactgttataggtgggatgttgtggagatgataaagccagcgaaaatgcttccgattaaaaggcgtttaatagagttaattagtagggggttattttcattaattaggactaggggtgggaaacgtggttaccctaggaatgcaaagaagataattcgagtgctgtaggcagcggttagggatgtggcaattaatgtaattagtagggctcaggcgtatgtgtaggatatatttactgctccgatccattatccacaggcttaatgacgagcaagacatccgaaacataggcaggactgtataaagcaataaccaattcgacagcaagcagcactaatttattgggaagctgggattgacaggtaatgccttattctcagaggattctactcagaagaccttattatagaggcagcaaaacattattccataaaaatgcctgagccctactaat

SEQ ID NO: 529718 - DNA, 189 bp, Homo sapiens
ctcattcggggcacctctgtcatctttgccttgaggatatcctatcgtcccagtgttctgcagtttcatgcagctccactagctcgttggcccttcctctgggcttgcgcaggttctgctgctaggtgtcgtgggccataggcctggccagtggcgggccccgcctggctgtgctgtgtgtgctggagc

SEQ ID NO: 529719 - DNA, 343 bp, Homo sapiens
tagatcttaaagtgtttatctgtggtttccgtactgcctatgatacattataagaatttataattaaagtttattaagaggaaagattatgcttatattttaggggaagggggaatattgaactacatttatagtgattttgtttcaggtttttctgaggaattttaaataccctgtgtcctcttaatagtaaaaacagtttgaggtactctgagtttcttacaactatttgtctctgaatagttttctcttaaaatttgacaaatattaaaaacattgtccttccttctttggttacagtgggagtctcttctgttttgccgggaaagtttaacatattttt

SEQ ID NO: 529720 - DNA, 378 bp, Homo sapiens
agtccataacattgaatttagtcttgtactttcctcccttttttttgagacagagtctccctctgtcacccaggctggagtgcagtggcacgatctcggctcactgcagcctctgcctcccaggtgcaagcaattctcctgcctcagcctcccaagtagctggggttacaggtgcgtgctaccacacccagctaagttttttgtatttttagtagagatggggtttcaccatgttggccaggctgatctcaaactcctgacctcaggtgatccacccgcctcagcctcccaaagtgctgggattataagcttgagccaccgcgccggcctccttcttataattatagtaaataattacctcacctcagtcccatatag

SEQ ID NO: 529721 - DNA, 263 bp, Homo sapiens
tgctgggtaaaagcctaaattccccccccctcatggtttgggggccgcatggtccttgtggatattgggtttgtgggagttaagggaacttaggaaataaggtccccccccccatttttttttgggattcagtttttcaaaaatcttttttttttccccttcccccccctgggggaattacaaaaccaaggcccttttctttaatgtaaagggggtttttttaaaaaaaaaaccaaataaacccccagtccgtctttgtttta

SEQ ID NO: 529722 - DNA, 325 bp, Homo sapiens
ccccccggggcgggcgggggccccaaggccccgggggccctcttgtgggggggggcccgccccgcgctttttttccccgccggggggggccccccgggccggggccccccttttttttttcccctttcgcggggggcccccacgggagctgggggtttccctttttgggttgggggccgttccccacttggggtttgggcccttccccccccgggctgggcctacgggttttttttggcccggggttttggcccccgggggccccccccccccctttccgggggggttccccccccccccctttttttttttttgggggggggga

SEQ ID NO: 529723 - DNA, 223 bp, Homo sapiens
cactgcgagtcaggagtatgagaccagcctgaccaacatgggacaagcaccgtatctaaaaaagacggagatcagccaggagtggtggtggaacaccgcagtcccagctacacgggaagcagaggcaggagaatcactcgaccctgagaggcggaggttgcagtgagccacagatcgcgccactgcactccagcctcagcctcccgagccgcagggaacgaca

SEQ ID NO: 529724 - DNA, 103 bp, Homo sapiens
tccgccgtgtcgcacagtaaggggtagggggtagatgaggacaagaacaccctgagaaagtattttacatgcacaaggctttatgagagaataggagaacaca

SEQ ID NO: 529725 - DNA, 596 bp, Homo sapiens
  misc_feature (2)..(2): n is a, c, g, or t
  misc_feature (85)..(85): n is a, c, g, or t
  misc_feature (101)..(101): n is a, c, g, or t
  misc_feature (103)..(103): n is a, c, g, or t
  misc_feature (114)..(114): n is a, c, g, or t
  misc_feature (120)..(120): n is a, c, g, or t
  misc_feature (125)..(125): n is a, c, g, or t
  misc_feature (130)..(130): n is a, c, g, or t
  misc_feature (174)..(174): n is a, c, g, or t
  misc_feature (195)..(195): n is a, c, g, or t
  misc_feature (244)..(244): n is a, c, g, or t
  misc_feature (252)..(252): n is a, c, g, or t
  misc_feature (262)..(262): n is a, c, g, or t
  misc_feature (304)..(304): n is a, c, g, or t
  misc_feature (386)..(386): n is a, c, g, or t
  misc_feature (457)..(457): n is a, c, g, or t
  misc_feature (586)..(586): n is a, c, g, or t
antctttgaacccacaaataaaaaataccctccaaaaaaaaaaaaaaaagacagtaagtggaagcctcgtcattgtttaagttanaccagcggggcttgcntnggagaactgcncctgcncagtnctgtncctgtgctcctggccctgggtggcccctactcgtcctctgtggnggatgtaagcatccctttgtngatcagatgaaaccgcagcgtgtggaagaggtggagcggctgaactggngtaaagtnaggaactgcngaatcagtttagcttgggtgaggagcctctgaaaaaactggngaggtatacattgacaaaggtggccatcagaaactggcagtaaaagcgatccatgaggcctccatggcacaggaatggtatnggcaaagtctttgattttaaaggctcgtttgaattcacttgcgaagaatcctccaaaggggccaatgagcnagggaaaggtggagagagcgatgctgtgaatttggaaggggtacatccggaccgttttccagcaaatgactgaatggatcaccccaggaatgttgtactcctgcaggcgaaaaaggtccgagggctcanagtccacagt

SEQ ID NO: 529726 - DNA, 1269 bp, Homo sapiens
  misc_feature (139)..(139): n is a, c, g, or t
ggtttcgattataactagtatggggataaggggtgtacgtgtgccttgtggtaaggaactgggctatgggcattatgtagatcttagtagctgaaaggaccgtataattcagcgtgctcccgactcgataacgggcggnatgccgccactgcgcgtacgtgtggaatagcattagcttgggctgtggtagcagtgtcaaagtgaaatgcaggctcaggagctccgaagtccagtggattagtgttgctggactagtcatgacaatggagtgtagcagaagtactagctagtagatcagagtcaccgggtgtacgcccatttacctgctatgatgatactttgcttgtctacactcgtgaggtactgccgacgtgtgaagggcccccgagtcggagttccattgttgcgtaggaaagctcgagcaaggagtagcatctgcgaaggggagtctcagactcgaagacctaaatgaagagataccgtagttgccgggacgtcaacgccaacggaaagcggacgtggggccaccgacagttcgagagcacaactggtgaatcacgcacgtcgtcaccctgggcccgcgacgggcagcagccagtgacgccgtcgaggggcaactgagccgcgacggccgcccaacagcgacaaagttgccaaagcgccgaacaaaaccagccagctactcacccctgcgtcacccgacctccccgagggcactccccgtacagcacacggtggctcgctgacccgcccaatcagcacaacaaccccacgtgcagctctcgacgctataccattgccgagcccatgctcaggccctcgtgcaacgggcgaaagcgcctctaccacgcacttgaacgcaccgaagctaacttcgactcgcgtgtctgcacaccatgtcacctacctccacttgtacagcacccgaaacctgcctgatgagttccgcacaacgtcaatatctacggcgtacggagcaagagagcggagtaatgacataccttgcgttcacgttgcggaatcagatttcataacattcgcaaggctatgagatagattccagctgaccgaaggacgaatacagtaagttctcataaggcataacacggaagaggtccatgtacatcacaccgcgccaatctataaaggcccacacaacaaacacagcagaaaacaaggagttgttacgcacccccacccaatggaaccataaacaacaccccaaaagagccctcaggccaacagcccactggcagcctagggcaccac

SEQ ID NO: 529727 - DNA, 371 bp, Homo sapiens
gggggggggggggggggcccccaaaattttccctttttaaatttttttggggggaaaaatttcggggggggggggggaaagcccgggggggccaagggaaaaaaaaaaaggggtttttgggggcggggggggggggggggtccgggcccaaaggggttttttggggggggggggagagagggaggggcccccccccctttttcccccccgggcccggccggggtttttttttttttcccctttcccccccccaaaaaaaggtgggggcccggcccttttttttttttttttttttccccgggggggccccccccccccccccctctttttgggggggcccccctcccaattttttttttttaattttttta

SEQ ID NO: 529728 - DNA, 289 bp, Homo sapiens
taagtaccccatctcaattatgcccacaaccccatgagcccaaaaagggataagagaaacctatctttcaggattctcaagatacagagttttcatggagtgataatgaaaggagcagcagccgcattatacgatcatctaatcaatcaaacaccaaaaataattctcaataatgcatcgtcgacactcgaatcaacatcaaaatcatctcagcatatataataaattactaatcacataactacacaataactaatactaataaaacaatcacaccgaccgataataa

SEQ ID NO: 529729 - DNA, 290 bp, Homo sapiens
ccaaaagttttttttcccaacccccaaatttttggtttccccccaaggtttttaaactttttcccggggaaaagcaaaaaactttttttttcccccttccctttttcccaaaaaggggggcccaggggtttccgttggctggtttgccaccttttttggtgaagcctttttttggtaaccccattcccctgttccgttttgttgttaactgccctcccctaaaaggccccgttgaaaaagcttttttaggggggttttttaagggggtttaaattaaagctttaaaatta

SEQ ID NO: 529730 - DNA, 327 bp, Homo sapiens
gagactatgctgcagcaggagacagtgctcaccagagacgcgccacctggtgagagtatgcaaggcacggcgcatccacgtgccatgcacggacatccacccagtccatcgcaatcttccatgcatcggcaacaagacagcagcggcgctctgagcagtcaggccccagggttcagcagcagtagggggttgggacattcggcgtgtgcagctctcggcgtgtgcatgcacacgccgagtgtccatacgaagttgttgcatgtcttggtggacgaagtagttgcagcacacgccgagcacccatacagatcgtagtggacgaagttg

SEQ ID NO: 529731 - DNA, 365 bp, Homo sapiens
  misc_feature (86)..(86): n is a, c, g, or t
  misc_feature (281)..(281): n is a, c, g, or t
gctcagcctctttccctatagtatttacagaataattttaaatttcagtttcacctccactacttcaacgattttaccctgtaaantgctgaaggtctttgtgaactgtcgaccagcaagggcgcaaagtagaggtatctagattacaaacttcaaccaaaagtagtccttgagtaattaaaatgttacttcattatcttctttttgcgggaagattgctcagaagtgcgcattctttacatgccttcacctcgttgagctaaacaggtcaaaagtataanaaactcaacattatttttaacttgcgttattcgtggtgccaaatgagaatagagctgtttttgccactttgggctggatgatta

SEQ ID NO: 529732 - DNA, 421 bp, Homo sapiens
agttcgacggagactctcgaaggcgggtagaaggtagaggaactagttacaggtatttctgaatttcagttgtcatggggatagaaaactggataagatttacaaagagggagtataggtagaaaagtgaaaagttctagctgggtgcggtgacttacccctataatcccagcacttcgagaggccaaggtgggagtatggctggaggccaggagttcaataccagcctgggcaacatggtgaagccctgcctttaagaaaaaatacaaaaaattacctgggtgtggtgcagtgtacctgtagctcagctacccaagaggctgaggcaggaggattgcttgagcctaggagatcaagactgcagtgagccatgattgcagcactacactccagcctgagtgacagagcaacactctgtctc

SEQ ID NO: 529733 - DNA, 365 bp, Homo sapiens
  misc_feature (152)..(152): n is a, c, g, or t
gcacctgctctcataatgacaatatataccgggatgcagtgatatgggttcccacgaaccgcttctgtgtgaactggggaagtccggcctctctgggcctcagtaggctccaggctgcaaggggtggactgtgggatgcatgccctggcaancattgaagttcgatcatgaaaaacaaaaaaaaaaaaaaaaaaaaaaaaaaaaaaaaaaaaaaaaaagggggggcgctaaaattttccccggggggccccatttcgtccccgtttttttaaggggccccctgagcataacagcggggcgtttaaccggggaaactgcgggttcttgaagcacccttttttgggggtgcttttgggcatcctcga

SEQ ID NO: 529734 - DNA, 1166 bp, Homo sapiens
gaaacttgtcaacccaagatccggtcggaattccggggggaactactatactcaaattcgcgcccgcgtcgattagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529735 - DNA, 996 bp, Homo sapiens
  misc_feature (334)..(334): n is a, c, g, or t
  misc_feature (495)..(495): n is a, c, g, or t
  misc_feature (619)..(619): n is a, c, g, or t
  misc_feature (635)..(635): n is a, c, g, or t
ggggttttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttgggagataatacagcaggctgtaccagtgcaggtcctcactttaatcctctatccagaaaaacacggtgggccaaagggatgaagagaggcatgtnggagacttgggcaagtgtgacttgctgacaaagatggtgtggccgatgtgtctattgaagattctgtgatctcactctcaggagaccattgcatcattggccgcacactggtggtccatgaaaaagcagatgacttgggccaaaggtggaaatgacgaacngtacatagacaggaaacgctggaagtcgttgggcttgtggtgtaattgggatcgcccaataaagcattccctgggatgtagtctgagggcccttaactcatctgttatcctgctagctgtaganatgtatcctgataaanctttaacactgtaatcttaaaagtgtaattgtgtgagcttgtgcagagattgctttaaagtacctgtagtgagaaacgtgatttagtgatcacttggagatttgtatgtttattaaagtcagttaaaatgtctgttgcaatgactgttttttggcagagttaaattacgagatgggttttaattgtcagaatttctttgtcagttcaggctgtgaattaaaccctggatgggacttttataggtttaaagattccagtcaaaaaaaaaaacctggggttttttggggggaaaaggttaaaggccttgtatcgtttctgacaggtttgtaaggggatgggcctgggagtataaaacggtgtt

SEQ ID NO: 529736 - DNA, 450 bp, Homo sapiens
tcttacgaggatcccccctggcttgctcaggtctcctggcttgctcttgcttctctagttctttagtgatgttagggtgtcgattttagatctttcctgctttctcttgtaggcatttagtgatataaatttccctctacacactgtttcaaatgtgtcccggagcatctggtacgttatgtctttgttctcattggtttcagagaacatctttatttctgccttcatttcgttatttacccagtagtcattcaggagcaggttgttcagtttccatgtagttctgcaggttctgagcgagtttcctaatcctgtagttctagtttgattgcactgtggtctgagagacagtctgttataatttctgttctttcacatttgctgaggagtgttttacttccaattatgctgtccattttggatttcgtgcaatgtggtgctgagaagacc

SEQ ID NO: 529737 - DNA, 935 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggattgatgtggagaaaacacctttcccttctagttttgagagacttcctcttggctccaggagcagaaggatatacctggactgactgatactacagggccctcgcgacttggggccccaaaagagctagcagaatccggaaacttttcaatcgtcttaaaggaagatgatgtccgccaagattttgtaagaaacccttaaataagaaggtaaaaccttggcaaagccgcaggattcgagcctgtgaacgccaggtgtccatgagacaaaggggggaggatatggccctagaaaaaacagggatcccaaaaaaaaaacaag

SEQ ID NO: 529738 - DNA, 167 bp, Homo sapiens
  misc_feature (141)..(141): n is a, c, g, or t
gattgacaagttcgagtttgtgcgagaagctgaaacgccagaaatatgacatcaccacgctcaggagccgcattgaccaggcccagaagcacagcaagaaggctgggaccccagccaagggcaaagtcggcgggcgctggnagtagagaggccagaaaggcccctcg

SEQ ID NO: 529739 - DNA, 1086 bp, Homo sapiens
ctgtatgtttcaattggccagtttaatgtttagtagctaaaagactggttaatgataccaatgcactcgtaaaaccttcagaaggaaaggagaatgttttgtggaccactttggttttcttcttgttgcgtgctggcacgttttacagcttattacgtttttaacaatcagtactttttaatggacacaacttgaccaataaatttgtcacagacattttgacgacccattaacaaaagcttaaactgacgcaaaaaaaacaaacacacacagcgccgccccccccacaactttccccccaagggcccccaaccctattcgcgcgttataccgcggccctttctctctggtctaccaacgaggtggtccccctaattgcgagtgagctctcgctattatatctcgcgcctatgaggcgtgcccgtgtcccgcgccccgttactaacaaaccggtttcgctcaccgtgggacacaaccggctcctaaaacctcttggcaacatcatcttagcgtagaaaaagaaaaacccccttataccactctccgtgccatgcaacactgcatcaacactatacatctatgcgcccaccaccaacatctacccctaccagaacaacatttttaacaacagactctcatcacacgcgctataacacctcatatttcacaacatccctaacacacaccatcgtatatccacacgccgatgttacacaacaatcaccccagtccatttatccctctctgcccatccctctcaccactattccaccgcacaccccgcaacacattctctccactctctctaacccattcttcactacccaccacgaaccactccccaaaaaaacattcaacatattaatctcctacaacacacaacgttaccttcaattccccataacctaatacgaataaccttctactaccactataaacataaacaatacatattatcataaatagacaactacataacatcttattcaacattactattattcatcaataaataaatcacctcaaatcaccttatcaaaataataaaaaatcatataaacactcgctccatccatctcaaaacac

SEQ ID NO: 529740 - DNA, 667 bp, Homo sapiens
  misc_feature (639)..(639): n is a, c, g, or t
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttggggggaaggggcatatgtcactaatagaatgtctccaaagctggttggtttgggaacccttccttctngttgagggctcctttggttcaggggggg

SEQ ID NO: 529741 - DNA, 333 bp, Homo sapiens
ggggttttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattttagcactcacgaacaggtctgaaatggcggccagtgtcaagacgtgcagacatacaagctccagtctagagcatcccagaggagcacagaaatacggtcacactacgctttccccgtgggtccgcagcaggttgaaaga

SEQ ID NO: 529742 - DNA, 655 bp, Homo sapiens
taatagtagttctggaaccttaggttttatgctatatcatgcatatgagtggatatgtgatcatgattcattttgccagatttacattttgctgtgtgtggaaaagttacgttcacttcaacttacagacccttttgatataatgtacagcaaatgtcatttaaatattgaatgctctattgggggaagacaaatgaagagaatgcatcctgagcatttcaaatcagtagtttggacagtgccttgttggggtccaatctttttggattggattctatgtcatcttgtgatgtgacttttcaatagttcacaaaagtaaaggttggtggtcaacaaaaatagaagcaagtcatagcagttctgtgccttagctggtagtttataactttttgccgtgattctttactggacaatcatagcttacagatggtataactgtattatataatggatattttctttaggtagtagggacaacttgatctgaaagaagatcatcagcttcaagtggcgattgattcagtgcccacaatgtatacagggttgctagttgttactcatgtgcgaatataccttttccttagtgtattctgtcaatataggatcctgtaaatgagacttggttggaatattatttaaaccggatctcttatac

SEQ ID NO: 529743 - DNA, 121 bp, Homo sapiens
tacaaccacattctggaccgcgacgagcggctctggttggaagagcgcattgaggccggccaacccaagccgtcacgggctgagcaaaagtacattttgcagaagctcaacgctgctgagg

SEQ ID NO: 529744 - DNA, 683 bp, Homo sapiens
tacggatgagagaagacgacagaaggggttgaaaaaaaaaaaaaaaaaaaaaataaaaaaaaaaaaaaaaaaaaaaaaatatcaaaaaaaaaaaaataaaaaaaaaaaaaaaaataaaaaaaaaaaaaaaataaaaaaaaaaaaaaaataagaataaattaaaatataaaacataaataaaaattataaaataatatgagctgatttatacacaaaaattacctaattattgaatatataataataataaatgctttatcattatttcaaagtacttatttgaaaatactattgaattactaaacatatttgaaatacttgatgaattcccctttacacaattttttatattttacaaaacgattataattattgtaattttctaaataaataactccatattggtaaagataaattgcataatattcagcattaattatatgttaaacaattatatattaaatacaatttttcatatactataataattttaccctatgttagatactttaccaataatattcaaaaactaaaaatgaatattctaaattaatgatctttatctttatatcatataattcgtaatataaatttttataaaacatcatttaattctaaacataatgttcccaaataccattatatctgtataagtgacacaaatattaatcaatatatatatt

SEQ ID NO: 529745 - DNA, 677 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgttttcgggggaggggaatttccctataaactgttcccaactggattattggggaaaaaccttcccttagtttggggctctcttggcccgggggggtcccatttgcaaatgc

SEQ ID NO: 529746 - DNA, 179 bp, Homo sapiens
cccaatttgtttttgcccgtttttttccccccaactggggtttggccaggatttttccgtgtggggggtaaatgggaccctttcccccccccccttcctttaaagggtggtgttttgtgggggggaaggtcagggctccttaccaccaataaaggccccggaaaaggccttgggtgtta

SEQ ID NO: 529747 - DNA, 814 bp, Homo sapiens
gcgctataaaaacttttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttgttttgtttggttctttatggaaagccccctttgcttgttttgtggtgtgtaatgccgtttgtcctttagttgttatgagcctttctcgctgtttttctgatgtgtactactctctttttttcccttaattccacccttttgtttttcttttcttcttacttccaacaaatattttcgtctcgtgttttgttttttctcttcattttattattcagctttttcttccctttgtcctggttctttcttaatctgtcgacccctcacaattgacaacaaacttctgatttctt

SEQ ID NO: 529748 - DNA, 705 bp, Homo sapiens
aaacttcaaccgagggcagtctacggattagatcatcctttcatgactcggaatcatgtgaggacgctacatgcatgctcctattcgtacatactcatagaatgctacagtaagaatgaagtgcaaaagttacatccgggaacaagtgagacagatgatgctagagacagaagcgtaaaaggatggaactcctgactgcatagatacagagcgggacattagaagatagcaagagccgtcaagcattcactaggacgtacacaccaagcgaaaacagtagagacataggtaagtgcaaaccccacatatgaataaacgaactgaacaaatgctgtagtcacccaagaattgagctatgaaagcgtagagaagcccctaaggattccccaagaaagtttaaccagtggaggacctagacgaaatacgttggattggcaacactggagataattagacaaagctcgaacatacgtgccgtttggacccgtggattcaccaacagatgaggacaatcacggattatcagtgcaagacaattgtatgtactcgatagcctggacatagtagacacctagcccagatgaagacagaacttcagagtatgaacaaaaacgagagtaagaatgtaccaacaagactaaaggagcaccaacttctacatcacatcgtcaaatgaggacgttcccccaaaaatactagctacaa

SEQ ID NO: 529749 - DNA, 182 bp, Homo sapiens
aagcttcatagtggggtatctaatcccagttcgggtcttatctattgtgtgttcagatatgtttaagccactttcgtagtcaattttgttgtcacactggagtttatttacaactccatgtgagttaaagctttattgtgggagggggtgatctataacactctttacgccggcttctattg

SEQ ID NO: 529750 - DNA, 1142 bp, Homo sapiens
cactacccttcccactcttcccttcactttctgcggcagaagagttatttccccgtggccgtcaccaaccacacgtccatggggagtactgctaggctgttgctgatgaactcccaagggttcttcagtcagcttgtgataaatgctgcctggcctgggactcacccttcagggcagtggggttccctctggcccaaggcacatctagaaatgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaacaacaaaaaaaaaaaaaaaaaaaaaaaaaaaaaaaaaaaaaaaaaaaaaaaaaaaaaaaaaaaaaaaaaaaaaaaaaaaaaaaaaaaaactttttcgcccccctagacaaattaaattttagtttgggctaatttaaaaaataagcaaaaaatgaaaataaatttgccaaatcgccctaaaatgaaggcaatataaaataaacggcctttgttaaaaaaacttgaaaaaagaaaaacccttgagttacccaaaataaatgggaataacaaatcccccttttgaaaaatagggaaaaaaaaaaaaagacctgaacaattggccataacaaaaaagaaccaaacccgaatgggtaaatgaaaaatgaagccgtaaatctttgcaaaaaaacacctaaaaatttttgtataattgccccaaattcgttttggtgtaaacacatttggaaaaaaaggcccatttttaaaaacctgggctcaaacacccaaaaggtaaaaaaccttttaaaaagcggaaggcccaataaaaaccatacccatattaatttttttgaggacaagggcccaaaggaattaaatgggacccaaaagggacccaccattaaaatttcaccgaaaaacccctaattggggg

SEQ ID NO: 529751 - DNA, 167 bp, Homo sapiens
tagaggatcgcaagggctgttcgcgtgctcggaggggtgtcgctgccatctgcggacatactaaacagatctgtgctgcagccgcgtaggaaggcctggggcggggctgcagctctgcccacccttcggctcagagggtttccggtgagatctgcccggcgtggtcc

SEQ ID NO: 529752 - DNA, 215 bp, Homo sapiens
agcgagcacaaagattccagagacaggctgtacaaggtccctgaaccaggctgtacaaggtccctgagccaggttgtacaaggatccctgagccaggatgtaccaaggtcccatgagccaggatgcatcacagttcctgagcaaggatacaccaaagttcctgtgccaggctaaacaaaggtaccagagccatgtacttcaacggtcactccagg

SEQ ID NO: 529753 - DNA, 403 bp, Homo sapiens
tcgtgctgacagcgctccaaacacgcgcattcgcatggttgacctttggaatcgtccccagggcactgtagccaggattcacatcggccacattatcattgtccatccgcaccaatgctgtagcaacataggatcatgttattcatgactcatgtgcacggctgtgtacacgtttcctggtcgccagaagatccacatctcaaaccaagtgtggccttcaccaagtccaatgactcatcaactatgaagacaattctgcctgaatcgacgctgtcatccctgatggctgtggggtcaactacatcccccgtcgtcattattaggacagttcgtggcgccctgcactcatgagggcttccaatgtgctgcccccctcttaatactcaccaataaattctacttc

SEQ ID NO: 529754 - DNA, 473 bp, Homo sapiens
gcgctataaaaacttttataaaccccccggagcccgagcagtgtgaagaagaggcgagaacgacccccggaccgaccaaagcccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttt

SEQ ID NO: 529755 - DNA, 155 bp, Homo sapiens
ccttgtctcttaaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatac

SEQ ID NO: 529756 - DNA, 1041 bp, Homo sapiens
  misc_feature (8)..(8): n is a, c, g, or t
  misc_feature (59)..(59): n is a, c, g, or t
  misc_feature (104)..(104): n is a, c, g, or t
  misc_feature (109)..(109): n is a, c, g, or t
  misc_feature (114)..(114): n is a, c, g, or t
  misc_feature (179)..(179): n is a, c, g, or t
  misc_feature (1041)..(1041): n is a, c, g, or t
aaaggcancccccccgctaacactaagccctcccggcccccgatgtgtgtggaaatgtnaaccggataaacaattcccaccacaggaaaacagccatgaccccngattnacccnccaagccccgaaaataaaccccctcacctaaagggaaacaaaaaagctggaagcctccccacccnggtggcggcccgctcctagaacctaggggatcccccccgggctgccaggaattccggcacgagggatcctccagataaattcctgctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctgaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529757 - DNA, 482 bp, Homo sapiens
aggtagtcattgaaatgactttttttcttgagacggagtgtcactcaaccatgctgaagtgcagtggcgctaccttggctcgcggcaacctccacctcccggattcaagcgattcttgtgcctcggcctcccaagtggctgggattgcaggtgcctgctgccatgcctggctgatttttgtctttttggtggagatgggatttcactatgttggcccatctggtcttgaactcctgacctcgggtggatcatttgaggtcgggttttgaggctagcctggccaacatggtgaaaccccgactctgctagaaatgcacaaattagctgggcgtggtggtgggcgcctgtgatcccagctgcttgggaggctgaggcaggggaatcgcttgaggccgggaggtggaggttgcagtgagccgaggtcgcgccattgtactccagcctgggcaacagagggagactccttttgggggtgagaaaag

SEQ ID NO: 529758 - DNA, 698 bp, Homo sapiens
  misc_feature (698)..(698): n is a, c, g, or t
aaactgtatccagctttattaaagatactttccataaacaatcatggtatttcaggcaggacatgggcagacaatcgttaacagtatacaacaactttcaaactcccttcttcaatggactacctgaaataccatgattgtttatggaaagtatctttaataaagctggatacagtttggcttggaaaaaaaaaaaacaacaaaaaaaaaaaaaaaaaaaaaaaaagggggggggggaaaaaaaatcccccgagggggccaaatttacggttcccgggtttgctgtacaagggggccctagagagagggcaaatataacacagcaaaaggcgcggatataaacgggcggaggcggaaaagtggagcggagacctcggagaggaccctactcgggcgggggacatgtgggacctaccaagaaattaaggccaaggggaaacttacccgctcaagagggataccgcggtgaacccacggagagatcggtgggggcagacattgggccggggtgttattaagaatacaggcgaggtgtatattataataaaagagggggagatggttgagagatgaaggagagagcatcagaacagggagagagaagaataaagtcaaaaagggacgaggggaagaagaagagaaatgagaaaaaaagacagaataagacagtaaagagatgaagagtaaaacatatgtan

SEQ ID NO: 529759 - DNA, 190 bp, Homo sapiens
  misc_feature (43)..(43): n is a, c, g, or t
  misc_feature (73)..(73): n is a, c, g, or t
  misc_feature (114)..(114): n is a, c, g, or t
ctctctaaggctggagaagggagaccaggatggtacttgaacntcccagggatgctgtcccatcccttccttnctcactcctactctttgaccctgatggccaaagcagagacnaggcctaaaggtaaaaacgttctctctgtattctctggcttttactccctaagttgtctctcgctataagtccttt

SEQ ID NO: 529760 - DNA, 1230 bp, Homo sapiens
  misc_feature (232)..(232): n is a, c, g, or t
gatcgacctactccttcggagctcttcgaggaccccatgcctgacgctgaccttgaggcgagtacggcagaaccgtcgtgcctcttctcagttcgccggagacctcgccagtcgtgaggatcaaaccacgctagtctgatgccatctgacataggtatcgacacgtgaccgggcatgaggagtacctgcgtagaccgccgtcgaagagttgcctctgtgtgtagccttgagnatgagtacgctatcttgagtcatttcatgggcacttttcgtagttgcgaaggtgggtgggctgagcgtttcctagtgcaggcgtgtagcggcttgttggcggcaagctggtcacttttcgagaccgattgctcgagggagtgaggcggctacccggattcagctacgaaacggcccgtttgtcccaaagccaagccaagcgctgataccgagtctcatctcacgcctcagtcttgacccgcttgggacccggtacgatggggaccttacgtgcgtttactaggttctgcaacagacgttggacgtagatgctcggagggggcaccttgcggcgggacgcattcgcaatttcgatgggggtcgttcccataagcgtgttcggcaacccaaaggacccccccgtgcaaaacgcggtaccgcgtgaaccaggtgtccatttggcgcgccacaggggaaccccaagtcttttataagaccgtaaggagtgggctcgtggtgaacaggtggggaaattgtcggaaaacctattttggcgcacgcctttcgagaatcactttggccattccgtttccggttcccaatttgtgggccatttgatcgattgtggcggctccgaaagagacaacatcatgttttcaacctatccgacgaagtttccccttgttgtggatcacagagggctccgaaccggcgcgaaaacggcaaacgagaggggcgccccaggtttggccgcacaggttgccctccacactgggcacaatctttaggatttgggcccacagaggcttatcgttggggtcaggcacctgcttcggggcaacgggagttcccccagatcctgctgctttgtgggccccaacgtttgattccctttgggtggccgtgtttcctttcgctttgccgtgtccgtttgctcgtttggcgtgcggaggctgggaaacccgatttcctaaatttcatctacccccgtttttccccatttccaagtatcccgcgccg

SEQ ID NO: 529761 - DNA, 196 bp, Homo sapiens
ttgcgtgcggatgcgctggtcacgctgtaatcccaccactttgggaggccgaggcgggcagatcacgaggtcaggagttcgaaaccagcctgaccaatatggtgaaaccctgtctctactaaaaatacaaaaattagctgggcatggtggtgtaataccaacatactcaggaagctgaggcagtagaattgcttga

SEQ ID NO: 529762 - DNA, 894 bp, Homo sapiens
tcatcggtgtgttggctcttgccgcattaacactgtcgagtgcgagagaaggcacgctgacgtcataatacagtgtgtgttgtacagtgataccaggataaaatcacgcgcgtggatcccggcaggagcgtgaatctactactcggatacttactaaaattcgacgcgctgagacataggcacgacagaccgacaacaattcgccttgagataatagggtagtggtggcggtagctctgagtataggagagcggcggaatacgcaatacagagatctgccctaggtgacaatggacactacgattctgaacatgccttgacgccagatgacattgtggaggaaattcaacctaatctggacgtacatacataccgtcctgttgctagccgatttgaaagaggtacctacaggaacgtagcgtgaatctggatctccatggattgaggagattccacagaggacgaaacttcagattcgaacaattagcaaacaacggtcccttaatcttcgaccggagagttggtcaatcggtccacgaagctttagcaattcgcaggtcctaggccaacttggatggcgcaaggcgacaggtctggagcggtggttgggacaatgtaccactcacgaataggcactagagttgccttttacacgcggaatcgagaaccttgaagtgccatgtgaaccacttcaccagaaatgtgggagctggtagccccacgggtaatccaagagccagagtaaccagaagccatcgtgggcgggcgtgggtgtgacacagccaactgcgtcacgagagttgatatcaggccgctgagccacagggacgaccactcgcacagatggccttaatccggcgctagacaccccccacggcccttctatcatggggc

SEQ ID NO: 529763 - DNA, 118 bp, Homo sapiens
aggatcccccgtacaatacccgcaagcatgcccatggtcagaggggcgcctggcgctgtagcagtgatcctcccgcactatcactgtgcgtcactgccaggacctgcgtagtggctgg

SEQ ID NO: 529764 - DNA, 144 bp, Homo sapiens
gcggtccgcattgctcaacgtcagggaagtaccccggcgaagtacaaccttaagcccaatctttgcaattcgatcccgccaagggtggaaacactgggaattggcggacgcctttgacgccacacttgccttctttaggatttg

SEQ ID NO: 529765 - DNA, 1301 bp, Homo sapiens
  misc_feature (588)..(588): n is a, c, g, or t
ttttgtggtttatttagttttaatttccatattcctataaatcttaatctctctgacaacccactctaggcttgggagggaacaaggaaaacttgtgaacacccaagagggaacctgtgcagcgaaaacccacaaagaattctctatagcgaatatacgtgcgaaccaaatgtggggtgtggaggggtgtgcctctctccttaagcttacagaaaggaattgactcgtgggtggttataaaaataaacacacagagtctcacaacttttattcgaagttttgtctcccacgagttcgagcagagtggtgtgaatcttttgtgtggcgtggtctcttgtgccatctccgtggacacccaaagaggcgcctccaagtgggcctctcccaaaatattctctcatgtgcgctatctcttatcatcacctgtgtgtgcacaaaaaacacccccaacagtgtgtctgtgtgcgccaatctcacacaaccaacctctcaggtctctgtgtgacgcacggtgtcgcgaaaattgtaaaaaacaccgtgtggggagacacccccactctgtgtgtcgtgtgtgtgggtgtcccccangcttattttttgcgcgcctagtgtgcggcaaccaatatatttcgcccagaggagaccccccctgtatattgcgctctatagagcgattcgagacaatgtgctcctccactatttctttcccaaatattttttccctcccccccctatataaagattgtcgggctctttttggcgcccccgctggtgttgcgcgccattatatgtaggagcgtgttgtgttgtaagagtctctcacacacgccctgtgataacaactattttataaaccgccgcgtgggggaaatataacatctctccgtggtgtggacaacacgcgcgagagaaaccccccttttttatttttacccgcaaaaattttctcctttttatcttcccctccccaaggggtggctcctacaaagaaaagccgaggggaaaaacaattttttccgtcgtgcgagttgacctcttctggttggggacaccccctttgtcgttcttgctgccaaaaacgacagcctcttcaaagaggagaaagaaactgcgcgcggccccacaaggggggctcttccccccgagtctcgacgggggccaaattgtttctccgaaaacaaccacccggggtgggtggtgcgcgttgtctccccccccatggcggactacaataatttgtcaccccagggcgagcacaatggtttcctaacaaaaatgcaggggaacgaggagcgccctca

SEQ ID NO: 529766 - DNA, 488 bp, Homo sapiens
tggtatgcacaagagtgaacgtcgtctcacaaaaaagtccgggcgtgatggctcacaccggtaatcccagcacttggggaggccagacggggggatcacgaggtcaggagttcaagaccagccgggcctagatggtgaaacccggtctctactaaaaatacaaatattagctgggcatgggggcatgcacctgtaatctcaactactcagaggtctggatgcaggagaatggcggaaacccaggagggagaggttacatggagccgagattggcaccacggcactctagccggggcgacagagcaagactccatctcgaaagaaagaaagagaagggaaattccccagggaagtacctgggctgatttcataaacaggtaccgaaggaagcagaggcttgtggaggacttccccagctcatgcagctattggggccggggcgtctgaaattcataatttcagagtcacccctttgatgaccttagcag

SEQ ID NO: 529767 - DNA, 1112 bp, Homo sapiens
  misc_feature (1112)..(1112): n is a, c, g, or t
gagcgggctggtggctgcgtggcagctctgcgtcctgaagctgctccgacgccgtcgctggtgaccaagatggacctccctggctgctgctcccctgtcccctgactgctgctgctggagtggcaacatggctggctgtgcccctgtgccctgctcctgcctgatgccccagctgcctgctctgtgctgcgatgcccctgctgctgcctgctgccgtgcttacattggtgctggtggccctgaagattgtgcggtggcccgtgggctgcgtgccctggtggagtgcctccgggctcacagcccgcctgccctgcctgatgtgactgacagctgacgggcgactcttttcttgtgttgctttgcttgggagaggttgccctgcactgtgcgggctgcttgcctgcctgatggcttgtctggatcagcagggaaggtgcactggagcccgttgtgcttcaccctgattgtttcaaatcccgttgggcatgaagccctggacaccctgaatgccctggtggccccacacttctttgaactcagagcccatgacctggaagccccatggtgaccacttagggcagtttagaacaacccctagtgagcatgtggtactgccacaggtataaacccaattccaaggcacgcgcaccaaaggagaccactgtggctttgggtttggcagcttccttcatagaaccctggcggggacgattccttacagacaggcactggacaatagggagacccaggaaccagaggagcaaccagcaaaagaccagcccgggtgccagaccaggacacatgcaatcaccaccgcgacggaagacaggcaccccaagatggccacatcacagggacccccccaaagcaaagcgcccccaagggcctaacccaggcgaatagccaccaagaaggcccaggccaagatatggaacgcgggcatacgagacccttaaaccgaaccacaaacgaaaacggccagccaagagctatacaacagagggatgccagacccacagcgaaccaaaccgagccacagccggcccggagcagtaggacacagaggcaacacgacacgaaggccaacatctcgacatcctaagccccccacn

SEQ ID NO: 529768 - DNA, 368 bp, Homo sapiens
  misc_feature (274)..(274): n is a, c, g, or t
  misc_feature (279)..(279): n is a, c, g, or t
  misc_feature (315)..(315): n is a, c, g, or t
agagaaatttgaaccctcatacactgcttatgaggataaattatatctcagtaagatggagctgctttggaaagcaatctggcagttcctcaaaaagttaaatatagagttaccatatgacccaacagttccacttctaggtacatacccaagacagagaataacatacatccacacaaaaacttgttaatgaatgttcataggcagcattacttataatagccaaaaagtgggaaataatccaaatattccatgcaatttgtggaatggaatnacatnaaaatgtgtttacatagtgggaaaattttttttccnatggaaaaggaaggtggaactagttacaagctaccaaccttggacctttaaaa

SEQ ID NO: 529769 - DNA, 140 bp, Homo sapiens
  misc_feature (7)..(7): n is a, c, g, or t
agctgcntccccttttaagtcaggcaagtcaagctaaaaatctcggaggtgctggcagcctggtggtgctgtaaaacatgagagccagattcctagatgctgaggcagatgcaggtagagtccccaagaaatactagaag

SEQ ID NO: 529770 - DNA, 803 bp, Homo sapiens
ttctggcgaaggagagaccctgcacactcagaggccccaagaagcacttaaagcgtgcagagaggtcgaagcctagcctgcttcgcaaaataacggccggatctggacctaccccatgcacaggtccatacaacctgagggaatgactctctatgatgcgctttctcaggattaagctcaagtgtgcggcgactggagatgacgactggaacatattgatgcaaggctacatcaaaatcgatggcgacgctagagtgaatgtcacataccctgttctatccatgtgtgtcatgaggatggagaatacaggggatcattaccccctgacctatcacacccaagaccagctctagaaggcacacaatcacaaccctggaggtccagtacaagttgggctaaggcagggagactactgggggagtgaaggaaattccacacccgtggacttatgacgctcgaaccatccaatacccataaccggaccttgagcgcgaaccataggggcacacattggtttaccgatctggccatactatccactgttatgcaaattggatgcagaccatttacatgtttgcgaaagcggaggaaccaacctttattcggagaaacctgttatcactcacaaggtaaagacttcgctggtcttttgaatggaggtccttgtaaaagaatgcccgtgcggaccaggtccaccctaaggtttacaaaaaatatggtattggagggggcgaaatacgtggaatttgcgcaatggggaaaaggggtgcccttatcgtttcttagaaggattagcggccccc

SEQ ID NO: 529771 - DNA, 515 bp, Homo sapiens
gggggaataaaattttcctgcctatggaaagggggattcagtattattttaggaaagccttggccgacacctggaaagcatcttttttggaaatttctgctaaagaaaaataaactggtggggatgcctttcgaaggattactttggaggcagaaaaaatggacggggccgcttacaagggcaaggctttatgcttggtgatgcgattctgctggaaaacctgaagaccctgcgaatatattctacgctggagaagcaaactgcccgtctccttgataaaaaactatgctccctttttcttctgctaccccggaagatatcattttgggcagagctccccctcctttaaaatatggtaactttgagtctgggcaaaagaaggtcactttccattttaaaattttaagccactcttattttcaactcatacattgcctttctctaatttattgaccaagaatactatcggcgttaaacattccactgtaactggtgcttaaaataatgcgaacatc

SEQ ID NO: 529772 - DNA, 807 bp, Homo sapiens
  misc_feature (305)..(305): n is a, c, g, or t
tggatctatccattaatttaactttctaaggaatggataaaaatataaaggtacatatccctaaaaaggggctatcctacatatgacagcccaaaattatactacctccatagggttcccgggatattctcaagccacacattttaaaaccaattacagaagaaggcacatcacattttagtgagttatagttgcaaataagggcgacactacaatacacacactcatatttctttataagttatagctcgagtttataacaaactctctcccctttcacaaacaattctcaaaactagtgtctnccaagctctccacaccatttataagagaagaggcacagtgtcacagatgtgggtggggttgtgtggcccatatattctctttattttatccacctttataaaggagggctcacacacagtgacaacacagagtggaggaaagtgtaaggctctatgtgggtaacacacgacaattaaatatcaccctgtggtgcagtgtgtttgagaatctcattgtgggcgcccttattaaagacaatatgtggggcttacaacacccagagagtataaaacacccgccgagcccgatataaacgtgagtatgagggtaataacacacgtgcccaagaggtataatacaccgcccccaagagggggcgtggcgaaaccaataaacaataagaagactccggaggcctaatagggggcgcgtgacaaagaacaaagaggggacccacacccagcgagtggcgacggggcgtaacaaaaacaagtggtgttccccactcaaaagataagccca

SEQ ID NO: 529773 - DNA, 153 bp, Homo sapiens
tcaccacagatccctaactacctaccccctgaaggcaggtacaatgacatcaccaaggtgtacacacaagtggagtttaagagatagacctgccggctgctatccttcacctgctgcccttgagagtaggaatcaacagggctcaagtctgct

SEQ ID NO: 529774 - DNA, 166 bp, Homo sapiens
ctacaggatctgctatacacccctcccaaagtgtaacggaggatcgaaggtacgctgtgtacggtcggacatcgtgctaatagtgcaatggcattagcgtgcttaactgcgagactgacaagacgagcaggtacgaaagtaggacatagtgatccggtggtatcag

SEQ ID NO: 529775 - DNA, 230 bp, Homo sapiens
ctctgaaaggaatttgtttatttcatgcaagtctagccatgataggtgtttagagaaaagttcttcgtcatcttctcagccttaacacagttccatgttgggctctacttcagcttctctcctcactctattaaagagaaccccccctctgtgtactcatataagagcacatatgatgagaaatatattttcgcgtatgagaagagaaaagtgtgggattcacaccccat

SEQ ID NO: 529776 - DNA, 1316 bp, Homo sapiens
gaaactgagtgagccctggagctgccgctgtgtggatcgtgggacctggtgggcacccgtggggagccgctgcccggagctgaccgccctttgtacagtgccagcctcccattcccggtcctggggaggaaacgagagagggggatgtgaacagctgtggaacgtcggagctctcgggagccggagcgggcacaggcgaggccggagcatgaacgagaaggagatgtgaaaggcaagagcagaaagagggagcgacacgagagacaacacaacggtagaaaagcagcgcaaaaaaacagaaagacaagcgcgagactgagaagagaacgagagaaaaaacgagcagacactagtgcacaaggacgcccaccaagacacggagacaaaaatcacgcgacacgaggagaagcagagaaaagagaagagcgagaaaagaaggagacagaaggcgcaaagacacaggcaacagaggaaggaacaaagaaagagcagaaggaaagacgaaagcccagagcagagaagagaagagcggcaaaccacagagaaagaacaagcagaaaagagaaagagcgagccaggacagcgaacagaacaagaagaagagggcgagacgcacaagcaacaaaggaaaaagaagaacgaaacagcaggacaggcccacgagaaagaaaggggcgcgaagagaggagaagagagagagagagacgcaacaggacagcaaagcacagaaacaacaacggagcgaaaagaagaaaagcaacacaagaagaacacagaagagacaagaaaaaagcagagacggcagaaggcgaaagcaaaacacaaaaaaaaggacaaaacagagacaagcagaacgaaaacgggacaagtggcagagcaagacgcggcagaggcacggcgagagagaaaaaagaagaaaagcagaaacaaaaagaagaaacggaaataagaccggaagccaggaagaagaaagaacgcgaaagcagagagcgaaaaaaagagagaaaagaggacaaaccgagggccaaacagagagaaaaagaagacaaaacgcgaagcaaagggacaaaaacggaacaaacagcaagaggacgggaacgaaaacagcgagacggccacaaacggcgcagggaaaaggagaagaggcaccacagcgaccaaagaagacaaggaggggggagcaggcggcgcaccgcgaagaacacggcgagagaaaggcggacaggaggggaaaaaacgaaaagagagacaagaaagcagcgaccgacaacagggacacggagacgcgccaggagagaacgccgcagcggcgagag

SEQ ID NO: 529777 - DNA, 1142 bp, Homo sapiens
  misc_feature (124)..(124): n is a, c, g, or t
  misc_feature (134)..(134): n is a, c, g, or t
  misc_feature (1141)..(1141): n is a, c, g, or t
ggtttcttcagcgtcttctggcatgtgtgtggacccgtctgttcctctgcattcttggaggacctggagcggactgacggctcggccgagaggccttacttcatgtcttccaccctcaagaaantcttgaacangaccaacaaggaaggcagcggaggtccgtgacagggccgccagtgctctcccacgcgtctcaacggaggtcgtccagtgctcgcatggggttgcgtccatgtacgctcgggctcgttgttcgcgcgcctagacctccgttgaggctcacctgaagtcctatcacgtgccgctctgcacccgtccccatgtagccagatcccaacagtttctggacgtggagagatctggggcatctccttcttatgccaaggggcgctgtggagtgttcatggctgcccatccagactgcgagaaacaagtaaaaacccattggggcctcttgatgtctgggatggcagcgtgagccgacctccacaagctccctcatgcttcctgtcccccgcttacacgaaaacgggccagagcacaggaaggacggtgtaagtgtctgagggagctgctggccacagtgaacaccacacagtatattcctgcctgctccggacaggactgaaccccttctccacacctgaacagttggctcaagggccaacagaagcatttctttattattattattttataaactggacatgcattaagggtctatgagcttactatccgtctgtctcaacgagtgagatggggccgcaaaggagtgccttcctttatggtccatcatactgggattgaagcgtgagaattgagtgtggccaggagggggaagaaacatggatgggaaggaaggaaaggagcgaaaaatgagagatagacaaagaaacagttgaaagagatggcaaagacggacgggcacatggggaacaagaaaaaggcaggaacacccaacacggaagaaaagaaaaggaacatgaaacaagaacaaaaccaaagaaaaaagagaacaggaggcacaacagaacaggcacacacaacaaaaaaagaaaaaacaggagagacagcacacaaaaccacaaacaacacaagaaaacaaacaaaaaaacaagacaacacaaaacaacaacctagng

SEQ ID NO: 529778 - DNA, 102 bp, Homo sapiens
acggatagcggatctgcgcatgagcgtggaggccgacatcaacggcctgcgcagggtgctggatgagctgaccctggccaggaccgctgctggaaatgctga

SEQ ID NO: 529779 - DNA, 462 bp, Homo sapiens
gtgattagaggacgcttagaatcgacggtttctcctgttacatagatgatttggtatttcagtgatggttatggtttttgactcacctgtgtgtcagtcctgctagagagacagtatagaatcaagaatttcttgatgtctttttaaaaatagagattataatggccttgctagttgtcctgtgaagtgaacttacatggctggatcatcgaatgtgacagacccttaattagaaatcttttaatcctgctttccattttacttctccaccatttatttttaacattcattctctgaaaatagttatgattttcagtgtaatcggctatgtttaagaaattccatttcaaagtcttaatatgtaacaatcttcatttcttataaacttgaaggacatttttgaggcaaacttacttttatagctcattttctccctagttaaggagaattctctggttccat

SEQ ID NO: 529780 - DNA, 275 bp, Homo sapiens
tcgcggctaacgctttactctctgtgggcttaagtatgtgctgctgcacatgtggaacaattcccaggagctggctacccgtcgcgtatgctgggttcaggctggcctcagccatgcccacccctgtactgaccacattacggcgaactgtaccggtggtgtagttgccccacggctccctctcacgcccttgcggacacgactttgttcccacgtacgaccacgacgaccacgggtttgccacgcagggacgacctttggcgacggggactcct

SEQ ID NO: 529781 - DNA, 1485 bp, Homo sapiens
  misc_feature (1211)..(1211): n is a, c, g, or t
ttctaaattatatcgtcccgccccccaaaaaagagattgtgtttaatagtgtgtaaattgagaggcccctgtagtgtttcaaaagttcccccccagacagccgacgcgtgtgtttcgttaaaaatgctgttatggttttaaagaagaaatttttggggaaacgaccacacaagagtggatgaaaggtggaattttctgtaaggcgccccaccccacattttggtgaaattttgtgggtgtttaatttgataataggcccactagaggggaaaatttggtggtgtcccgacaccccagccctcacgctgataggggagaatatattttaatattgatagaagagtatatattgcctcttctgtaacatgggggcagaaagttggtctcaatgataatgttttggccgcttcaacgggcgtaggataaagaagaggccctgcaatcgtgttctccgacgtgttatattcgtcgccgccttcttcgtggtggaagaaaggttcccaacggcgacaaaacgggtttttacaatcataactaaggcgggggcttaatgagaattttattggaagcagggctgaataatgtcgtcgcaaaaggtgtaatattatagattgcccccccagcggtgtgtctttgttggagagcaccctcttattattgtgattaacaacaacacataaaattggggtggtgtataaaggatagggcagcacccatcgtagtataataacactactggtggagagtgttatataatagagattatctccgcccacggagatatggagtacagcacaccgtgtaggtgtttatatctcttctttggggtatacgaaaggaagactataatttggagcgtggaattatctctgtgaaactctgtgtgtttgacactctttgtgtgtatattgccactctctctcttggtggtgttgtttgagtagtgtatatgtctcgaaaatatgcgcgtgaattgagattttataaggagcacgcgcttttttgtaaaaaaaagagaaaaggtgtcttgtggagaatgagacgccccacagttgagattgagattgggagagaacacacatcatactcgagaatggagaagagaaatatattttatagagattataaaaaatgagagagtatagagtttgagaggtgtgtctctgtctctctctgagataatgagatatagagatatataatgggtgaanagagtataaggcgcttatattgttgagaggagatctcacggtgagggtgataataataatcgccacagtatcttaccacactgtgttctggcacacactgagtgaattaaattaaaagaaattcgaggcaccccctaattaccctcagagaagccacgggttgttaactgttttctggttgaactctttgttgttgctcggggccttctgccctgttttagtgtccctttaatcaaataatagtaaccataaaggttacccctttattaagtga

SEQ ID NO: 529782 - DNA, 143 bp, Homo sapiens
gatgaatgtcatctcctggcaagacgctcaggtagttcttttggtttaaatggcagatattgaaaactggaattttttgtttatgagtctcgatctgtcacccagactggagtgaagaggaggaatctcggttcactgcaacc

SEQ ID NO: 529783 - DNA, 270 bp, Homo sapiens
  misc_feature (130)..(130): n is a, c, g, or t
  misc_feature (149)..(149): n is a, c, g, or t
  misc_feature (262)..(262): n is a, c, g, or t
aaagcgtagtatctggaccggagtgcacccccactcacggcatggtccctcatggcttcccttggctatgggagggagttccccaaccccttgcacttcccaggtgaggcaatgccccaccctgcttctncttgccctccgtgggctgnacccactgtctaaccagtcccagtgagatgaaccgagtacctcagttggaaatgcagaaatcacccactttctgtgttggtcttgctgggagctgcagacagctgttcctatngcgcatct

SEQ ID NO: 529784 - DNA, 272 bp, Homo sapiens
ccctgctgtgaggaggaaagctggcaggaaggtcacgagtagaccattgacgaacgctcccgcgaccgcccgcgtcgtccgccagttgcatttccgtagaccccggcaacccttcccactactccttggtgctgaagaatggcaccgaggctctcctggtccacgaaccgctgttctcctctgctgacggcagccgcgccttccacgtcgatcacccggacctcttcgggtgtccatctatgatcccctcatcatctggctgaagccggaca

SEQ ID NO: 529785 - DNA, 866 bp, Homo sapiens
  misc_feature (627)..(627): n is a, c, g, or t
  misc_feature (706)..(706): n is a, c, g, or t
  misc_feature (713)..(713): n is a, c, g, or t
gagggcacattcatggcgcggacgcgggcacgcttccccttttattttgcacaacggctctactgacaagcacacctgtgtgtgcgtctattaccctatcgtggaagcggcatccttcaagtacacgcaactattgatacagaggcccaaagccgagaggggatgccacgaagtctcttatcctgcggctctcggatagtgaggagcagggtcggcagatatcacctgtgggcactcaattattcgaagcttggatcactacactcgttgacaaattggggactcgggtatacaagttcctgcacaacacgattatatggaaagaaatgcccccatgtctagaagacacccaagggacgcgttgcatcttaccggtcaattatccgcgaaagcaatcgaacctgtcaagaacacaaattaatagtatcgcgaaggcagtcgcaccaccatagcttatgccgggtgctctctcccactgacaacaactaagctccccacaggtacaaaagggaatttcccctattcctacgcgttctcatgttgcggccactgagccctatgaatgcttatttcacgggggaaaagaatgtcacagttggatcactaatttttatgagcaacactctnctccttgttggcttccgctctcgagcccaaaggcggagtcctagaacttccgcgccaaggtttattgcaatcgcgtcanacctatntattacagcatctacttggagcccaatttcggtccctatgagcggggccgtcattaaccatttgcagacggaccggtctgtttataacaaaggtttcgcgcaactggataaatacctctctggggtgtcgctccacattaagattagccgtcg

SEQ ID NO: 529786 - DNA, 907 bp, Homo sapiens
  misc_feature (737)..(737): n is a, c, g, or t
gggtctggggtgtgagaggttcgctcgctctacggagattcttcaagcgatcactagtgtcaactagacacaggatgtctcccgttccattcatactcgaggacagatcgaaggagagtcaggaacttcacttcgaaacacatgcatacaagagcgcaggcacttcgatacccgttgtgtccctagtcgggtgtatgcaggcagatggtggccctatggattatatcatatctgaagatgcaaggggaaatactaacaatgtccatttcattcatgaatccatcattgcgtgtgtggcatgcccaaaggcttcgattgtctgagcaagtgaactagcttggttatgagcgctagtgtccatgtactcgggaacttctggtgcatgagatccttaacgcctctaggaaggaaacgaagagttgcctgtcttgcgtcctcgctcggagcgagctatgctctgtagttaagactgctcgttacttacttacagctttaaccgtattactggatctgcgaataactacacactaaaatattagctagtgcggactactactgaccgtgctaaccactgtgcaatgtctccgcagtacttgggcttgcccttttggcttgaacaggcctttgaattttgactttgtgtgcaccggaattttacttgaggtgcacctaagttttagcgtaaaactgaaggtccactttcgagagggcataggtcaaggttacactttaaacancagttgttcaacctacacattgttcccttggcatgtgtggttgcaaaatggttccaacctttcttggaaattctcctaaagaatgaacagcttaagtctcgttaccgaaacgataaacgaggccgacttcctgaagcggtagtccccggtttgcctgcagacatgtccca

SEQ ID NO: 529787 - DNA, 386 bp, Homo sapiens
atgagctatttgaaatctgaaatcctggctaaagtattcaaagggagtattttataggggctcccaggattccaagtcattgaagaaagaattacttatttatttttttaaaaaggattctcactctgtcactcacgctgcactgcaagggtacgtgctcagttcactgcaacctccacctccctggtacaagtgattcttccgcctcagcctcctgagtagctggaataacaggcacccgccattacgcccggataattttggtagtttaagtacagatgggatttcatcatgttggccaggctagtcttgaactcctgacctcaggtgatccatccacctcagcctcccagagtgctgagataacaggcatgagccacttttcc

SEQ ID NO: 529788 - DNA, 120 bp, Homo sapiens
gcaatcattggatgaaaccctactaggaatacaaagttagccaggcatggtggtgcatgcctgttgatcccacgctactcagcgagccttggcaacaagtagcaacaactccagtctcaa

SEQ ID NO: 529789 - DNA, 311 bp, Homo sapiens
ctctcttgagaaccttgggaacaaatacattatgaattttaaccagccataaatggagtgctttcacccagggcttttccttgtaatttcaatcaggtttaattttgaccgtaggcttttgtctaggttggttagatcaccatctctgttataacctccaaattattaaaaagctcttctgaaagattttatggaaggttacggcatgaaatggcctatttctctgtgggaaggcagggctcagaaaaatgtgacaaacgtcacagtgggaactgtgccttgtgtcaaaccacaagtggtgcctccatacg

SEQ ID NO: 529790 - DNA, 1010 bp, Homo sapiens
gctcggagcggagactggcaaatgtgcggacttcgacacctacgactgatcgggcctacagcagcttcgagcggcggcagagggtcccgcggcatgatgctggtggacatggttcccgtagccagaaggagtttgcccacaagagcccccctacacagcgatacgtaggaccatctacctttcacagtactggttcagggcgcacgatcagcatgctcatctttcaagtgatctcagcgataagtgcagtgtcacggctcagtcagagacacacagacaccagataaatttcaaaggacttcgtgctagtgatagacattcgactgaacgtggacttcccgttacaggacagccttgaccatacgactggatgcacgtgttgggacgactcggttcactatcagtgttggaccattgcagacaggcagacaaaccaagactcaaaggatgagacttctggactcgcacgacacacacggtcggacccacagagtgaccagaccggcttcacgcggactcgaccgtacctctaccaggagagacacgcgagagaacggaacgcccgccaccagagacagacacaggacaaaccaaggagcccacccaccgatgcgggcaagaccagactgtcgagggaagcactggcgcgcagaccgagcagaccggagggatcacgcacgcatgggcaagagcgcaaggagcacacccacaacgagcacaagcaaggcaacagcagacagacgagaagcacccacagacgtacaagccgacagagccagcacgaaaaaggggggacagacagacaaggccaccacgatcaacaaagcaaaacggcacagcccaacactacgccaaagaacgcgcgtggactcacaacgactacagagcggcagcatggcacacagggaccgcgcaaggaaggaagcggacaaggacacagagggaagaaagagagacggggcacaggacaccgccacacagcaacacacaaggacagaagacggcgagca

SEQ ID NO: 529791 - DNA, 251 bp, Homo sapiens
  misc_feature (139)..(140): n is a, c, g, or t
cggcttatcaggaaagtacactccgagcggtcaggctaggtgctgtgcagcgagtcctcttcgtctctaaccacgcattaagcggaggtgtcccagtgctgccccaacactccagtgccctgccccctcccactcttgnnagaggaggccgcctcctcgtgggctccagtgctggcttgccctgcgcacatctgcatctggggtgatcctactagatgtcgacgctgcatggccatgcaatgcttgtgcac

SEQ ID NO: 529792 - DNA, 792 bp, Homo sapiens
  misc_feature (5)..(5): n is a, c, g, or t
  misc_feature (25)..(25): n is a, c, g, or t
  misc_feature (586)..(586): n is a, c, g, or t
  misc_feature (757)..(757): n is a, c, g, or t
cctgnttgtaatcagcgcgccctgngtgggacaacggattcggccttatggccgggaattaatgtgctcgcacggggtgcatcagtattatgatacctctgtactttcctttcgctattcatcaatttcccatttttttttcagcttaagtaaccacacaattttaggcctcaattttttttttttttctgtgaaggaacttgaagtgatgcatgtgtgatcttttgataccgaagggttaaagggacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgtaagctcaccctgttttttgaagcacccatgtcagtattaagaagaataggcaggagttccttaagttacataatgttcgtgcaataattttcctggacttttttggtacattaaattttgaccaggattaccacccaaactggttttttggaaccaaaaaaaatctttttttggcatnacaattaaatttttaaggggcagaataccatctcatattcaatggggggctcaatttttataatttccttaatgttcatttaatttcaatacctgggaggggacaggttttaaaaggtttctcaaatatatagaacctaatcttaagaaaaaaagggaacattgaccgttnatcatttggggcaaaattttacgtaaagagaccat

SEQ ID NO: 529793 - DNA, 265 bp, Homo sapiens
  misc_feature (181)..(181): n is a, c, g, or t
  misc_feature (203)..(203): n is a, c, g, or t
aagacatcacagctgatatctcctggtgctatccccaaactgccactctaaactcttgaagtaaataaataatctttgctggcaggactctgctgaatctccttaggcactctctaatcagatatcctaggtcctcccaattcttagaccttttatacctgtttttctccttctgttattncatttaggtttctcaattcatncaaaaccggtatccaggccatcaccaatcattccatatgacaaatggttcttcttaaatccc

SEQ ID NO: 529794 - DNA, 214 bp, Homo sapiens
ctggaggctgctgtgagtacctactccggatgataagttagcatgaattgatttgggtgctggcaggatgttctagatatgatttttagagaatcaggtcttccagttccttagcaggatcttgaatgattggatggattagttgagttaggtctagctgggttaggtctaactgggggtaccggacgcttcgaagttcgtaatcagtggtcat

SEQ ID NO: 529795 - DNA, 837 bp, Homo sapiens
agcggggaatcattggccactggggcattagcttaacctccagcccctatccccttcctggaggttgagggtggggcgtgaaagtcccaagtcctctaatcctggactatggtctttctggtgaccagccccatcctgtaatgccacctagatgctgccaaccaccagtcttttatttgtgatcttgtgtttgagctcagagtcttgtgtcctctagcctcctgcagttagctgagactacaggtgttagagtagagaaaacgaattctctcctctgcgatggaacgtggtccttagtaccgcattgtagcacggaaacaccaagctctgtaacccatcgattgttccttcttatccacttccttgtagactggtacggcctgtgcagaactttagccttgcgcaaagaaaagctaagttggaactatggagagcagatcttgcactgcaatgtcgtctatcttgtgatggatgaagttctggctggagttaccactacaccaggaactctttccacacagtctgctgagtgtgattgccaacttcatccctttctctgatcacaacctagagtccacggaacgatgtaccaaatgccagatgggctaagcacaacatatgggctttccacttctcacttatcaacgaccgatcggataacaaactgtatcgtcttcagaactcctcagacgccccttgggtgagaccctccatgtcatgatttcttgttgacatggataactatccaatggggagcaatgccatcgcttgctgtgatttcgttacacatggggtatgacatggggaagatgcccctgaatcgtgaagccgggctat

SEQ ID NO: 529796 - DNA, 270 bp, Homo sapiens
cctcatttggcgaggcagtctccctggccctgccggacccgctgtaccccctggccccattggtaatgttggtggcctgtagccaaagggctcgcgcaccctggccccctggagctactgttccctgagctgctgccgagtcgtcctcctgcccttatgaaaggctgtacccatgccctactggcctgctgcaaagaagcagcaaagtccccgtggcgagactgcctctgctgacgtcctggagaagtgcccccctgccccactgccctg

SEQ ID NO: 529797 - DNA, 766 bp, Homo sapiens
tatcacagaaaatttcaagcaaatacacaaggtaaagagaaaatatagtaaatcaccatataaccatcactcagtttcaataactggcaaaaggtgggttatttggtttcactggtgtctccctttccctttggggggttattttcaacacaaacacaaaaagacacttgagtactttaaagcaaatgggggtcatcaaatcatttcacccaccaaatgtgttctcttcaacagcatattaatctgtaaccgaccaaagagtatttaaccaccatactataccacgttcacacaacatcaatactaattctcttaatatcagctaataactaggccatgtctaaactcttcctgattatttcatggcctcatgtcacaaagcatatgtctgctttgtcagtgaagtttaaccaactaactaagtcgggcgggggcaacggggggctccaccgcctaattaatccccagcgctttgggagggcccaggcaaggccagacatcacgaggtccggcgtccggacgacccatccttggccccacgtgggctgaggccctgtcctctggccaaacacattaccaacaaaatttaagcacgcggcgtagttgggcacaaggcccctttggaatccccagagctacgtcccggggagggttgaacggcagggaaaacccgctgtggagctccagaatctccaagaccagtctgtggcgcacattggtggagaaccctcgtctcttttcgcgaagacccaaacaaaaggcgggc

SEQ ID NO: 529798 - DNA, 928 bp, Homo sapiens
  misc_feature (623)..(623): n is a, c, g, or t
agcggattactccagacagacggctatgtaatccagccagctacactccagctccctggaggcagcagtttgattcaatggtaggagaatgttacctctcctggctctgggagctcttgcgtggatgggttctagccctgctgtcctctggcaccctaagagcccacttgacgaggagaactctgacccaggagataccaagaccgagcgatcccacgtgcgagcctcggacttcagcgctccgtccgaactgtggagctgtcgtcttatcgagcctgctacaatgccagttgagatcgctgaaggctcgcgctgataatgagatgtcgatctatctgccccgacgggaggcatctccatgcgacttgcgcgcattgccctgtctctagggtggcccataagtagcacccgtggacaggagattctcgaaggtcctcaagttcaacacctcgcggagcacttcttgaggcagaaatactccatagctttcgagcaaccttcctgcggacactgcatcgagatcagtctcgagcagatagagtcgtgcgaagtcgtgatgtatgggaagatgccgctgtattgtctgagagcaagtcagtctgctgtaccaggttccacgaganggattgccatgaggccttgtattgggtcctgaggcgctttgccacttgacgtttcagtgactcaggcgtgccgctcatagaatgctcatcaacagactacgtgaagaatgggactagggggaacatcgccgatctgatcgatgaccttgacttcgcctctccatgatcggtctggtggatcccctcttctttaatgcatatgggggctgctttgaacccgagaaattttcaccaggttcttggcacgaccgttgggtgtgggcctatgttgtgctgtactaccggaaaattctgccggggagaaa

SEQ ID NO: 529799 - DNA, 152 bp, Homo sapiens
  misc_feature (92)..(92): n is a, c, g, or t
  misc_feature (129)..(129): n is a, c, g, or t
tgtgcgcggatccttccagagactgagttctcagcccatttgtgcaattctgatcaagccatcctggcaacgcaggggaagggttcacagtngcaacacatatagcaatgcaccccccagtggcactcntggagtttccctgaaagcagaag

SEQ ID NO: 529800 - DNA, 136 bp, Homo sapiens
ctcgatgcaaagtgtcaaaactctaggacattgtgtgtgcgagtgtgagtcagatagtcatgttgtgagacaccaagacacgggtcctgtgatactctgatgatctctgtgagtctgtgtgacgaggactactgga

SEQ ID NO: 529801 - DNA, 345 bp, Homo sapiens
agttacaacagcttagtagagatggggtttcaccatgtttgccaggctggtcttgaactcttgggctcatgtgatccaccttggcctcccagagtgttgggattacaggtgtgagccactatacctggccttattatggttttgattagcatttccttgataattagagatgtcgagtatctttatatgtactttttggctatttgtatatctttggagaaatgactattcaagttctttgtttttgagttgcgttggtttttagttgttgaattgtagtagttaatatattttcaatcccagtctggtactagatacatgatttgcaaatattttctcccattc

SEQ ID NO: 529802 - DNA, 149 bp, Homo sapiens
agcgctcgtactgggaggctagaagcatctccatcgagtttagcaggtagctccatctcagcctggtctgcagagggccctggaggaggaaggctctggtgctcacttcaaaggcctcgagaaggaacttgttccaaggtgggccacgt

SEQ ID NO: 529803 - DNA, 858 bp, Homo sapiens
gattcctgaagctgacagcattcgggccgagatgtctcgctccgtggccttagctgtgctcgcgctaatctctctttctggcctggagagctatccatgctgctactccaaagtatttcaggtttactcagcggtcgagtcgcacgtcgagaggcacatgtgaatacgctcaaaatatcctccgtggaatgcgcgtagtggtagtcatgagagtctctcatgccactcccggagctagtgtgagaagtgtgagcttgatcgtagacacgaatgtgaggagcacgaatgcgacatacacaagtgcgtaggcacttacaagacattgatctatctcatgctaatggactggtctttctatctcttgttactattactgaagttcacccccagtgtaagaaacgatgacgttagtgcctgtccgtgtgaaccattgtgactttgtcatcagccaagatagttaagtgggatcgagacatgtaagcagtcctcatggaggttggaacgatgccgcatgaggattggatgaattccaaattctgcttgcttgctttggttaatattgatatgcgttatacagcttacacttatatgcacaaaatgtagcggtaataataatgttaacatggacggtgatcttcttaataattctacttttgagtgctgtctccatgtcctgatgtatctgagccaggttgctccacaggtagctctaggagggctggcaacttagaggtggggagcagagaatgctcttatccaacatcaaacattcttggtcagatttgaatcttcaatctcttgcatttcaaagctgtaagatagtaaagcgtgcattaagttaatgtcccagtttaacta

SEQ ID NO: 529804 - DNA, 449 bp, Homo sapiens
gagtgtctgtactcaggtatagtgttagcacaggtttttttcttcagtgtggcgggtaaggactcaggtataaaagctaggtagtctcagtaaaaataattgggccaaatagctatttactacccatgagatcaaggagacgccagggtaaaagaggcagcagaaggccgggtgcggtcgtcacgcctgtaatcccagcactttaggaggctgaggcgggcggatcaccagaggttggtagtttgagaccagcctgaccaacatagagaaaacctgtatctactaaaaatacaaaattagccaggcatggtggtgcatgcctgtaatcccagctactttgaaggctgaggcaggagaatcacttgaacccgggaggcagaggttgtggtaagccgagatcggccattgcacttcagcctgggcagcaagagtgaaactccgtcttaaaa

SEQ ID NO: 529805 - DNA, 308 bp, Homo sapiens
ccccccggggggggggggtccccccctttttttagggggaagggggggtttcccccccccgaattgggcaaaaacgggtttttgtggccctttaatgtcggggggggggggggggctccccttatggggttggggggggcccccccccccccgggggggggggggtacccttttacccccctttttgtgggggggggggggggggcattttttccccctggacgggggtttccccgtggggggggggttttgggggggggtgttttgggccccccccctcccccgaaaaaaagaccgggtgggcggga

SEQ ID NO: 529806 - DNA, 867 bp, Homo sapiens
  misc_feature (392)..(392): n is a, c, g, or t
  misc_feature (476)..(476): n is a, c, g, or t
  misc_feature (484)..(484): n is a, c, g, or t
ggactagacagtcgtggtgcagggacggcgtctcggtcagtctgccgaagtgtcgtggccggcactggacagatgaaggagagcagggatatggcagctcgtagttagcagtgcgcggagagttacagtgccatgatagtaccagggccagtgatttcacggtcctggtagcagcacacctgcgtgctccgcactacatcgttgctaaccacgtgagccgcacaacgtgaaggaccggcactcactagcatgcagcggttgcgtcctggtggatgggcgacgacctgagtcttcgaggccagatgggtacctcggctattcactgggacctcgtacgcagcgacacaaaatccacatcggcgtcggtgtgcaggacgaatctgcagtgagantggcatgtcaaagtcgctaaattctcaaacacgcttgactgacgaattgggcgttagtccagcggccccagataaccacatctntctgtaangtagcaaagaggtgacagtaaggggccgacatgaataccctacaggcgcagtatccgaagtgagagcaccttactccttcacacaagacccatggaaagggatacgcgcgccttggtgtgaaacgcacttcgggaacggaatcgggagacggattacagtcgcaacccacggtctttgcccatgggcatgtggtacaccctttgtaaggaggagtgcccccagccgttagttagaatgacccacttcttataaaagcggtcacccgaaaagaagtgaaaaagcacgacataaagagaagtggcaccttttcagggagaacccattgttttctggaaaggaaggcgtattgctaaaaaaattcacaacgggggcggacgccagg

SEQ ID NO: 529807 - DNA, 398 bp, Homo sapiens
  misc_feature (3)..(3): n is a, c, g, or t
  misc_feature (10)..(10): n is a, c, g, or t
  misc_feature (28)..(28): n is a, c, g, or t
  misc_feature (186)..(186): n is a, c, g, or t
  misc_feature (370)..(370): n is a, c, g, or t
ganaataaanaagtttggaaaagtaagnccctcctatattgctttagcatgtgtttccagagatgaaacatgttttaaagatgtgggcattatgtgcatttatttccataatatgatggctttaaactgtcctctttactcttaattagtcccaggcataaaattgcaacctacgaccgggtgtgngtgcacgcctgtaatctcagcactttgggagtctgaagcaggtggatcccttgagctcaggagctcaagaccagcctggccaacatggcaaaaccctgtccctgctaaaaatacaaaaattagccaagcagaaggatcacttgaaccctgaaggttgaggctgcaatgagccgtgattgcgccnactgcactgcagcctgatgacagagtga

SEQ ID NO: 529808 - DNA, 696 bp, Homo sapiens
gaattcgacttgagaaacttacctttgcacatagagctgttagtgtcagcacagatccaagtggatgcaactttgcaatcctgcagtcagatcctaaaacaaggtatacttgtatatattaaatttcattttttagaaggaacaatcactgaattttcttgttttcagtagctgctggtgcaaatttaattgaagagctgttgccaagacctatagagaccttagacataatcatgtttacagattatgtctacagataatccagaggtagaattgttatacttggagtgatgaatgtttcctttggtttataaactgacatttattgaaaatattgaaaatatctatacatgcactcacaaagtttattgtctttcttttttttttttttttttggaaagggagtctggccctatggcccaggctaaggggcaaaatccgcggctcacttttaacctccacctcccgggatgaagcagttctctggcctaaagcctcccaagtagtggggatcacgggtgcccgcaaccaaacccaggtaatcgggagatctcagtagacgagggggtttggccctgtgggccaggcgggtcttgaccacctggacctcgggtgatccacaagcctgggcctcccaaagtgctaggatcagggcatgagccacgacccggctatatgggctcccatacggatgac

SEQ ID NO: 529809 - DNA, 508 bp, Homo sapiens
  misc_feature (31)..(31): n is a, c, g, or t
gctacatcaggcaacctgttcccatttaatncttaattaggtagctccccagttaaaagctccatacttacctcacaatttgctcaagaaggaaattcctagtgaatggtggccagccagaactcaaagttatctctctgaggctcacctgagacaaatgcagatctgtttgtttcctctgccctattgttaattttaaaatgcagattcactgagccaggctaaattgtgtattcagtgggagacttatcaaggactcaaataaatttattattttttctcttatctacttatgacgtggaagccccaacctcaagttttcctgtcttacctgaccacaccaatgtacatcttaaacatgttattgatgtctcttgactttctaaaatgtattagaagactgtaccccaaccaccttgggcacctgtcatcaggacctcctgaggctgtgtcacaggctcctacttaaccttggcagaataaactttccaaatttattgacaaaaaa

SEQ ID NO: 529810 - DNA, 153 bp, Homo sapiens
ttccaaagcagtacccaatctcctttgggatgtgggcaggtagggaagcaggcttggagggttaatttacccacagaatgtgatagtaatagagggagggaggctgctgtgggtttaactcctgggttggctgttgggtactacgctttggca

SEQ ID NO: 529811 - DNA, 362 bp, Homo sapiens
ctattaagtggcagagatggaaacagaactccagtcttctgacttgtagaaaaaggtgtctatgtgattttattttaataaagcaaatttcagtgtaatgcaattaagttgaagatatcatacctgcccatctcctctagctagagtatgaaatttcagattggataaattgtggtcataagaacatttctctacaatgatgtatgtaacatgatgaataaataaaaattaccttagaagaacaactaggaaaacaatccaaatggtcattactaaaatgtccaaattgtccattttgatgagaaacacacagttatgagttatgaaaatggatttgtgaatatgaattgccaagccaggac

SEQ ID NO: 529812 - DNA, 355 bp, Homo sapiens
cgtggaagttatcgttgcttccaaacacaggccctgccacgaggcggtccggggggttccacaagtgcgatgccgtctccatggaggttcttcttccctgtgccgtgcactttgaagtggacgtgcatttcccagtctttgaggaagcacggctgctgtatccagatagagccctctttgctgcgctcgtcaggtagcagacgcacgtactgtctcgtgagcatagtgctgccctggtagtcccagagtggcatagagctggaaccgaccccttggtagggcttaatgagcgaatgctcccgcttgagatgttcactgttgccgtcagttatatccgcagcaaagaccccaaaag

SEQ ID NO: 529813 - DNA, 367 bp, Homo sapiens
tcccaaaagaaaaacttttttttggggaaaggggtgtccatcccctcacccggggagggggatacccccctccgggccaaaccccactttaaatttttcaaaaaacccgttgggggaaattggaaaagcccgggggccccttttaaaaaaggggggtcacccaaaaccaaaaggccctctgtttcccaaaacaaaaaggggcccggggccccctgggcccccgggctttgcccccaatgaaaagggggggcctacaaaacccccccttgggggggcccctaatttgggcccccccccgcaatttggggcccgggggcaaatgggccaacaaattggggaaagggaatttttccccaaaatatttaag

SEQ ID NO: 529814 - DNA, 219 bp, Homo sapiens
gagggagactctgtctgaaaaaaaaaaaaacaaaaaggagatcatgaagctagaagaggagaaagccactttaccacagaggcaggacaagcagaagtgtcccacagtgcaaagcactgctttgcactgtggaagggcaactaactggagataaccgtttacagatactttaaaacaaacctttttgtacaaaatgcttaatttataagcggttaggcc

SEQ ID NO: 529815 - DNA, 100 bp, Homo sapiens
gtgttcacaacgattcttttgcctcagcctccaaaagatgatgggattataggcgcgcgcaccacacccagctaatttttggtatttttagtagagttcg

SEQ ID NO: 529816 - DNA, 477 bp, Homo sapiens
  misc_feature (116)..(116): n is a, c, g, or t
  misc_feature (135)..(135): n is a, c, g, or t
  misc_feature (142)..(142): n is a, c, g, or t
ccatatccaaaggctgccagagagacacgggggacgaccacaacctactaggcgatgcctcgagcatgcggacctgtattgcagcctatgctctctttcttggcgctatgacagangatacatcttttaactgancaccatnctcctgacatggcatgggagagcttgactgcggacaacagtaattatgtaaatccatacatcgtaaaaaaccctgctgttggtgatcaagccatagactgcagaaaaagtaaacaaagaaatcaaagggctctggcactaaaagtttggccctggggagagacaccccagaccggtggaaaaaaggccggagacccacgaattccccaattggccatttggaccaaaccaaggcccggaaaacttggccccaaaaagacctttgaaacagaaccaccatttttttaaaattccctaaggagcggctttggccatacaaaatttgggtcccccccc

SEQ ID NO: 529817 - DNA, 536 bp, Homo sapiens
aatagacaaccttatacaaatcattctgaagtttcacatttcttcaatttaaatttatgacattcaactattttgaagtggtcctgaaaagtactatataagaaacatgttggctgggcgcggtggctcgcacctgtaatcccagcactttgggaggccaaggcgggaggatcacaaggtgaggagatcgagaccatcctggccaacacgatgaaaccctgtctctactaaaaatacaaaaaaaaaattagccgggcgcaggggcaggcacctgtagttccagctactcaggaggctgaggctggagaactgattgggcctggcaggttgaggctgcagagagccaaggtcacaccacttgcattccagcctgagcgacagagcaagactctgtctgtaagaaagaaaaaggagccaaactaacagaccctcaaaagtgacattttgaggctatgcaaaggccatatataggaacccttaaatggcgacagcctccccactgtgtcagcctgacatacaatacccgtcttttccct

SEQ ID NO: 529818 - DNA, 965 bp, Homo sapiens
  misc_feature (13)..(14): n is a, c, g, or t
  misc_feature (269)..(269): n is a, c, g, or t
  misc_feature (274)..(275): n is a, c, g, or t
ttttttttttttnnaaaaaataaattttttttatattattttttttttgattatcatcgccctttagaacgaaggtaggtggatgatagtacttggaactatacgagacaacgggagggaggactcttgaaacaaaaaagaaaaaacacagcaatagggcaaggtattcattattttactttttatttatttttttcctgagagcgtacaggacaattatccgttttatgtatttactccttgctctttatgatttcttcttttctttncaacnncatatatttttggttgttctgtagacgggatctatttttttgaatgtgctgtatttttgtgtatatataatattattatcagagtatataaaattcataacaccagtgcccgcacaatgaacaaagaactctccgagatcattttttattttattattagttcttataaatcctgttatctcttcacttgctcatatttttttaatatataccaccacctcttactactcctactccccgtccttatacaccacccccttaccaccatcttctacaccctgtacttacttcttctgtattttggtgttttttttcttggagaatccgtctaccttgcctctcacacgccccgtttgtccctattgtactgactcttgtccttccattacttcgatattactatgttttctacatttcatatctcagctctatcaccgatctactcatctcttcccatccacctatacttagtctcactatttcaactcactcttagttttttattccttctttgtctcgtgttcgccgcgcgcggctgttcattttcagtgtcttttaccgtttcttggtttccttcttctgtcacactacccgaattttttctcaccccatattttttccgtggccaattgaactacctagttactatcactaattgagaaatatcctatattaattctatattctttc

SEQ ID NO: 529819 - DNA, 182 bp, Homo sapiens
catgctatcctgtccaccagcttagtctttgagaaaagatgggtgaaagagaggactctcccagtcattccggaaaccaatgccccatttaaacattatccttgtcttggtggagaaaacagggaggatgtcctgttccctggttgatcaccttcagttcaaagttgcagccaagtgaagaa

SEQ ID NO: 529820 - DNA, 143 bp, Homo sapiens
cttgttcaaggatggctgtgtgtgtgtgtctatacttacatacatatatatatctattctagtgccccggtccccatcctgttcaggaatggactgtgtatatacatatatatgtgtgctagtgccctagcctccatgctgtt

SEQ ID NO: 529821 - DNA, 745 bp, Homo sapiens
gtgcggttgttctctggagcagcgtgcttttatctccgggccgcttctctcctacctaagtggcgtgccagacacgcacgatggaagattcgatggacatggacatgagccccctgtaggccccggagaactatctgtcctcggcgttgtagaactaaaggccggacgaaaggatcatcgactatatagagggtggatcatggatagaaaatgagcaccagttcatctttatcaacggtctagtattaggggctggtgcgacaaggactggagattgccactatagtcttgaagcaagagtgcaatgaattacggaaggcagctccaattaaagtaacagtggcaagtgttgtaaaatagtgctgtacagccaacagggtttccctttgtggggcttagagaataagcagctatcagtggtctataagggttgaagtgtggttcgagggccagtgcatattagtggagagcacttagtagctgtggaggaagatgcagagtcagaggatgacgaggaggaggatgtgaaaattctttgagtatagttgcgaacagcggtctgcccctggaggtggatagcgaggttcccatagaatgagagtaaggcttgatgtgaggaagatgatgaggatgatgatgagaggttgatgcttgagactggtggtgatgaatgatttcgatgttgcaggaagcgaaataatttcgacgggaagaatttataaagtatattgcacactacatgata

SEQ ID NO: 529822 - DNA, 294 bp, Homo sapiens
ggaaggcccgggaccgcgggatgggtgtcggcgtgaccaggccttagtccctgtctctcctcagtgacatcgtctttaaaccctgcgtggcaatccctgacgcaccgccgtgatgcccagggagacaggcgacctggagtccactacttcttaggtcatccactattggatgatatcgaatgttcattgtggagcagacatgtggctccagcagatgcagcagatccgcatgtcccttcgcgggaaggctgtgtgcttatggcagacacatatgcgcaggcatcaggcactgga

SEQ ID NO: 529823 - DNA, 904 bp, Homo sapiens
gctcgtctcactccatctctcccctctttggccggcattgaatgccaataccatagaagattcgaggaatgacgacgacaactgaggtagagctcacctgtgctcaccagctccgtcagggtggtcagccgacccctttccctgggaaccccacgttctctctgtggctggcttggttgtcggggcgtgagatgccatattgcattacagggcagcaacagaaccagtaccaggaatttacttgaccattccccttatttctcatctagaggaatctcggattcaagccctttcattgctaagacaccttttcactgaggttcttaccagctcagccaagatctccactctgctatagcacgaagcactcaatgttcgctttagcaccacgatttcttgacctatgcctttctcttagaccgtctgatacgattagtcagaacttcagatcatcagatcagtctcaaatgggtttcttggaatttcatatttgagcaaatatttatactatacccaaagtcatttggaagttcttaggttagtggtcaaaaccatccttttaaaggccagtaggtctatagacacatggtccccatccacaccgcgacaggctggggaaattgtcgccacccatccaccccctatggccattgccttccccatgggggccctgctccatcttgcacgctggcaacctctcgggttagcagagacattacgacgaagaaccaagggccaaacttggaaatacagcaacacatgtgcaatttggcgtttcaacaaccgaaggccacggtgtacgccaaacagtgaataggtcattgaccatatgtccagggtgggattctaaattggaacaatagggtcggttgacttccatcctaattagagctatccaggatag

SEQ ID NO: 529824 - DNA, 570 bp, Homo sapiens
agcggagtgttgtagtccggccgtgattggcggtgagccgcggctcatgcgcggtgcacagaggcttgtatcacagtctgtaacaacgaggagagaggcccaggccgtcgctgcatgaggcaattagcgaaggatgagaattcagctccagttcgaaagcctacaaaatctgagactgtcatttgctttcataatggattgccagcgtttcgccgtcctggcgcagaaggctgttcagccatggactcattcgagagaatagatcgggcccagcacaggcagcgtcgagtgcgaaacttccccgcagcccgccttccacccatgtgtgtcgaccctagcccaggagggaccatctctcgagcttctagagcaccgtattaagcagagcttcccacagtgccaaataatcttctacaagcagctgtgaacggaagagccctcggggtctcacatgccatccagatcacctagtctacgtgccaccccatgggccgaagtaacgagacattcacattgcacactcaatggccaaaagcgtgcaggtctagggctatggccccgaaaatgatg

SEQ ID NO: 529825 - DNA, 820 bp, Homo sapiens
  misc_feature (820)..(820): n is a, c, g, or t
caaaggaggggcccgagaccccacccaggccccgggtatcagctgctccccccatccccgctcccgccgctatccggagacagtgactcctcagcctcctccgacaagcggtccccttggtactccgctatgtagattgacccattgtgcgttggcccccggtagggtagcgagtccagctccggcggcttgtatacgcacaggtcaccccggatcttcttccgacgatcgggctctcttgcgcctgctgctgccgaggtcccggatggaccctgggcttggggatccgccgtgcccgggccccccgggggggccccccccaaggggaagggcccccgggggaatcccccaagctttgtcgcgtcccgccaggccctcttgacgcccgagtgtgtgccctgggatgtcccatgaagccgccgaatgagatgtcacgcgctggtgccctgccttgttgccgccaggggagctcgacgatcgggggccacgcagcttcactgcgggtgcccacatgtggggccacccggggtcacggtagggggcagggccttactgcgcggcccacaaggacggcaatagaccgcacagcgaaggaaagcctccccacgcgcgggtttggcaccaccaggagagaagcacccacctttagcagcacgagacaaccacccccgggggaggaggttttctacccccccaagggagggagttcaatttcacccagaggggcgcccccccacaaggggagtccccccacaggaaaagcatttttatgggcggcggacacggagccccacaccaacattaccccagggggtcatcn

SEQ ID NO: 529826 - DNA, 174 bp, Homo sapiens
agatatttttacttaagatatagtctgtgagctattcatttctacactcatttgtataagaatggagctgatttgtataagaatgggagctgatttcagagctgaatactctaataagttggcggatcgagcagaacttgctcagcttgtcatctgctgccagagcacatatct

SEQ ID NO: 529827 - DNA, 476 bp, Homo sapiens
  misc_feature (8)..(8): n is a, c, g, or t
  misc_feature (36)..(36): n is a, c, g, or t
  misc_feature (95)..(95): n is a, c, g, or t
  misc_feature (98)..(98): n is a, c, g, or t
agtgatgntggcccgtgcccgtgctataagtatacngtgtggtaatttgattagtatccctttgaacctaggaaacctttacccttgctgaaatncgntaaaggaaaacactccatatgctaaagttaaatatggtatttagaaatagtcatgtatgcattgagaagtctatatttattttacagaaagctggagattatgactagatatggaatattttttctgaatttttttttatatttcctccgacttacctctttttgaaagagagtttttattaagtgaacctccacgatattggctgaaaagttctacttctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 529828 - DNA, 984 bp, Homo sapiens
agcggacgcgtctccgcgcatgctcctttcttttccagtcccggtaccggaccctgcagccgcagtatatgttgatgcctacgaagaaccggattgccatttactgaacctctcttttcataggagggagtcattggtggccagagacggatgtccaaaatgcctatatgcacccggtagctggtcatgacacaccatagtgtgcgcctgagcttcagtgtcgtgaacggtgcatgctggtctctctagtcccggggctgcgtgatcgatccagtttgcctggtagacttttctatctgtgtaccttagctcatctgcagggtagtccagtagtctgccgtgagttatccttcattctgccctcggcagtattgtgtcctgccaccctatcgccgtgaatcagtccacgcagtacttggctaggcctcgcgcctaaacgcgtctgtgaagggttgatgctgagctgtcgagtagcttcacaagcaggggcacatgcttgacagcagcatgcgcttacaagacggagttgcttgtgccagccttggtgctcgacagagaaaggcctgaggcgtgggggcctgggggtccagccaatgctgatattaccagcctttgagatggcggagttgagagtcggtgggcacgcttgggtcaagacccagccttcccgtgaaacgattgggacgagcgatgtcttttttcgccattgacacttatagctttagcagctccatgataaacctgctaaaatcagtgggcacagagtctccatcgcaggcgtcactggatcctccggcccaataatgtgggcccttgattccccttccccaagggaggggggcccccgggttaaccaaggcttttttgtgttcccctttttagtcgaaggcggtaaaattgccgagcttgggggtaaccattgggccactgggcttggttcacttgtgggtcacctttgtttctcccgggtcacattttccctcg

SEQ ID NO: 529829 - DNA, 606 bp, Homo sapiens
  misc_feature (366)..(366): n is a, c, g, or t
  misc_feature (368)..(368): n is a, c, g, or t
ccagagaagatagcgagatctaaatctctgccaaaaaaaaaaaaaaaaacttaaaatttaagaaacacaaagagcaaagcagaacttataaaattatattattattattattatttaaaaagctctctagttctttcaccccccagcctttccgtgaaccgtgccttctcgtgaggattaaagcaattcatttttgctcccacccttcggccctcgtggttttaaaaatataaacctttttaaaaagggaaacaaaaaaaggttccctctcttgtggcaaatttctctttttttttaggttataagaggggtggaaacattctccttgtggacccaggggtgttggatatttgtgcaggagacccncnctgtgtccccacagagagaggccacagaggcgccccaactagaaaatcatcacaccccaacgcaagcgccacccaccaggcgccgacaccgcaaacaccgacaccaaagcacgccggccacacccacccaacgagagacacaacaccacacaccacccaaggagcaacaacaagaacacgaaacgacacaagaacgcctcatacaaccaacaagcacaacaaacacgacacagagaca

SEQ ID NO: 529830 - DNA, 154 bp, Homo sapiens
atagcaaaatacagaacccgagattatactttaggctaggtgttgtggctcacacctgtaatcccaatgcttttggaggctagggtgggaggatcactcgaagccaggagcttgagaccaaactggacaacatagtgagaccccccacctctac

SEQ ID NO: 529831 - DNA, 131 bp, Homo sapiens
agtcgatctagaggatacccctcccaagtgctgggattacaggcgttagctgccgcgcccagtcctattaaacttctacgaacttcttgcacaagtaagggaatagtttctaattcctgagaaagtattat

SEQ ID NO: 529832 - DNA, 108 bp, Homo sapiens
tgggggggggtttttttccccccccccccaattgcccttaatttaacctggggttagctgcctcccttggtccctgcttggtccggacaaagtcccctgggcccccca

SEQ ID NO: 529833 - DNA, 299 bp, Homo sapiens
catttttccccaggggggtttttttaaaaaagtttaatgttttaaagtttcaaaggaggagggttgctttttaagctataacagtcgactttatttttttactttgaaaaatcttgacttgtttgagggtatataaaatatataaagggacccttaatggattggttttcaaaatttaaaattttttggatttgctcttggaaaattgtttttaacggaaagtattaaaaaattgaggggggaatttttagaaccaaagttttttttaataaaaatccccccatgcttggcccatgcca

SEQ ID NO: 529834 - DNA, 289 bp, Homo sapiens
  misc_feature (44)..(44): n is a, c, g, or t
  misc_feature (261)..(262): n is a, c, g, or t
ccactgcttggcacggtgtgaggcgccagggcattcttcccacnccgcccctcccgaagggcccaaccaggggttgtgcagaggggggaaccatttaactaatatccatagaagagaaagagctgcgccccccctcccccatccccccaaaaaaattattttgccagggtgaggttgtggggggcgcctcctggggtgcacgattccctcagctctgggtttaatgtattatatttatttggggccgacagtgccccaatnnagggtcagaagtggcaaaaaaaaaaaa

SEQ ID NO: 529835 - DNA, 399 bp, Homo sapiens
aactgcactgatctggaaggttcatggaggaagttggattatctgggcttgaaggaggggcagaaagttgataggttaagatggagggagtacatttcataataagtggtctagagaaaattcttgtgaagtactggaaaatgagagggcaaacaaacacccccagcgagtgaagcataccaactgagagaaaagtctgaggagtctgggctgggaccaaagtctcaagtccccagatggggtcttcagtacaaatgatattaggaggcacaggacaatgggcttgtttgtaaacctagcagcagcgagaggtttcacattgcagtcaggggccccaaactgcgctgtgaaactctcgctgcttatctgggaaggcgatgcctaagggacatgctgctt

SEQ ID NO: 529836 - DNA, 119 bp, Homo sapiens
acccctgtcacggggctagagaaagcatacgttctcatctagggcacacaggacaggtgggcgaggtggagtctgccagaaaatgtacatcctgtgcaggcagcatccagggctcaatg

SEQ ID NO: 529837 - DNA, 351 bp, Homo sapiens
cgaaatgcccgagaccctcccagcccggcggagccccgaaaggcccctgaggccctcagcccccacatgccctgtgctgcactcccaggctgcagaccctgagcggaatgtcggcgtcagatgagctggacgactcacaggggcgcccgatgctgctcgacctggagtgagactacaacgccttcaagcgcttactgcatgcctgagcccggagcactagaccttgcacagaatggcagaccctgaggcgaaggctcctggtcccctgtgcgccacacacgccgtaggcatgcacacaactcactgtctgcagatgactgcctggcgacaggatttggtgatagaacttgg

SEQ ID NO: 529838 - DNA, 629 bp, Homo sapiens
gagtttaagctcaaaattccggagttgaacttacctggctgagttaatccggcgattaagcccttacttgagttacgtaagttgatccggagtttaagcttaaagatccggagttgaacttgtccaagattatgggccgtaccctatgtgttcttctttactgccaacttaatttgtaattccagtccacaaacaggattatattttttcccagctgaatatccagaaacccctctattgaaaggtcgtttaaaaaaaatttgactgcttgaattcccaggacaatttgagagagaaagagagagagtttgagccagagactgctgattaagccaggaggacctgttggcgaccgcgagccttggccccagcctccgtacgcccgaccctacctccgtacgcccctgacctctttccttcccaggcccggccccgccactcccgagcccaccaaggccgctccactgaccacgcaatgtttgtgacttctaacaggactgccggtcaggatccggcttgagagacgaaggcggagctctggataagcgagaaggaatcggttacaagtctggataaagggggaactacgtaggtcaagtcaggactgcaaagaaactaagcgggctaat

SEQ ID NO: 529839 - DNA, 740 bp, Homo sapiens
  misc_feature (151)..(151): n is a, c, g, or t
  misc_feature (235)..(235): n is a, c, g, or t
ggactttttattggctccataagtcaagtttaattctttaaaggaaagcacactatttcagtcaaagccttggtaaaataaccagtttcttcaaatgtgtgctgttacaaatgaaaacagattcttattgcacttatgcaaataactgtantgtcataagtaaagaatactcacaaatagattccaaattctgtagaaatcaggtagttttaaaaacaaatatgctccaaatttngttcaaaggagtatactccattgttaaaagctgtaaatagcttaaaagtttcttgattttgaaaaacaaattatcagcaacattttaagcaaaaagttaaaaaagattacttcaaacttctattagtttagtccatgcagttaattcttgttctgcttgatattcatgaacatttcagctctccatgagtcctcgaagttttttctctagtttgatgtcacagtctccagagctatcagaaacatgcattcaagaaacacctgttaagagttttatagctgattataaaactacctctgaaaaggaccaaaaaaagatgaccaatgtctgtgaataatgaaaagttttagggcagcatagtcagacattctgttacctctggtaggcacacaataatttaacattaaaaattataattattactggattaacatacagggtgtgctattagaataatagggagtttcccataatttggggatacatactaattaaattattatac

SEQ ID NO: 529840 - DNA, 751 bp, Homo sapiens
  misc_feature (107)..(107): n is a, c, g, or t
tcagttgcaggctgtacggtccgggatttaggatctctgggcgagctcgcgggcgggctgtgggtcgcgagccgccgtgtggagctgctgtgtgcggtccccagtgntgccgccggacgactgctccgcccgcccccttggcgcccatggtcccgcgcgagctcgcgcacgcgcgcgcgcgcacctgcagaggcttgtttgaggcccgtggggactggtgcggtgcggaggccggtgctgccagaagtgtgaggggaggagcccgagcctgtcgactgctgcctgcctgctaagggagaggagcatgtctgcaactcgagccaagaaagtgaagatggacaccaaatcatgcccctgagtgcgaccaacaggttcctgttgcattgtacaatcatgtccttgatggtatacatatttattagcagaaaacttttaaatgcaaacactcagagaaatcaccaccttctacagagaaacaggaaacaggacaacttgacatctatgctaacctgtctgatgaaaaggcttacgtgtttacagatcgccttggaagaaataaatagacacaaattatcaatcaaagacttattctctgaatacttgtatagcaaaatcgtgcgtgaaacttctgtcaggataacatcgagcaaattctcaaacaggtatatggactctcaggagcattcttgactgccatcaataagggccatcgattgtaccatctcgccatgatagtaatagcctgtgccag

SEQ ID NO: 529841 - DNA, 260 bp, Homo sapiens
cgccgtgtctatctgccgtgatcgggcttatgctcatgtccgtcatggctggatgttggaccatatcttcatctacagtgggtcgggtgactcactagtgtcctgtgttagcgactcagcgactccgtcctcagaggcctggttgtcattatttctctcacctacttgccaagaatcaaagaatatctggatcaactacctgattttccctacaggatgcctcctggccttggagtccagctgcctcctgcaaatgtagg

SEQ ID NO: 529842 - DNA, 127 bp, Homo sapiens
aagctctctttactgagggtgctttagtttgtaggatgacaacctcaaactaacagggctaccatgtagagattgaggccagtccaggggacagcagaccagaatatggagagacttgcaatcatga

SEQ ID NO: 529843 - DNA, 277 bp, Homo sapiens
acgtcaggtgacgcacttacacgagcatggttacaccttcatatggctgacacgcgaacagattggacgttcctgaaaaaactaaacactacgagctatcatatgatacatgaatcccactgctaggtatatgcccaaaagaaaatgaaatcagtacatcactgcgatatctctgctcccatgtttacttgcagcacttgttcacaagagctacagatttggcatccacctcatcgttccattcacagatacaccgctcacgcaaaagggtcaccgc

SEQ ID NO: 529844 - DNA, 1478 bp, Homo sapiens
cgccctcttgtgtgccacgggagctatcgtgtctttgtcagtttgctggtgtcctggatatactgacaactccaattatgggattgcgttccctccagtcgcagaccctatcagatttggatattgtccttcatactttgattggactttacagtggtttcagcagtgtgctacacgtttttacgtgattcatataagaaaactggtaacctggttatttctgtgagacttagtgataactgcacggagaaagacaaacagtgtagcatacatcgagtgttagagaagatagactagacgttgtgacaatcactgtcgccgaatccattgtaccatccgcacttcctgaagaatctgaaccattttgctttggcctattgtagccggtattaacaaaactctattagagtgctcgtgagttggacacatgatatcaaaggcgtacgtaagcagctgttgtgaaatatactacgcttccctgcatattcaactcggcagttgtcatttcctggatgggcacttgtggcagtaccgacgtaaaaggacgtgcttaagaaggtctaacacagcaagaaacttgaatgtccacttcacatgaccagtcatcgcaatacccatttgcgtaaatggtgccgtcatactggatttcttttggggaacttaacgactcgaccatggaccctggacaggccagtacaaggtggacatgaagaagcgttagcgacgaggaatgtaacagggtattcataattgggtcacagaccataccagcgacacacgggggacgtattatcctccttgacaaaaggaagctttgaattgcccggagagctcctttaaagaaaagtatcctctccactaggttggctaagtatgatgggttctaaggacaggaaccacacgggttaacagggcagcaaagggggttatcccggcgtgagaatttgggcaaccaagtcttaacaattttcggtttaaacacgagaaactccaacaatttggcgtttcccccgagggcacttcaagcggtcacacggacttacatccagcaagacatcttcgggtttgtggtctcacaccaacgtggcacttaaactttttgacccttgtcaaaaggagcccgttcttgcccgcgggagtttacttaaacgcaacaaactgctttctacttatagagaaggacaatactaattcaattaatcaagaaatttacctactaaacaaattatagaataagtacaaaaattctatacacccagcgaattaattataccactagagagaacaacctacacaagacatcaactactatatatatcaccaccaaatatagttcgatgatttaacaaagcaaatatatacccgcaacatatacaaaaagaaaatatataataaagtagtacactaatcagaacataatacacaactcatgaaataaacaacagcaacaacaagacacacaccaatcagaaaataaa

SEQ ID NO: 529845 - DNA, 474 bp, Homo sapiens
caacggctgggttctaggaaaacccttttatacttgcgtgccccatctttttggggaaggtctttatggaggcaaaaggggctcattttttaaaatgggcttttcccgccctgtggccaaggaaggctttttctgattttctaacaaacgaatttttgcacacattaaattggggtttatcggcaacttacacacattgaaaaagacctatcgtacctataacacaatccacaatgaaaacgcaggaataagcgtccttgtaacaatattgtaatgaacggctgtgcagtaggcccaccgctgctgtggctctgaagaggaatagcttaccacgaacccttcagcatactgggaatctcttcctgaacaacgaatgtaaatatggtcaagtctacttttccgttcattcaattattttaagcatttgaatcatttatggtatatcctcaaaaatattatcctttggcagtgact

SEQ ID NO: 529846 - DNA, 102 bp, Homo sapiens
tacgactaatttctcaacacactgtaatttagcactgaactttgctactctactgtccaacctccttctcaacaaagtcaaatcacaaggagaacttaacct

SEQ ID NO: 529847 - DNA, 922 bp, Homo sapiens
agtggtggtcccggatgtgatcctgtgacatccaggtgggagtaagtactaagggagggggttggaactatggcagaaggaaacaccctgatatcagtggattatgaaagttttcgggaaggtgcgagggtggctgcttttgctcgattctcattactcagggctgagggttaaaaagtctggtgattggtaggctgggtccagtaacacttgatccgggtgcacatgttgcacgggacaaatctgctcatggttccctatctcacatggggtgcgtgattactgtcatggaaatgtgcgttgaacaacaacgaggaagctccgtagacattcacactgtcgacaatagcatacgttgaaacaaatgaggatagtcatcttgaagtgggatttactcaagatcttctaaatttgtaatgtaattgggctgaattttagaggtttctcataagataccactacaggggtgcttttggttgtcaattattataatatgacgattacgaagttgatgtgtgtgttaatattatgcattgaggtcaataaggattccttattactgttcatgacttgtttgagatgttattataatattaaccgtgtatgattgggatgggattacctactgctactacaatctcctatctcaaataaagaactgtcagaagcgttcataaagtgccttactgacctgtagccatatacttgtttccgaggtcgtggcgacgaggagacctgttcattgaccaacagatggggccagggcaccttaaggtggtacagtcgttaatggtggcccagagagacactccccagagaattggtcgggcatttgcactcttacaaactcgtgggcacctgttttttttaccacaaaccggggttcggctctaagaattaaacgaggccggcggctttatcc

SEQ ID NO: 529848 - DNA, 207 bp, Homo sapiens
gtggtcccttcctgcgcgtcggtcggacctgctcggatctgtggtgcttcacttgtacccgacctgttctccacacctttcctgctcctctctgtctctacgccccaccctgtgactgtcctgtggcacttctgccttccgttcttttccccctccttcctcgccacagctctgactcgttacggggctcctctcgcgtcgccctgc

SEQ ID NO: 529849 - DNA, 152 bp, Homo sapiens
ttcattagctcccacaatcctcggtctacccgacgcagtactgatcattctatttcccactctatagatccccacctccaaatatctcatccacaaccgactaatcacccacccacacgagcatactccccctaacctcgacacaactgata

SEQ ID NO: 529850 - DNA, 947 bp, Homo sapiens
tctgatgccttctcgttgtgctgtcagctgtctgctgggtgtgctcctggcggtcaagatgtgtataccggtcacactaagttgtgcctggcctcagcgctccccagcctcctacgttgaccgagaccacgtgtgtgacactgaggtgagtgtttcttattctccagtgaggggtaaggactagagacgatagttaaagacataagcattagcacacgctagctgctgtgagtagaagcaaatgtgatgcttgaactgagcttagtgtcatagctcatgttattcagtaacttactgagtcgcccttgttcacttaaaaaatattggtgggccgttgcaccgtgtgtcacacctgtaatcccagcactttaggaggccaaggcgggtggatcacgagggtcaggacgtacgagagcggccctgaagcacacaacgatgaaacccgtgtctctacgtaagacaatacaaaagatgagccaggcctggtggcaggcggccagtaagtcccagcctactcggaagacatgagacagcgagacatttgctagaaccctgggaggcgccagcgcttgcaacaagaagcccgagaatcatgccaacagatacccagccgggcacgaccgggccgcccgaaagacctactggcactgctgatactggtcaccactgtaaggactgaactgcgcggaggtagagatgacacacagtaatggtgtaacgattggccacggtggcgactgcgcactccgtgtaatctgcagcaactaccggacaggccacagaactgccctcacgcgaaaccagaggggcacagcaccaacgcataccaaccatggcaaccccgcccctcgccacacaaaacacagacgtccgaccacccacaatacacatgagccccactccaccacccctacacgccacacggcgccatacactccacatcacac

SEQ ID NO: 529851 - DNA, 226 bp, Homo sapiens
ggctatcacattatcgtacactggaagacataggaaccctctaacgtatcactatcaaggttagtcgtctatatctacttgagataaagatactgaaaattcagagtctgaagccaaatcctgatttagcacgttattggtagtcataagtgataagtgtgagatgctgcagggaaggcagatgtggtaacttggatatctctgatacgggctggataatgatgag

SEQ ID NO: 529852 - DNA, 122 bp, Homo sapiens
cagacacagtaacaccaagggcaggtgggcaggctccgccctcctcccctactccaggcccactgcaagcctcagcccaggagccacctagatctcccaagcacctatggtcctggtacctg

SEQ ID NO: 529853 - DNA, 657 bp, Homo sapiens
tcctctatgcagactagcaatcaagcaagaagtcaacaacatactgacatagtttggatgggtccccacccaaatctcaccgttgcattgtaataattcccacgagtcaagggtggggccgggtgcagataactgaatcatggggatggttccccccatactgttctcgcggtagtgactaagtcacatgagatctgatggttttataaatgggagctcccctgcacatgctctctcctgcctgccactatgtgagacatgcttttgcacctccttgccttccaccatgattgtgaggcctccccagccatgcagaactgtgagtcaattcaacctctttcctttataaattacccagtctcaggtatgtctttatttgcagtgtgagaacagactaatacaataagttgataccagtagagtggggtgctgctgtaaagatacccgaaaatgtggaagcaactttgaaaatgggtaacagggagaggctggaacagtttggaaggctcagaagaggataggaaaatgtgggaaagtttggaacttcctcgagacttgttgaatggctttgaccaaaatgttaatagtgatatggacaacaaggtccaggcggaggtggtctcagaggcagatgaagaatttgttgggacatggagt

SEQ ID NO: 529854 - DNA, 419 bp, Homo sapiens
tttacctattattagtccattttcattctgctatgaagaaatacctgagaccgcataatttataaagaaaaaggggtttattggacttacagttccacatggctggggaggcctcacaatcatggcagaaggtgaaggaggagcagaggcacatcttacagggcagcaggcaagggcatgtgccggggaatcgccctttataaaaccatcagatctcatgagacttattgactatcatgagaacagcatgggaaaaacctgcccccatgattcagttacctcccacctggtacctcccatgacacatggggattatgggagctacagttcaagatgagatttgggtggagacacagccaaaccatattcctatgttgtttctaacccttgcagtgacccaccagcaaagaccccaaaag

SEQ ID NO: 529855 - DNA, 239 bp, Homo sapiens
gccagactgggttttatcagaacgggagcagtttaacgaattccgggatcttaacaaggacgggaagttagacaaagatgagattcggcacttgattcttcctcaagattattattattcacaagcttaggccaagcatcttgtatattaatcagacaaaaacaaggatgagagagctaactataagaggggaatatatggagagactctgaacaaagtttgtgcggggagacaagcta

SEQ ID NO: 529856 - DNA, 138 bp, Homo sapiens
tctagaactgtagtaggcaagcagccagactcactgcaaagtgggatgtgcgattcttgacacagaaaataagtaggattgactctaagatttttgctttgagacaaatggtcgtagatatagaagagtgcacttttg

SEQ ID NO: 529857 - DNA, 125 bp, Homo sapiens
ggatcggcggtaatcggtgagctcggtgtcgggtaagggacccagtccatcgccaccaagcgccaggaatgggcagcataagggaaggctaaggaggactgcaacaggttagggccctggagatt

SEQ ID NO: 529858 - DNA, 879 bp, Homo sapiens
gttcgcccacaacccttccacaatttgcggcccccacacatggtccccctccagaccccccacccgcagggtttcaacaaaatggagaaccttcaaacgtttattctatcagccttcttcagtcaaattgctcggcatccccgaacgtttcaacacttctccccctcccgcgggggcccccactctcaatagcggtctaaggtcccacccaaagcgccccctgctcttgccaaacatgctcccacagacatctctcctaatacacgcattctgcctccctaatatcttcggcaacctcttgactgaacttcccaccagtatttctcctcaactttgagtccccccatctctccggccgtggcctttccaatcttctattgccggccacactttgggaccacacatcaaagatcttttaacttgcccatatactagctgtccacacccaccagacattggcaccccacataacaaccggggccgcgccacaaataaagaggtgacaacattacttcttcgttactcccccgccacgcattatgtgaggtcagtaccctcatctcccctctctgtggatggtccaccacccaacgttctctaaacatgtcccccacagtgtctgtccccaacatgttatactaacttccattacattcacacacagcttatatctacaggccgctttttctctgaatagggaacttatagtccacattcatcccccaggtgtcttgaagtatccttcctcatgtgttacacacgtctaacacgcaactcaattgcatcccccccctaactcacgcggtgttgccgtaatccccatcttttacccaccacatgtgtttcctccgtcccaaacacaaattcttcctcccaaca

SEQ ID NO: 529859 - DNA, 248 bp, Homo sapiens
gggaggtcacacattgactccctgagcctctgctctccaggctaaagagtcccgaggcatcgaggccatttctgctgcacacggttctgtctctccactgtccgcacattcttagtattcctccaggctctggcaggagactcgcagtgcacaccacacgtattcagtcttccaccctcttgcatacctccaggacagagagcttactacctccaaggcagctcctgctttggctgctctacttacga

SEQ ID NO: 529860 - DNA, 1041 bp, Homo sapiens
  misc_feature (1031)..(1031): n is a, c, g, or t
atgacacatcgatcacttgcttcatgatcatagtagaaatgaagccagtagtacctactgacaagggcaccgactcgagccatccataactgatctaccgtataaacgcatagatgaatacatctctctatttacctagtagagcgctcgcgtcattcataggccatatcgtatgcgaactctcgtaacctagtgattgaccaggtgagtgggcagcgtatgtaggcgaccgatgaaaaggcagcatgtcctaggggtgtgaaacagctcgactggtacaccaaggacttgtcctcacgggatcatccttgattaaataagcctcgtcaggaatcttgggactcgtcagacacgagagtaaagcatgatggctctttacctccaaatgaaacgaacttagggcttgtaccggcccccatgtgagggagtggacatctggggcggcaaacatgtatcttatgttctcctaagagtacaacgtaaaatgtggcttatcagtatgctatctgttgcagcttttatcttcgacctgagggagatctcgagtcaagcatgtggacacacaaatgaagtcctcatatagtagaagatccgatgcaagtgatatcctaaagactccatgcgagtgttgctaaggggaccgcggctcgtaatttgaactcatcgtatggagccactcagagtggttagcctcaatccacgtatagatgccaacgtcgggatacgagggtggctgcattgttagggagcactcgcgggtcgatgcaactacatgtcagttattgcctgaacttgacccagtatgtgactgcgtcgacgacaatatgcatgttctcgatcctcaatttgtcaacagagcattggaagacatctggaagtggggccttccgcagtttaccatggcgggggggcagaaccaggtgaaccacctcgccgctgggggaggcacgaaccttggcgggccagaagaagccggccacaagtcctccggcaaaaaggcgggggacaacataatagcgcgacaggtcccngcacactacc

SEQ ID NO: 529861 - DNA, 883 bp, Homo sapiens
gcgcccctccttctcctcgcagtgcctcagagccgaatgcccgagctgtcggcggagccagagccgaggggcctatgggttgtgaagtccaccgtgaatgatgaagtcatcaaacgttttgaatgattatgaactgtatgggaatcttgctacacaagaggagatcaagacgagaaagaaagtagtgctgcttgcggtctttaagacgatgtacaaatagacaagataagtggtagaatggaagcttatgcaaatatgtggtgggtgacatgtggtggatactgtagaggatccgtaaacatcttctcgtgaagtggtagctctgaatgatgtcgatagtgcttgtgttagtgatgtaacagtacagagaacaagagagacgtctatgtaaaggagaggaccgctagctaatttataatgtcggggctctggtgagaaggtgcgccttgttaaataacgcaagagtgagtttatgcctgagttctaggagagtgcattgtaaaatgagagcattttaccatggtagttaacatatggagttggcgagtaaaagtgggttgggacttggatataaaggacaggtcagaaactgggagagaaattggggaggcagtgtgagtaggtttacactttgaaatggggaaatcgtagttaataaagtggacccgtgaagtggccattctgggttcttgaagggagggtttccaagtttctgcaagtttcagtcattgaaataggtattaggtgtcggttagggtgttttcacaccttttcgaatggccttcaacccatggactgggggaaatctctatttgagaagcttcagggtttggttactggggactgggattttttaaccaggagggtgggttttaaaagggtc

SEQ ID NO: 529862 - DNA, 320 bp, Homo sapiens
gatccttgacataattcccttacctctgtcgacctgtgaaactgaacaaacagcttatctgcccctaatgtgaaatgatggtacagacatagaataacactacagtgattctagttcaaaatgaggaacatggagggataaagagtcactaacccaatatagtttggaaatggagctggacaaactacagcaggagtttcttagttaggatccacagcctggtactgacctctgtcctgtgggtcttactgtggctctctgctctgcatttctgaaccattattattacatttcccacaatcttttgcggattgctccca

SEQ ID NO: 529863 - DNA, 469 bp, Homo sapiens
ggcccgcccgtttgcctcttttctggcgagacctctggattgggctcgccgtcgtcttggagtgacgtgtgataagcccactgtaagggggtcccgtgagcctggttgactatggacagccaatcttatgaatatcctgtccctggtacgacatggctgtttcccgcgtggagtgcaagcgttccgtggacttgtggggagtcgtgaaccgaggtcggacgttcctcaacaaatggctcagctttccgtgagcgcctggaccactttagcggagaacatgtgaggacttctccaatgatcctgttcagcagcttctttgatgaccctgtgtctggattgaggaagagccctctatttggatcatggaactggactcccctacgaccaggcattcattgcggtagcacagctactccctgagcggcgactcagtcgccccagagcccccttgtgcccatcaagatggagg

SEQ ID NO: 529864 - DNA, 898 bp, Homo sapiens
ggccatctttccagcctcagtcggacgggcgccggagacgcattgctggaaggaacgccgacgatggtctgcgcagaggcagagccccaggatccagtctcagacttgtattggtctggtgatggtggtactggaaaaaggaccttctgtgaaacagtcatttgagtggtgaatttgcagaagaagtcatgtagctcagcctgtgggtgatgaggtttcatcacggtagatgtgtcctacagcaacagaggatctattaggttcgaatgtcatgggacacaggcgtgcgggagcaaattctggttggtacgtgacgagatgtgctgattgatatccgaaggccaggttgtggcatcgataatgttggatgtaaccatcgagagtttagttacaagaatgtgccgtagactggcgatagagatctgggtacgagtgtgtgaaatacatacccataggtagtggttgtgggaacgagaagtggaatattgaaggacaggaataggtgagagaggaaaatccagtgataataccgaacgacaagtaggaatcgttcagataacgcacagaccattatcttgacctagaaatgttcactaacgaacactgtgtgaaccaaagacccattccctgcgtgagcttgggcaaggaactgctccactgtggactgaagccattaatcttcgagaaaagtgcgggtgtggcatgtggtcgttgaactcggtcggtagacccgagctatagaaaggattaggatcaaggggtataagcgcaagagtatttgggcaaagggatgagtcaattgaagtacagaggacctttatagagtgttgggatctagaaggcaaagatgattcatcccgtgattgagggaattgattgagcatggtgaggaagtgaa

SEQ ID NO: 529865 - DNA, 1252 bp, Homo sapiens
ggtctctagctgtgtaacctcgtcagaaccgacacaccactggggcatacttccgatcaattcctccgaacgcggctccgagttcctcgacacgggtggaaggcgtccggcgagcactcgttgcacggcccactcgtccgtgcgttcaggcagctcgacaaggaacgtgtccatccgtgggtgcccaaactccattaattgccaatgaaatgcgaatgacgctcgaccactagtactgcaatagagtataattccacactgatcgcttggaggccacgagcgatcaaacacgcccatggggccctacatttatgcttaccctgtcaaggtcacctcgctaccacccataaactctcggtctcgaggatttctatttcgcgacctgtgcgaatgcagtgcttcgcatcgtggctaacgggtcgtagaggcgccatttttcgtaacccagccatacactgcccgcgagggaagaaggcagccgaccggcctacgtaaacggtcgtccaatgcagaggattgcaagacataacgcattgcgtgggcaagctcgccggcgtactctgtcacaggagagcgatcctagaacctgaacatttggcttggcaggtgcgaaacgtatctagaagctttactggagccagcactcgacgcaaaatgtcctttaggtccctaggaggtgcgaaggaagagttgcgcttgaacgcaatgtcacgatcaagcttaaaaagaaggcagggagcgcgaaaaggacgtgctccgtgtgtcatcggtcacctttggcctggtctgacaactccccctttctcgggaacaatctctccctgcgcataggtggtaccctatgcccgtaaggggcggaatgggcctagcgacacgctaatcgcgacgtaaggggaaaccaaagcggcatggcccaaccccaagccccacctttgcgcggcccagtaatccttcgtgttcttgtctccccttttttggccccgagggacaccttgaggctgtggcttcctttccgggcacctttccagggagccccaacgaacttgccaaacaagcggcgtcatcccctgtgggttcatttccacttgtttatacacggcccgggggtcccctttgccttgttagccctccaagacacttccgaagaacgcttggtttcctggcacggggttgaaccttgaattcacaacctagaataacaggggccaatccttcaagttacagaatgccaattggcgccttaagggtcacc

SEQ ID NO: 529866 - DNA, 142 bp, Homo sapiens
gaaattttcccatttgaattttttaattgcctggcaaaagctgaaataagttttaaaaaatcagcaaaaagatttggtgaattcattacaaccccgttatgtccctttttgattccaaaaaaagttttcagtaaacttttca

SEQ ID NO: 529867 - DNA, 166 bp, Homo sapiens
cctacgtcaaaggtactctcatcacccgatatctaagcggtttacaatgctgtacttcgcgaaaataggataagactaccatggtttgaatagtttgttttctccaaaactcatgttcatatttaatttgccccatgtgacatgatttgctcaccgctaattaact

SEQ ID NO: 529868 - DNA, 868 bp, Homo sapiens
  misc_feature (79)..(79): n is a, c, g, or t
actcaggggtgtttgtccggcggccagaaaataattctctcgtgttttgtggcggggggcccccccccccacccacaanttgcggaggtgctctcgcctcccccacctcaatgcgtgtgggggagataggccgcccacctctttcgagttgtgtctcgcgctgcgccccgcacacttcgtcgcggaggttagatgccctctcgctgtgctctccccccgcctgcactccaccacacagtggggcgaagaccattttggagaccccctcctcttccccacggtttggtataatttttctggggagagctctcccgccccacaaaatggtcgacgcgcaccccgttgtgccctcacacacaaggaggaaggacacgcaccggggtgaaaaacccctcgcgtgacaacgtgcgtatctgcgaagagggtgcctccaatcacaccccatggggcgaaggataaatccgccgggccagggagccaccccccccaccaagtgcagggagggcccgccccccctcgagtctctcttctgtagtagcacccgggggtgtttcaccgctcgggacaatagacgcactcactcggccacacacaccgtcgcgtccccccttgcagggtcacaccacacagtgcggttactctcagcacaggccgacgcagccccggagacactctcctcccccgaggataaggggtgtctctccccttcgccccgcacggacgcaaacaacaagacggcccccaatatattggccggccccccaacgacgccccgtgggtgaacaacgggcgccccgaggggaacacatgcgcaagcatcgtgttcacgaactgtcaaaaacttgggccgggtaaaacccacaaaaca

SEQ ID NO: 529869 - DNA, 173 bp, Homo sapiens
ctgggattatagatatgagccactgcatctggcccacatcactctttatttaaattgtcttatttcttgtctgactcctatctagattttaagtttctttgggatagagactctactattcagtcatcactttttttgaggtgggaggagaggaagaggtgggaggagaggaa

SEQ ID NO: 529870 - DNA, 264 bp, Homo sapiens
gcaggctgagggcaggtgggaagcaaacccggacggatcgcagcagcagcagcagcagcagaagcagcagcagcagcctccgcagtccctccagagacatggttccccagacagcaccttcccgggcgttctgctcctgttttttttgcattgggtttcctgggggggcgttccccccctggggagccccgttcagctcggatttgaactgccggttacaggcaactttcggactgcagtggacagcatcctgggccctcaggg

SEQ ID NO: 529871 - DNA, 355 bp, Homo sapiens
  misc_feature (54)..(54): n is a, c, g, or t
  misc_feature (82)..(82): n is a, c, g, or t
  misc_feature (136)..(136): n is a, c, g, or t
  misc_feature (151)..(151): n is a, c, g, or t
  misc_feature (160)..(161): n is a, c, g, or t
  misc_feature (212)..(213): n is a, c, g, or t
  misc_feature (217)..(217): n is a, c, g, or t
  misc_feature (241)..(241): n is a, c, g, or t
  misc_feature (269)..(270): n is a, c, g, or t
  misc_feature (274)..(274): n is a, c, g, or t
  misc_feature (281)..(281): n is a, c, g, or t
  misc_feature (306)..(306): n is a, c, g, or t
  misc_feature (335)..(335): n is a, c, g, or t
ctccatgccgccttcgccttggaacctgggaaagaatatttgatcatgggtctngatggggccacctatgacctcgaggganacccccagtacctgctggactcgaatagctggatcgaggagatgccctctgaangccttgccggagcancgccagcgnnagcctgtcccagctcaacgacttcctccaggagtatgcactcaggggtgcnnggtntgagggctgccctcccacctccgntgggaggaacctgaacctgggaaccatnnaagntggaagnactgctgtgtccgcttttcatgaanacagcctgggaccagggcatattaaaggnttttggcagcaaaaaaaaaa

SEQ ID NO: 529872 - DNA, 236 bp, Homo sapiens
  misc_feature (51)..(51): n is a, c, g, or t
  misc_feature (102)..(102): n is a, c, g, or t
aggggcaggcactcggggcgggaggcagtcttggcttaaccataaaaaggncggggaggggaaggggccggaactctttagagctcgtcctttgttctgaangcccggttaccatttcgcttgtgtcacccgtttcgggaatcgaggagaatccctgtatcagctggaaaaccgttttgggaaacttgttctccttttgaagaatcccactgctgcttggactaggactacctctg

SEQ ID NO: 529873 - DNA, 582 bp, Homo sapiens
  misc_feature (20)..(20): n is a, c, g, or t
  misc_feature (79)..(79): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (95)..(95): n is a, c, g, or t
  misc_feature (103)..(104): n is a, c, g, or t
  misc_feature (109)..(109): n is a, c, g, or t
  misc_feature (113)..(113): n is a, c, g, or t
  misc_feature (126)..(126): n is a, c, g, or t
  misc_feature (128)..(128): n is a, c, g, or t
gaccaaacgcaggaggaggngttctgcagaggtcacagggaagtcacagaacagtaatacgctagcaggggcatggggngtgangaacanaanangagagganncgttnccangcctccagagaanantcaaggccaaccaaagcttcccgggtcacagaaccaattcttttaccaggcagtaccactgctgtcatttcagcttctgggcactgggaggtgctgctcgaaagggtttgacatgagaatccaagaagaagatgcgggaaggacagaaggggtactggggttttagcatctggcacaggagttatgtgtaaataaccaaagggagaaaagtatgaaccaagatataatccaatcggagatgatgagaataacgaagttattacggaaatggtttagcttccccgcaggatcaggaaagtttgagaaaagcatctgcagctgagctgccagttcctctgagtcctcaaagaccaggccattttcttcatgtttcaccagctcatgtaaacacttgaagttcacagcacacacaggcaaacagcacccaaacatgtccaccaccttcatgggcagg

SEQ ID NO: 529874 - DNA, 947 bp, Homo sapiens
atagagtcggccaggtggctgcttgcttcctgctaatgtgggggacgtgagacagatctggaaaggcgtctccctcagatggtttgcatttaatgctttatactgccgagtctgggggctcgtcttggtttgtgggtgcagccatcctctcaccagacagggggagctccttccgctgtggctccagattatgggtatgccgggttccaggccgaccagcacttgggatctgatgggacacggcagtgcctaggggtgccaagtccaatggctcccaagtgggagtcatcagcgtgagaagatgccaatgtttcagtccacctggctgcacgaggcgacaaaactcccacacccaggacggctgtgatgatggtgtgccctcactgtcaaccctggtcgctggagtccccagcaactggggccctggtggggctgatgtctcaggtgtttactgtgctgctgcaactggtcgctatgccagcctcaacccatgtggggaccacggaaggcacactcccttacccccggtgtccggccggtgcggtcccccagacggacatgcagctgtggcgacctgcgtttctccctgggctgtgcttctgtagttagtccggccctggttcccttgtgggtcaaagccgcgttccatggcttgtacatatgtgattgctgtgggcaccccaagacccatgttagctggcgtccgaaggtacaaggcccgtccgattgttttaccgaggtgttgccctaggtctgtatgggactggcctgtaggctgccatacaaaaaatgtgtcttcccacaaaaaaaaaggggggtctaaaacacacgcacagagcaccttttataggcagctaggaaaaaacgagcgtactacagaacaagtagtacacactggcataaacacaccttaattaatttagtgtaacattcacaaatcacatcta

SEQ ID NO: 529875 - DNA, 696 bp, Homo sapiens
agctgagatcatggtactgcactccagcctgggcgacaaggcaggacttcgtttcaaaaaaaaaaaaagaagggtgcttttacacagtgatcctagtttactgaaatgggactgactccgggatatgcgtctgatagctggccactcctatcctatcctgttcctagccttggtctatttgggctgcttataaccaaaattaccattagaactggggtggattataaacaccaggaattgattcctcacggttcgtggaggctgagaaagttccaagaaacaaggaactggcaatgttacagcgttctggtgagggctgtattcctggatcgtaggtgggtgtttctcatgtgtgtcctcccatgacgtgacgacatgggcaaagcaggcgtctctcaggcctcgtagtgtaagggtactaggtcccattcgatgaagatgcagcctccctgacctaatcaccttccaaaccctcccttccttccttcctagcttccttccttccttcctagcttccttccttcctagcttgctgtgcttgctggcttccttccttccttcctctgtctctctttctttcttttttctgaggcggagtctcgctgtgttgcccaggctggagtgcgatggtgtgatcttggctcgctgcagcctctgcctcctgggttcaggcgattatcctgtctcgcgctccca

SEQ ID NO: 529876 - DNA, 172 bp, Homo sapiens
gaatataagctcgtaccagtgaatcgactcgggtatggaggatcatctagaagttgaccaggctcagcttaacgatatatggaggtcagcacggtgctcacgtagacgacggaacttgtacagggaggcatagcaccgcattggtagaatacacgtacgacctaggctccag

SEQ ID NO: 529877 - DNA, 320 bp, Homo sapiens
  misc_feature (292)..(292): n is a, c, g, or t
gatggaggacagccagagggacgaccggaccctacttctggtcccgccttcagacgatgaccatgccgttggcgacattggaggcgacatggttatcagcgcagttgacgctgacatcaagcacaggcgcactgtggccctgcagcatcgctgacagcagccttggtcgcccgatccacatcagagaagcgcacgcgacagcgttctcactgacagacaccacgcaggccccctggcggaaggcatgaggcagccaagatgctgcgcacaggatgtgagctctgcttagggnggaaactctctccagcgttgcgagcgca

SEQ ID NO: 529878 - DNA, 295 bp, Homo sapiens
tgagatcactgacgcgcaccaccacgcccagctagtttttgtatttttttttggagatgaggtttggccatgttgcgcaggctgatctcaaacttctgggctaaagcaatctgcctacctcagcctcccagaatgccggggttacaggtttgagccactgcccctagcctaagtttggctaagttcctgtttactacactctaaaattttaaatggaatttctgtttttgggtactaagggtttttggttggttggttggttttggttttggttttaggctccttggtcgtggct

SEQ ID NO: 529879 - DNA, 130 bp, Homo sapiens
agaatctattttcacatctaaaagaacagatagagcccgacaggtgatgcaccgtcgagtaaaaataataagaaaaatacatacagttgggaagggcatttggtgcactggtgagcacagtattttagaa

SEQ ID NO: 529880 - DNA, 962 bp, Homo sapiens
gtagtaaaacccagcccatgacccctaacaggggccctctcagaccctcctaatgacctccgtcctacctatgtgatctcacttccactctgtaacgctcctcatactaggcctatgaaccaacacactagccatataccaatgagtggcgcgattgtccccccgagacaagcgacaataccagggtccatcgacaacaccgacctggtcctacaatagaggccttcgatacgggcaataatcctagtattattacctcagaaagtatgtgagccttcgcaggatcaaactgagccttggtaccactcctgcctagttcatagccctaaattctgatggccctggacccccaccagggaatctcgccggtaaagtccccgtagacacgattccctggtccataaactaatccggtgaattagttcgccatccaggaagcattctatctaacttgatccccgcggttagatcgagctatgagcaaggatcgaggaccgaatataagcttggtgccctgctaatgattatttaactgagtcacgatataataccactcttaccatgacgtaagaatatcacaatggtgtccctatatcacattcgatgcatgtgtacaaaagtctttaatttaatatgtaggtttcacaggatggccacgtgcatcttgcacgtcactccatgttctacattgtttgccttcattactcagaggtgcaatcgtcctgtctaatgatttccctttttttcctaaaatcaagttcggtcgaacgcgagagtggcacctgtccacctcatagaaatacggaaacccacaatggcggaagtgcatattttgatacaaaactctgggctaccccaattccaccatacgggggccgaaaaaaaacggccctagagtgctgtgtgggtcccaccccccggtgaagaagtggtacactacaagccagagaatctcaaaagaa

SEQ ID NO: 529881 - DNA, 938 bp, Homo sapiens
gaaactgtgcctgctctgagagagtcgtgtgtgatgtgatgtcttcctgtgatacaaggcgtagctggggcaaagagaaatacggtgtggacctggatgagatcaagccctcctcggcccctgatctccagggcgtgcgcctgtttgctgactacctcgcccagcaatagtcgaaaggacgagatcgtggtcgagatggaccgagagataagcaggactgtggatcgtgaccaatattgcagcattcctgtcatcatggacgactcgcatctatctcgcacggaggcgatgaacccgtgatgtccgaccatgcgtgggcaagaatcaccagtggtggaacattgcctgggagatgctgccaagtcatgaacaagttgcgggatcctgcatgaagcatggatcgcgtggacctcgcccggaaggagctgaagagaatgcgaggaccgtgggaggaggatgcccaaccatcagccagttcgccaatgcgtgggtcagactggagcacgggatggtgaggaagcgtgaggatgcctactacatcttccaggagatgggtgacaagtgctcgcccaccctgtgctgtcaatgggcaggcggctgcacatggccaagggccgctgggagggcgtgagggcctgtgaggaggcgctagacaaggatagttgggctaccccggagaacggctggtcaaacctcatcgtcctgttgccaggaacctggggaagcccccctgaggtggaaaacccgatacctggtccaggagcccccatctggtaataagtatcttacgtcccacagagagaaagtagtctaaaattccggacagaaaagagcctaaccaaaacacgaaacaaacaaataaactcaacacaaataatactagtaacatacttatgaaagcaggtatatcaacaccaatatagggagtataaacccac

SEQ ID NO: 529882 - DNA, 285 bp, Homo sapiens
tcacttcgagcttgtacccgtgagccatgatcacaccactgcactccagcctgagtgacagagcgagaccctatgaaaaaaaaaaaacccagattctttcctggcctccccgttgcaattctaaacagcctcggacccattatcggtttggcggctggggggatctttaaaaaatgtaattcaggatcaggggcctcctttttaggaaggggagaacccccttccagggccttccctttgtttaaggatccagatcaggatcctcactggggcctcccagggcca

SEQ ID NO: 529883 - DNA, 485 bp, Homo sapiens
  misc_feature (88)..(88): n is a, c, g, or t
  misc_feature (96)..(96): n is a, c, g, or t
  misc_feature (176)..(176): n is a, c, g, or t
  misc_feature (355)..(355): n is a, c, g, or t
  misc_feature (368)..(368): n is a, c, g, or t
  misc_feature (442)..(442): n is a, c, g, or t
ctgactgtaagttccacaacagtagtaatatacaaacatcaagtgaagtgcctgacctatatttacaggttgacattttttgaatgantgtctganttttagatttaaaaagtattggccagtcgtggtggctcacccctgtaatcccatcactttgggagggcgaggcggggggntcatttgagcccaggagttcgggactagcctgggaaacatggtgagaccacatctctacaaagatagaaaaagtgagctgggtgcggtggcgcatgcctgtcatcccagctacccaggaggcagaagtgggaggttcggatgagcccataaagttcaaggctgcagtggagctatggtncttccagcctggnttgacagagtgagacctggaccctgttttccaaaaaatggcatattttaaatgtacatatattacatgttatancacaacaacacaacacattacaacaacacgtgtgtgtattata

SEQ ID NO: 529884 - DNA, 155 bp, Homo sapiens
agcctgcccaacagcagggaagccaagcacccatttatccccctgcccccatttgattgggtagttgaaaggggaacagtgccatgtaccacacaaatgttcctgtttccttgcatgggcatagggacccatcattgatgactgatgaaaccatg

SEQ ID NO: 529885 - DNA, 291 bp, Homo sapiens
  misc_feature (194)..(194): n is a, c, g, or t
cgtcgacatacagtataaacaagttgatatacgatgtgagcaaatgaggtgagataagggaggtaaaggcaaaaaaaggccatggtggcaaagtaaatacaatatagcaagtaaaacactggaattgtacatttgcaatggaagaaatgtgcaaagtagaaataaaaataatggggtgcataggagcaaaatanattcattaaatacagtagggaaagagctagttgtttggcctaaactataggtgggctatgtacaggtgcagtaatcgtcgacgcggccgcgaattta

SEQ ID NO: 529886 - DNA, 217 bp, Homo sapiens
gtagctgggactacaggagcctgtcaccacgcctggctaattttttgtgtttttaatagagtcagggtttcaccatgttgaccaggctggtcttgaactcctgacctcaggtgatctgcccacttcggcctcccaaagtgctgagattacaggtgtgattcactgtgcctggcctcagttgaactctttaagattattcaactcggggatcctctag

SEQ ID NO: 529887 - DNA, 257 bp, Homo sapiens
cagcaatgtatatcagccggtagtagcggcaccatcgtgagccttctcttagaggtggctggtggcaggaagctgaagtcgaaaccagcgctgggagtgaccagtgtggaccaggaggtccagtgagggccgggggtgaccaacaggaccagcatcaccacgtgcgacctgcgatttcttgaatggcacggggatccgtctacgagtctgacgctgcatggctatgcaatgcttgtgctactggcctgtctgtttta

SEQ ID NO: 529888 - DNA, 943 bp, Homo sapiens
aaggattacagtttctaatacatatacactgaacctcgctgtaggttgaaattaggtgtacctcgtgtgttgtggtacccacgtcttctaccaggtaggctgccggtgcgtgaggattcggattacgcgatgcatggactgtgttggaagtcgcggtgataatgtcaaagatagtgatcacactgatgatattctagctgttggaggaagagatatcctcatatagttcaaaagaatgaagtgtaagtgtatgtgtgggtgttcggtgtatgtgtaacgagaaaaatagagataacgagcttgtatgcgaattatttaatcccgaatagataatagcgtggagggtgagtacattgggggtgttctagttgatacctggttttgtaatcaattgctcttgttgttggaatcttcttgttgaaccatgtgatctgtgagtgtagtaagaggtcgagtatcgtatgatgcactccaaagggaattggcatgtcttagcatagatggtgtctgtgatgtcctatgatgagagcagcagcgacatgacaatggggcataggaggaacgttgtgacatgtcgaaggttcgcataactagtgatgacattgcttgtaagagagagagcgaagttgatatggtcatagactgggattaggtgaagtgaaggcatgggatcttagccctgatatgaacgtggtatacgagttgaattgtgtgatctacatggttacatcatcgagatcgtctcggttgccctcgattatacaccacatggaaaggtcatttcacatgtctcgtactgcagtttccgtccgaacttacatgcctttcagtgctttgatcaaagcttgcattcaagtggtcctgggcagggccgaccacatagtgggttgagatgccagctcgggatggtgacgggcagcctagcattgtgtcttgaaggccc

SEQ ID NO: 529889 - DNA, 237 bp, Homo sapiens
  misc_feature (25)..(25): n is a, c, g, or t
  misc_feature (92)..(92): n is a, c, g, or t
  misc_feature (217)..(217): n is a, c, g, or t
  misc_feature (233)..(233): n is a, c, g, or t
attgcggcacagggcgctggcggtngtccggaccttgagcgcccggaacaccgccctgagtcaccccctaccgctgcccctggagcccccgncccgcactccccggcaccctcgcctgaccttcccgcctgtcccccaggcacgggcgaaacgcagcgctgggcactctggacttctacatggcccggcttcacggagccatcgagcgcgaccccgnccagcacgagaagctnatcg

SEQ ID NO: 529890 - DNA, 939 bp, Homo sapiens
cgcgggcaacacggccagatgtgcgactggaagactggctggcgtccgtgcgtctgtctgggccgttaccgccggggcacaagtgctattgcgcgcccgacgctcgccggccctgctgtggacgccagtcttgcggagtacggcaaccttcgctcaggcgctccagttcgtgccggatacgcaggttagccttctggtcaacggcctgcgtgtggccttccgaggcagtcctctctagcccacttgctcggtgggacgctgtggtattgactgttgcgcagctctgttttgagcactgatgaagactattggggcatcgctatcttaatgcgagcatctgtgctttcagatggtgaacaacagaatcgagtctggacagtgccctggcatgaaggatcgtggatgagcagtggcgcgtgtccctattcttaagttgcctacatacatcccgaggagacatcacaatgactttaactaatattacaaggcccgtctgtcgcaaggattctagctcggataagcttgttggtagctccttgggtgacattgtgctagaacttgtgatgtcttggaaaactcacgagatcgaggaatggaaccgtgatgtgatcctgtgggagatgcatgagaaattatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaagggccccttcgaatggtgctggcagcagcttgaggagttgagcaccagcaaatgttagacctcgcccaggaacacctcggtgggattccatggacttatgcagaagaacgctgtgcccacttttactccatgcccgttcaacttggcattgaagatc

SEQ ID NO: 529891 - DNA, 146 bp, Homo sapiens
ccgtagagggttggggatatgtctgcagtgagatgaggcgacagctaaaacggccgggtcgagaaaccactgggcttttgcatgggtgtgtcctgggtttgttgtaataactgctactggaaaactgtgctaaacccaaaaacagg

SEQ ID NO: 529892 - DNA, 161 bp, Homo sapiens
cgcaatactattagttataataaacaaccctcaccacgtacatactcttcctaggaacaagcatatgagagcattctcccctgaaactctacacaaaatattaggtcaccaagaccctactactaacctcccggtactgatgaattcgagcagcatacccc

SEQ ID NO: 529893 - DNA, 267 bp, Homo sapiens
ctcgagctcggaccacagtgtatatctctgtacactacttgcaggctgagattgtccaggggcaggggtcatgcctgtaatcccaacactttgggaggccaaggtgggcggatcatgaggtcaggagattgagaccatcctggctaacacagtgaaaccccgtctctactaaaaatataaaaaaattagctgggcttggtggtacgcacctgtagtcccagctactcaacaggctgaggcaggagaatcacttgaacccgggagacg

SEQ ID NO: 529894 - DNA, 132 bp, Homo sapiens
tacccgagagggagacatggtgaagagaagtaatcaccctacagtctcattcccttaggaaggcagtttaccattcaaagagaagagttatctgtcagtaaccatattacaaggcagaaggctataggtatc

SEQ ID NO: 529895 - DNA, 808 bp, Homo sapiens
attaagatcttatggtattggtagcagatcctactctagagggtagattctatttatgatcgttggtctgtgggaacttagaatacagatgaaactcttctcttattatagagtggagtttatagagtaaaaaataaatagagatcccaaagccaaggaatgcattcagttaaggttctcataccaatgctggcctgcttgcattgcacattctgtatactaatgtaaacatttgttctacctgaaaatcaaaagcaagatgtgagctctttggctaaacctgcattgatatgtcaggcagcaaaactcagtgttgagattatcaaaagccttctaatatgcccttataggcaatcctgaagcattggttatcatcagggagatgtggccaggcgggtattccgggctccccctccaatctcctttatacacccagccccactcctcagccctcacttaattttagattatataagtagcctgtcaggaccaggcaagaggtgcctactggagggtctgggtagaagcggtaactccattcctttcccttggggtcccccaagaggtaataaaaacgtacctggaggagaatacgtcacggtgattgacactctgctgtatctctgactggtgatgtaggtgcagacaccgacatggccttgcgtagatcctgggggtatcagtaactgaagcttgacacaaggcattcttccctcgaagcaacagcatgcattaccaagacataagactttaactaatcgtatggcctagattagacaaaaactggttgaaagtcaaccatcggtca

SEQ ID NO: 529896 - DNA, 148 bp, Homo sapiens
ttatccccacacgtggcttcactggtggggggctgtgaccccacgggcaatcctgctacccgggcacgtttgtaccttgtgagaggtcctcctcagtcttgcgcgatgctcgtctacacccatgagccccacgtgcaaatcccatggc

SEQ ID NO: 529897 - DNA, 100 bp, Homo sapiens
ggtgatctagaggatcccaactcagtgtgcgagctgctggcgcccgtggcttgtgtgtgtggttcccttctggtgccctactcgggaggttgttgctttg

SEQ ID NO: 529898 - DNA, 836 bp, Homo sapiens
  misc_feature (123)..(123): n is a, c, g, or t
  misc_feature (412)..(412): n is a, c, g, or t
  misc_feature (421)..(421): n is a, c, g, or t
  misc_feature (441)..(441): n is a, c, g, or t
  misc_feature (469)..(469): n is a, c, g, or t
gagacagtttgaagttttcaaagactggctctgctgttaagaaagtgtacttaaagcggaggagctaagccacctgccaaaaatgtgcaaaggacttgcagcttgccccactcatgcctggangggccaaggagattaagatcaagttgggaattctcctccagaagccagactcagttggtgaccttgtcattccgtacaatgagaagccagagaaaccagccaagacccagaaaacctcgctggacgaggccctgcagtgggtgattccctggacaaactcctgcagaacaatatggacttgcagtttcaaaagtttcctgaagtctgaattagtgaggaaaaccttgagttctggattgctgtaggattcaagaagataagtccctgcaagatggtgaaaggaaagcanatttatgangaatcattcaaacggaggtnctaaagaggtgaatattgcccttactanggcatcacaatgaagaacctggtggaaccttcctgacagtttgcatggccagaaaagaatcatgcctgatggggatctctgcctcgctttgtgcgctctgagttttatcaggagttaatcaagtagtaattaggcaggtatgaattctctgtgagtattctcataataacctggtttcccataattaattttttccacagaggttgtcagtgtcccctggaaatccggggtggtaccttgccccgctggattttaggcgaggttttcccaattcgcgttatagattctcggtgggacaaagaactctctgggaaagaactcttgggacaccggcaaggtacgcatgtttggcccacaaggtaaactc

SEQ ID NO: 529899 - DNA, 517 bp, Homo sapiens
  misc_feature (130)..(130): n is a, c, g, or t
  misc_feature (157)..(157): n is a, c, g, or t
  misc_feature (191)..(191): n is a, c, g, or t
  misc_feature (258)..(258): n is a, c, g, or t
  misc_feature (299)..(299): n is a, c, g, or t
  misc_feature (318)..(318): n is a, c, g, or t
  misc_feature (472)..(472): n is a, c, g, or t
tgaagtatagatgaacagccctgtcccaaggaagagcgcaagccgatcatcagcatcttgctctgtgcagattcagaccgtgcactccattgcactgtgagagggctcatcatgcttgtgatgctccacnttggcagtgtgtataacctctccactnccgagtgaacttggtttccagcatcaccagtggntctggaagtgtccatgtctcctattctggtatcagtgcctgtgtgacaccacccacatgccttctcnttcctgtgcccgttccgtgaaccacctgtaacttcaatgtnctgcctggatagaaaccanttcacaggagcagaccagtgaggttgtaggttgctgcagggtgctggggtctttgaacggatacacagctctaccttaggtttggactcgcctgctgcactgtgaagctctccacaaccccgtagttgtatctgcagtaagtgtccacctcggnccgcctccgctccaggaggtccttctggctgttccaggactcgtc

SEQ ID NO: 529900 - DNA, 110 bp, Homo sapiens
gaggaaagcagacaattaccctaccaagagggcgggagaacatacaataggaataagggtgaccgatgttaataaccaacatatgaagaactcaaagccaattacaaaga

SEQ ID NO: 529901 - DNA, 244 bp, Homo sapiens
agataacgttttctcacattgagtttagaagatctgccttgtcggggaagccaaggtttgtatgtgagagtttaaatctgatgtgaagctcaaaaaaaaaaaaaaaaaaaaaaaaaaaaaaaaaaaaaaaaaaattcttgggtaataatttttggtttcaccccattttgggattaaaaaagggcaaaaaaaagcagtcccacagaaataaaacaaccctcttattataaactggaccattcac

SEQ ID NO: 529902 - DNA, 891 bp, Homo sapiens
  misc_feature (16)..(16): n is a, c, g, or t
agaccctgatatggcncagccagggtggtgagagagtgtgagcacgtttgtctgacccacctctcggggcttcccctacgttgacacccgttgccgagatgggcctctcttttgggcccactcaaatttaaatggtgagggcctaagcacacctttccgccccgtttcccttcccgccccagttgtggttaccctgccggccctctttttacatctttccgggagtttatcttcaagccctccttacttgggggcataactcctttgggaacgatgccccccaaggggtttctgatatacaaacgctttcgggtactcggacgatcagtatttccgccctgcgggcccgttcaccaccgattccagatggcaccacggccccttggcattcgcaccatatgagaaccccccccacggattgcggggtgttcacaaaagaagccccgagtgcgtgagtgtatgggtgccaccagaagaccggcgaattgttgggatagatggagtacatccaccacaatgtttgggcgagaatcaagaacacgcgtactagaaggcaagtcctgtattaacacgatcttgacggaaaccccatggtgcttccgaagattataattacggttagaatatgtgcaatcccgtcccgcggctctgtgcgagggcaacaccgctaccgcacccacgccctcataatcggtctaacaagatgggcacaacaattgcaggtagtacccttagacttcaaggagagttgttcaaaactggtttcaccatggagttatgaggaacaacccattcttcaaatagcggccgtctcccctggggcgacccctcagagagttcgggacttggattatttcctccaaaaaaacccccccgtttttcatagacaca

SEQ ID NO: 529903 - DNA, 499 bp, Homo sapiens
actcaagacactggggctgtagatcaacccaacaccactcctcttccaagaatcatttggacaggttctttgggaggaactccttcgtcttttaaacccacccttttaaaaaaaaaagggcaccaaagaaagacgtgaagaaacctgtggctgcggctgcggttgccccagcccgggcaccggaacctggcaccttgccccttgccccagccaaacccaaagaagaaaaaatggacctctctgccattaagatcgagttctctaaggaacagcaggatgaattcaaggaggcatttctcctgttggacagaacaggtgattccaagatcaccttaagccaggtcggtgatgtccttcgagctcggggcacaaatcccaccaatgcagaggtcaggaaagtcctgggaaaccccagcaatgaagagctgaatgccaagaaactcgagttggaacaatttctggctatgatgcaagccatttccaacaacaaggaccaggc

SEQ ID NO: 529904 - DNA, 902 bp, Homo sapiens
agcggggatagatcttcccggtacccgacttcccggttgacttgttgcggatgatcgagggcagccaggatccggtgaacgatcacaagaatggctggagtcgatctacttgtgtctcaaaagatcattgactgcagtacgcttttgacagagatcattaccccagaaccataacgcgcatggactatgtatccgctgaacactcctggacatgagaggcctcgaacatccagggtatggactgcctattagctgacgaatccagcaaggctatgcgactgtggactatacatacaaggggcgagatgtgtggcaaagctggcttggtggatgactttgagatgaagtacattgcgctgacggtacccgtgccagaggatacctctattgcccaggtggatgccgaagaaaatagagaatgtgaatatctagtactgagtgggtgattctctcaaaggccagtgattgtagaatagtgagaagagagatggagaagatgagagaacgtgtaattccattttgatcagatgaccattgatggacttgaatgaatgctttcccagaaaccaaagttagatcaagaaaaagtatcccctattggcctgcggcaaccaattgagaatttatacacaattgagtccaggaggaagctctggtcctgtattacaaaatatctggacattaaacaataataattataccaaaaaaatgaagatgacccacaagtatctcgagttggtcttcggaccaaagggggttgatctttgaaagggggggggccggaaagcaagggttaagatccgcggaaggggagggataaaatttgcagagccctggggggacattgatggcgaaagctgtaaccgggcgatgaagttgtaactccggctcactgttcctgc

SEQ ID NO: 529905 - DNA, 204 bp, Homo sapiens
aaaaaccgggggtttttttttaaaaaaacccaggaaataaatctaggaaaggggttttttaggttttggggtgtttaaaccccaaaaaaccccaatttggccggaaccagggggtgtttaggtataattccaagggggccgaatggggaaaattcccccccgcccaaaaagggccatgaattaaaaggcctgcccctttttcca

SEQ ID NO: 529906 - DNA, 112 bp, Homo sapiens
ctgactctagagtatccctccgagttcgcgactactagcttgcgcaattgtacctggatttatcatgttgcccaggtaggtctggaattcctgagctcaagtgatctgccag

SEQ ID NO: 529907 - DNA, 380 bp, Homo sapiens
ataatattaattatacatgtaaataatatacatataatttgtaaaatactaatatatagtaataacacagtaagggaagatggatagagctgtagagacacagatttgtatgcactatcgatgctaaggtaatcataattcaatctattttgttataaatttgaattaccaattttagtgtccatgttagctataaatatgtaactaaaattttaaaaaaaaatcagcatgacagctgaatagatgtgcctgcattcgtcaatcccatatgacggaatgacagaattgaataaacagctaagactagactggactgatgaaagggagaagtagaggatagcaggggagaggagaggtccctgtggttattagaagcccaa

SEQ ID NO: 529908 - DNA, 1077 bp, Homo sapiens
  misc_feature (318)..(318): n is a, c, g, or t
gaatgagggcggcgacggaggtggtgactgatccggagcccggcttgacgggatggctggggcacagatcggaagttggtagttagggagatctgcacgaagtcgcgcatcacgctggtgcaacgagtgagccagcgtaaagtgcaagacaaactctcgtggttgccaggaacatctgcgaggcatcgattgcgtcgtgcaacagagaagactcttttgcacctccagagacgagtgatgactagtctcaagactctggtctggctgattgttcaatactggtgaggaggacgacgtatcgactgatcacatctgaanttactccatgacacagatagagtcgggatctgtcgtgcaccggttcagaagattcggttctgattccaggtggacttcagggttatgccatgcgggagatatggccagcttgatgcccatgttcgcgagcagggccaatttgtatgtgggactagttcgtatagtgcttcggaggaacacaaacgacaaatctgtagagagctatttgacgcgatgcaacccatccatatttcgtgacttttacatccagagttcctgccgactgggggcttatttactgccttgggaaaaccaaacaatttgttccatcactatcgtggtcagatggaatatcccagcgtgttctacagctggtcgacgctatggtggtaatcaagctaaattaggagcgtgcatgctgcaaaagtaccaatacggaattcgagataccaggtagaaccgtttaaataggccagaggcctggatcggtggaccttggacattgcgagggaaacgcttatatgcaatgtgggcaccgtgggtctggataatttccacgtggttcacttgaaacacacacagttgtgagtggaagccccagcaagaagaattgtggctaattccgagcttctgggtaaataaaggaatcctgtcgccacggttacaaacatttcattgatttacacgagtcctttctttgcgggtttacaatcaccccattaaatatggcgtcccacgaggcatttccctagggtaacacggtattaatggcaagctatt

SEQ ID NO: 529909 - DNA, 868 bp, Homo sapiens
ggagagaactagtctcgagtttttgatatgtttttttttcgaaatggagtctcactcatattggccaaggcgtggagtgtgcagggggtgcgatcctcggctcacgtggaacctcgtgccctcccgggtttcaagcaattctcctgtgtccctcagcccttccgagatagtggggactatcaggcacgcacgcggtcacgcctagggacataatattcttgtggatatatattgggctacaaagacggggggtttcacacaagtgtgtgggccacggatgtggctctctcaacatcttccttgaacctctcggtgatttccacacgcgcctctcagccctccccaaagaggtggcgtggcgacatccacgcggtgtgtgtgaagcccccacgccgggactcccggtcccctacgagggtccccgcgctttacaccacaagacacaacggtgtgttagacctcccagagcacaggggcacagcggaacctacacccctcttccccccattggcccctgttttcctgctccgcgcaccttctcttatcccgcgcgtgcactctctgggctctcttcttcgtgtggcgggacgccctctgcgtgtgtgtgcccccccaacttcggcgggaaccctcctctttctccccccccctgcttcccccccgtgtgtgtccccccccctttgtctgggggcgtcgcgtccattaacacttgtgctctcgtgctcttcccactgctttccctccccatccttagcgggcgccccattattctctgactgttccttcccgctcgcgacccccccggggtgctcctccgtgggcaccccttcggcacccccacgggcccctcctgggatatctcccctcc

SEQ ID NO: 529910 - DNA, 311 bp, Homo sapiens
tgttatcgatgccacctacacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatgtatgcagccaaaaaacacatgaaagaatgctcaccatcactggccatcagagaaatgcaaatcaaaaccactatgagatatcatctcatagtggcatcgataaacaccggtgtttacaccaaagtggcatcgataaaca

SEQ ID NO: 529911 - DNA, 860 bp, Homo sapiens
gttgattccgccccttggggaggaagtctttattttcttcgggggacccccttcagtatctctcctgtgtgaccaccctcgtttgtgtggcgcccccccccctttggtggccaccccttcgtcgcttatttaggggctctcctcttgagtgttgcttgttttggtccgccccccctctctggagagacctcctccttgttgtggttcccgcccccccgttgctgttcttctgctctcgcccgcctgtgatgtgcgcgcccccccccggtgagggagttggtctgcccccggcgcggtctgtgtcttcttccggcgcccctcctctctggtgaggagtgggggtggtgagcaccccactcagatggggtgtgctgctcccccccacccgatgcttttttgttgtggcttttctactccacacagatagcattctcctctctgttggtgccgccgccaccacacaatgttgtttgccgtcgctttttctctcgccagccaccaacctctgtggtgtgttgtatatctctctctctctctcccccccccccctcgccgtggcgagagctgatgagtgttcccccccccccggcgggggagtgcccccgcgctcggcgggggggtctctccccgccggtgtggtgagtcccccccccgctcgggggagctctcccttgttttgcatcttcttctctcttcttctgccttctctctcgtggccccccccccgcccagttttttttctctccctctttgctcagagtggtcgtgcgcccccccccccccctctcccccccccctctttttcccaccctttttcccccccccccccggggggtgtcttttttctcccccctaaagga

SEQ ID NO: 529912 - DNA, 110 bp, Homo sapiens
gtgccactagaaacagtgcatcttataccttcaaaagctgttacctgttctttaaaaaacaaagttgcttgttacttgtcctttgtgttttaggtgcagctcagtggaag

SEQ ID NO: 529913 - DNA, 352 bp, Homo sapiens
cctgaagaatacagaaagctctaaacgagtcgcaagagtaaccttagataatggcaagagagattaaaaaagaaaatgtgcacaaccgggcataaacacattgtggagtcgaagacagatgacaaccacacgagaacaaccgaggaacaagaccagggcacgagtataccacacccactgacaagcctagcaaacaaacaggcacagagactacagtggctaacgaacgagaggaacatgacaacaacaagtgtacacccataccacacgcaaaaggagacacacaaggtcacccaagaaacccaaggatcaaacagggagcaagaaacacgcaccaagaatcaagccaggc

SEQ ID NO: 529914 - DNA, 1069 bp, Homo sapiens
actttgttttttcttttttttacgcaagaaaagggaggaagtgcgcggcagcagcggcggctgtcctgcgtctggtgatctctgcagcccgcgtttgtatttgggggtactttcccgggatagcccggtatcggtctggaacacgccacccggccggggttgtaaaagggcccgccgttgtgcagtgcaacccagaggggggcgttccccgcgccaagatggtgcccctctccaagcacgggaccgttaagcccaagaccgcgtgtggagagttataaaaaagatctcgtattttaagaaacttaggatggatgtgctgactctgtgagggagtacttacgataatcccgacacgtgggacgaccatgaggttgccaacccaggatttccccatgccaagggaccatactgcgtatctatagaggacccaggaggggactgtttaaggttgccccaaggtggtaaggcgagcttgagaggcttgtggtcctcggtgcccacgtgaacttcttgaagatcttcttctttaattccctgctgttcccggccagccaggatagcccctagggtgtccgcccagattaggtgagctgctgtttagcccagtttgtaagcccccaatagttctgttctcgttgataccagaggttcttctgaatatttctggaagttggtggttttagttttctggtggactggagagtgtaatacccttgaccaataccctcgttgtaaagtgtgcttaatagagaagagatcccaccctttctaaagcgtgccaggacccagggcccgtgccgcccttaattgaccccacagtgagcttgatgtgccctccaggaagtctttttgcgccagcgtgtgcccttgtgaaagaccccccctctcttcgcccccccaagcgtgcgtgcccttggcaccactgaagccatttcagactgggccaaacccggtagtcatcccagaccagttaattccccgggcttggttaagatgctggtgtgataaacttgtttggatgagactttactttaaacccccttaccataaacttggggaactacccgtc

SEQ ID NO: 529915 - DNA, 458 bp, Homo sapiens
acatctctgtgcgggttcttgtatggatacaccttttcaactcctttggtaaataccaagcagtgtgcttcgtaaggtaagactatgtttagttttgtaagaaactgcctgtcttttagaatggcgtaccattttgcattcccatcactaacaaatgagagttcctgttaattcacgtctttcccagcgtttgctattgtcattgtgggttttggccattctgataggtgtgtaatggtgtcatattgtcattttactttgcaatgccctgaggacatgtggtatggaacatattttcctatgcacacttgccatctgtgtgtcttctgtgctaaggtacctgttaaggtttttggccccttttttaatcaggctgttgtctcactgttgagttgtaagagttctttgcatattttagataacaatcctttatcagataggtcttttgcaaatatatt

SEQ ID NO: 529916 - DNA, 882 bp, Homo sapiens
  misc_feature (15)..(15): n is a, c, g, or t
  misc_feature (81)..(81): n is a, c, g, or t
  misc_feature (90)..(90): n is a, c, g, or t
  misc_feature (107)..(107): n is a, c, g, or t
  misc_feature (147)..(147): n is a, c, g, or t
  misc_feature (173)..(173): n is a, c, g, or t
  misc_feature (216)..(216): n is a, c, g, or t
  misc_feature (227)..(227): n is a, c, g, or t
  misc_feature (291)..(291): n is a, c, g, or t
  misc_feature (344)..(344): n is a, c, g, or t
  misc_feature (365)..(365): n is a, c, g, or t
  misc_feature (374)..(374): n is a, c, g, or t
  misc_feature (377)..(377): n is a, c, g, or t
  misc_feature (386)..(386): n is a, c, g, or t
  misc_feature (389)..(389): n is a, c, g, or t
  misc_feature (398)..(398): n is a, c, g, or t
  misc_feature (437)..(437): n is a, c, g, or t
  misc_feature (439)..(439): n is a, c, g, or t
  misc_feature (455)..(455): n is a, c, g, or t
  misc_feature (540)..(540): n is a, c, g, or t
  misc_feature (572)..(572): n is a, c, g, or t
  misc_feature (575)..(575): n is a, c, g, or t
  misc_feature (627)..(627): n is a, c, g, or t
  misc_feature (639)..(639): n is a, c, g, or t
  misc_feature (647)..(647): n is a, c, g, or t
  misc_feature (651)..(651): n is a, c, g, or t
  misc_feature (677)..(677): n is a, c, g, or t
  misc_feature (684)..(684): n is a, c, g, or t
  misc_feature (771)..(771): n is a, c, g, or t
  misc_feature (838)..(838): n is a, c, g, or t
agcagagaacttatncgcgtcatttccttttttataaatgtgaagaggttcgaactatcctagagagtgcccatctaactnaaaaaatgnaatggctttggttaggnttgcatcttcagtacatgtgaccgtgcccactgagcttanttcagtattttaatgtgcaattgaantcaggtgtccccactacgatcattacgagtaagcggtgagganaaatagagaanattaagtattgaacattatatagatgcagctttttgttctgcatatgaagaaagatgaggatanaggagggcattgaggccacgaagagcttcccagacacccacggccatcagatnatcttcttcctgcaggcagtnccttctggnggnaggagctcngtntatcagagnataaaccaggagcctgaaagcagtcctgtgtctctgccntnaatcagctgttatttnttctctccccaagaaagggaaataggtctcagcagtttctgccatccatcatgaatcaatgaaatcatttcattaaaaatttttngtatgaatgtgcaaaattgccaactaggagtncantgggaaaaataaaaaaaacttagtttgtcaacatgatccatagacgagatgntcttcatgtgtnccaaaggnaganaggtgagaaaaaggatctagcttggnctctgtncctcaaagacagaagaggtcaggaagtccaatgggcgatgctcctgtagataaggcacaaagcaggagagctgagggtgtgcaggtnccatgccctgcatcaccaagaacccttctccctggcttgaaatctttggaaattcctggtttgagtnacagagaagcattgtcatgggctcagtaaccctgccacccctgt

SEQ ID NO: 529917 - DNA, 1112 bp, Homo sapiens
ggattcagttgtgggacccggagctgctgacccagcgtggtggcccagctgaaccggtgacacatctgtgcatgtgcgttagtggctctgggagcctgctgatggcctgtgcctcgtcctagatgctctggcgagcctgtctgcctgctgtctgtccccctgtcccccagtcatgcaaacctgccgcctgctggaagagctgcccccgatcttgggctgttatcatccgattggcgtcctgccttcagggagccatggcggaaggcaacggagcagatccttggtaccctcgaatccagccacagaacctcaaaaattcgaataggcccctttcacagaatgtaggtcaactacaaaaatctttaaaattgccgaaatatcccatcgggaattaggcaacacaggtgtgttccaacagttgaaacgaactaccagtgagaccttcgccgggtatacgtgtgattgacggcccaacacaggttggaagattcatttgagccccagtggtccacacattgatgacccttgatcagctcaaggtacattgcttacaaggcccctttttggaactttgatgtagcattcccggtacagtttgacacacgacatgcaggtatagacaccgacgaaggtctatcataattgggctacgacgatgaaactataatacttatcgtggactcgccgcacaccaaagaaccagcttatcaagacattaacttgcgacaagaccatgtgtgtgtagggtaacaacgtgaccgtgtgcccagaaacaccctgggcactgcacacttcacagtgggaagttcccccaaacaattttggaacgaccgtgggcagtattacattaggcgaaaaaagcttgccccccaatagatggcacaacagtgggcgagttgccacacatttcgcacctgcacatacttgtgagacgcgcgttagacagagcacggcgcatgtgttacaccacaagttgaatgatgtggccatctattcaaacgacaaaagaaaattgggacaccgtatattgtcccaaatacacccatcaaccaagagtcgtgtactcaccgtttctactgaaattgcccagaaaagcacagagaacacacata

SEQ ID NO: 529918 - DNA, 165 bp, Homo sapiens
agcagaatgggccagtggatgggcaaggagacaacccaggcccccagggtgttgagcaggggacagacccagctgggccttcggattcagacaaaaagcttcctgaaatggacattgattgattcccccccttgtttttattaaaacagactattataaagctta

SEQ ID NO: 529919 - DNA, 650 bp, Homo sapiens
ccacgcgtcgatgatgtatctccacactagcagagaccagagatcgaaccacccttcgacatgccgaaggggagtccgaactagtctcaggcttcaacatcgaatacgccgcaggccccttcggcccggattcttcatagccgaggtacacaaagcattgaggttataagtaagacaccgtcacgcacgtacaatgcttcctaggaggcaacatatgagcggcactctccccatgagactcgtacactaagcatattttggtcaccaagaccctacttctaacctccctgttcttatgaagttcgaacagcatagcccgcgattccgcgtacgaccaacgtcagtacaaccgtcctatgaacaaaagcttcctagccactcaccctagacagttacagttaatatgaatagtgttccttcgccgaaggttaagcgccgccaaggtttgttcagcccaggaggttccatgtgcacaaaaggggtcaagtttaatccccccaccgccgtccgagaggaacgctacaaagaagaaagaaacgaagagggcaccgaaaggagaagaaaaaagaatacagacaagagacaacaaggagtaaaatgaacccgggggagggcgggcagacgacgaacgagcgaatagtacaacgtag

SEQ ID NO: 529920 - DNA, 577 bp, Homo sapiens
  misc_feature (329)..(329): n is a, c, g, or t
tggaggccatcaaccttttggtggaggccttgttttacgcctcacatgtgcttgggcattggtgggcctgggcttttaaggtggcctcctgccctgatcagggaccctccccgctttcctgggcctctcagttgaacaaagcagcaaaacaaaggcggttttatatgaaagattagaagccgggaataaccgggctttttaaatgaggtaattccccctgtaaaagcatagggattttggaaccacctgttggtggcttgggacaccagtggggccaagggttttttgtcccgggttcaaatgagatttggctttcccgggtttttccnggaaaacccctgtttggggttttgggggtttgggtgggaagaggcccatctgcctaaatgtaccctgatagctttccaaagcccccgggggcctggtttgtgtgagggtgtggacagtgggggccgccttgggccggtttgggttgccaaaatgccccggggtgttgggggggggtttcagccggccccccccccttttttaaaaaaggccccttttgcccttttcaaataaaaagggggggcaggca

SEQ ID NO: 529921 - DNA, 375 bp, Homo sapiens
caaacctaggctggcatacactgagtaacaagcaaaggaatctactgcagggagaaggcaagaacatggaggagtaccctccctagaggtactcccaacaggcctaaggctgaaggtggaactggaatgttgagacacaccttgtggccaaccaggtcccctactaagcacaaggttaacactgaaaggacttagagctagggagagtacaggctagcagtgcagctatgatagcattactgggggcactaaaggtaaccataacaacaaccaaacccaagcccgctcacaacactgactaacctaactcaaattaccctactaaaagccttagaaacaaaacagagggcagcctataccaaggcctaaatatta

SEQ ID NO: 529922 - DNA, 235 bp, Homo sapiens
acatccaagcctgtgataaactctctcaccctaaaacaataaaaactcttagtccataggagcatgcactcctaaccaaaaaaaaaaaaaatttgtccagaagcccctctcaggtttattctccaaaataactttgtctttgattggtggagccacttttcagtgtttcttttctctttctttacttcttacatttgggtgctgaaaccggggatgggtgtggggcgactaaata

SEQ ID NO: 529923 - DNA, 990 bp, Homo sapiens
cgggaaggagacctggtggggactggggcggggcagcagccttgcgaagccctaacgcagcgctggggaggggggcgtgccgaaatggggggcgtgtgtgtcagggccgcgcaagcggagatggaatggggccctgggctcaagactggtcacggggtggagtgctgcctggggtggaccgcgggaagtgcggtggctggtggctcggcggagagtgccaccccacacagacgccccgggaggagcgcagcccagcagctgctggacgcggtggaagcagcgtgccagacggcagactccatggacaccatcgcagcctgcgaggagatgttacggcagctgggcagcgagagcccggagcccggctgatggcgggaacgtctcagacaaaccatggaggcagcacccaccagaccggctgtctccgacaggaggcggctttccacacaggatgctggcgcatggagctgcggagcccttgacgatacccaagcagagtaccctgacttctcatcccatccccatggccgtgtgtctggactcctgaaacaaactcccttcagtaaaggggccagatcttacacttggcagagggatggtacttgggatctcagcatggaaatggaagatcttggtagaagattggagtacagtacacaatttatacttgagctgaaaagcaagtggatgtgattagaaaagtagaagacaatgaatacccagtatggattaacccacaagacattaggggagcaagaaaacacaaggcaagggtggcatcgagccagaacagttggaggtccagggcactgtgcatattgaggggggcatcaaggggatgggtgggttcaaaagttgtaccagtaacacatagtctaagagggagggcatatagaggcccgcccgacacacaagaaccatcccagagacgaagcgtttgtcagtaaagaaggaaaccgttgacgcaagaaacaacaagacagcaaaaca

SEQ ID NO: 529924 - DNA, 208 bp, Homo sapiens
acgacaaggcgatcccagagtgctgggattacgggcgtgagccaccgcacctggcaaactttttgtatttttagtagagatggggtttgaacatgttggccaggctggtctcttaactcctcccacctcggcctcccaaagtgctgggattataggcgtgagccagcacaccaggcccttttagttattttaaattagcatatcctat

SEQ ID NO: 529925 - DNA, 851 bp, Homo sapiens
actgccgggtgtggtggcttacacctgtaatcccagcactttgggaggctgagggggccagatcacctgaggtcaggagttcgagaccagcctggccaacatgacgaagccccgtctctactaaaaatacaaaaattttccaggcgtggtggtgggctcctgtaatcccagttactcgggaggctgagggaggagagttgcttgaacccaggaggtggaggttgcagtgaactgcgatcgcaccattgcgctccagcctgggtgacagagtgagactccgtctcaaaaaaaaaaaaaaaaaaaaattaaattaaattaaaaattaaaaattgaaaaaaagaaattacttgatccggccagttttcttgaccctgtgttggtggcttctcttacgggttaaaattggggtttagttttggggtttttccccactggtctggacttagtatccatttccctgtggttctatataagtcagttgcctggctcatccatctggctttctagcttccagttatttaatggctaatgggctcgtctcccattcctcttgggtgttcgatgggtttcacccttcttttaaattcccaaaaagtagggtcagggagacgccttttatccggctttatcacctctttgagagatgtctgtatcatgcttttcatccctgttggcaccggtgacgaactcttgtttcccctgtttggaggtggccattgccctgggagggttgtggggcttggatccgagaggctgggttggatctatgcttacagcgtgttacctggggccttttcctaactcccccataaattttatggccctagcatttggttagggcccccggtggc

SEQ ID NO: 529926 - DNA, 480 bp, Homo sapiens
gcgtttaaatagcgacgatccatgcagcgtgtttgaatgcagtggattccatgcagcctggtaaaatgcatcctgattgaatgcagtggattacgtgcagcatgattaaatgcagtgaactccgtgcaatgtggtaaaatgcatcctgattgaatgcagtagattccatgcagtgaggcccaatgcatcccgattaaatgcagtggatttatgcagcgaggaccaaagcatcccgattgaatgcagtggattccatgcagcgtcactgaatgcagtggattcgatgcagcgtggcccaatggatctcgagagattgcagtggattttatgcagtgtggtgcaatggaatttaattgaacgcagtggaatccatgcatcgaggagcaatggatcccaattgaatgcagccgattgaatgcagtggattccatgcaggcgtcattgaatgcagtggattccatgcagccgtcggctacatta

SEQ ID NO: 529927 - DNA, 278 bp, Homo sapiens
ttcttcctctgcttcgtctactcattgtcagacctcctgctccccattttcctcattagcattcccgattagcaggggcgtctcatcccatggaactgcctcttaccagaacttccttcttctacctgaaagtccttggatggtgattacagagagctggtgtctacggactagcgtctagacataggtggggcacgaccggtgtatccgatgcaggggcattaaaaagcaacagcgcagcagttccaggcaagaggccagcacaaatgggcagcaga

SEQ ID NO: 529928 - DNA, 989 bp, Homo sapiens
ctcctttaatctctccacccttatcacaacacaagaacacctctgattactcctgccatcatgacccttggtcatactatgatttatctccacactagcagacgagccacccgaacccccttcgaccttgccgaaggggagtccgaactagtctcaggctcttcaacatcgaatacgccgtcaggaccccttcgccctattcttcatagcccgcacataacacaaacattattataataaacaccctcaccacttacaatcattccgtgagtgaacgaactatattgacgctacatcatctccccttggaacatctacactaaacatattttgttcaccaaagacccttacttcgtaaaccatccctgattctttaatgtaattcagtaacagcgataccccctggattcccgcataccgacccaaactcaataactaccttccatattggaataaatacctttcctaccacctcactcctacggcctacttacttaatatgatattgtctctcactacccacttatcggaaatctccaagcagttccccctcatataccctataaattacagacacaacagagaacattacaatcctcattactatttctagcctaaacaaactcaaaactacagaaacgcactcacagggcgcggtcataaatccatctcctccaggagtgcaaactctattcccactaataagcttttttgatagactgtcctacgccagcctcgctaacctcgacatttaacccccactattgagccttactgaagaaaactctctgtgctagtaaccacgtcctgctgattcgggtatgcaccctcctacttagcgggacgacaacatactggtcacaggccctcaaagtccctctacctctttagacgagacacacaagagggtcaagtgcacccagcgataacaactaaaaccttcttccaagaaaaacctcatagtttaactacacatttcccgggagaac

SEQ ID NO: 529929 - DNA, 663 bp, Homo sapiens
  misc_feature (489)..(489): n is a, c, g, or t
acaagatcagaagaggctgcgtgatcaccatctcgggacgcatgagcttcacgagacaactaagtccatggagatcgaggtgtgggtggacgccgaccctgtagtggacagcatctgagaagcgctaccgggccgccagtgccttcttcacctacgtgtcgcatgagccaggaaggcgggtcgctggctgtgccccaggtggtgcccgagagcagaggacgacgaagaagcgctttgagcgaaggcatagggcgagtacctgcagatgaaggcgaagcggacgagggctcgacgctggagtccgtcagcgccttagactctcgcatccttcctgcgcactggtgcctcgaggtagccatggtcatacagggcccagttgttctcatgtctaggcattatgaagttcgccccgccttgggccataaaccactaattgcagcattagagcagctgtgtgtgtgtcatgaaggttttcgctatcgacagtgnttaaccgtgtagcgtctcatcctgccaagacctacacaccagaagcttgagtttcatgatcgatgtccaagtatcaatgctacgacagtgttgtcccgagcgccgggagggcgtcgggcagaatagcctcgggaatgcttcctgagctacgctgtagggtatgggaagaagcca

SEQ ID NO: 529930 - DNA, 177 bp, Homo sapiens
acgtgagtgaagcctgacccgagctagcagcactgcaccgcctagaatctactctttcctgtgtaccaccctgcgccgctggactcacagctgtgcgatgagaggctgcacaccacattcaacaaagtggcggagtgtccaacctgggcagcagcacaacatcccaactggcagcaa

SEQ ID NO: 529931 - DNA, 100 bp, Homo sapiens
  misc_feature (95)..(95): n is a, c, g, or t
gaggatccccctgtcagtcgttcttggacatgtggtaagaaaggcaatgtagttgtagggcaaagggaacagtgatttttacgagtgtggaaagnctcta

SEQ ID NO: 529932 - DNA, 245 bp, Homo sapiens
aagctgtcattcttgtggtcgatctctagcaggatccccgcaatctatgctcgcaaggaactcatctcctgtcaacaatcttgagacgagctcttacaaccagatccttcccacatatcaagccttcagaccagaatacagtcctagccaacatcttgatcatagcattcttagagacactgaaccaaaggcacccagcgctactcataccagagtccagacctacagaaactacgaggctattg

SEQ ID NO: 529933 - DNA, 120 bp, Homo sapiens
ccagactcaatgtgtgtatatatatataaagcaaagagccacaccacggcgtggacagctgatatttcacccagctgctggcttgtgggtgtggctctttgctttatatatttatacaca

SEQ ID NO: 529934 - DNA, 973 bp, Homo sapiens
  misc_feature (38)..(38): n is a, c, g, or t
  misc_feature (97)..(97): n is a, c, g, or t
  misc_feature (120)..(120): n is a, c, g, or t
  misc_feature (122)..(122): n is a, c, g, or t
  misc_feature (135)..(135): n is a, c, g, or t
  misc_feature (440)..(440): n is a, c, g, or t
  misc_feature (557)..(557): n is a, c, g, or t
  misc_feature (590)..(590): n is a, c, g, or t
  misc_feature (610)..(610): n is a, c, g, or t
  misc_feature (619)..(619): n is a, c, g, or t
  misc_feature (709)..(709): n is a, c, g, or t
  misc_feature (723)..(723): n is a, c, g, or t
  misc_feature (732)..(732): n is a, c, g, or t
  misc_feature (759)..(759): n is a, c, g, or t
  misc_feature (796)..(796): n is a, c, g, or t
  misc_feature (798)..(798): n is a, c, g, or t
  misc_feature (814)..(814): n is a, c, g, or t
  misc_feature (823)..(823): n is a, c, g, or t
  misc_feature (837)..(837): n is a, c, g, or t
  misc_feature (911)..(911): n is a, c, g, or t
  misc_feature (956)..(956): n is a, c, g, or t
acacggcctacaatcatggcggaaggcgaaagccacanctcacatggcagcagaaaagacaaaaaaaggtagtcatcttttagtaaagaaacctganactggtagttggcttggagccanangatcgcttaagtncgggagttcgagatcagccaggataacaaattgagaccccccccaactttaaaattaaaaaacgaaagaaaaaatagctgggttttgtggctcataccttttatcctagcactttgggaggccaaggcgggttgatttccttaccccaggagttttataccaacctgggcaacatggtttaaaccctttttctactaaaacataaaaaaaatcagccaagttttttacccttcaccttttttcccatttacttgggaggcttaggcacaaaaattcctttaacctgggaggtaaaggtttcaaanatcatcccactccactcccacccttggttacaaaaccaatactttttcaaaaacaacaacaacaacaacaacaacaacaaaacaaaacaaaaaaaacctctcaaaaaaataaaaaanatttaaatttaaattaaaaaaaaaaattcttgntcttattgctcacacctgtnatctcagcnctttgggaagctgaggcagggagatcacaaggtcaggagatagagaccatcctggccaacatggtgaaaccagtttctactaaagaaggnacgcgccttttgtnccagcactnaggaggctgagccaggagaattgcttnaacccggggaggtggaggttgcagtgagccaagattntnccacttcactccagcntggcgacanagttgaactccgtntcaaaaaataaaataaaataaaataaagcaaaaatataaaatgttaaaaaaaacaaaaaaagggaaaaggagcngattgcctttgtgagtaacacttggtatttctgacactatttganaaaaaaaggaacactta

SEQ ID NO: 529935 - DNA, 654 bp, Homo sapiens
tgcactggttttggaggcgaagtttgaaatttaattccagttttgccacttgctacctgtggagtcttgatcaacataatttatctctgagtctggttttctcatctgtgaaatgggaataatagtaccagaggctgctgtgaggtccagataaggtcatgtgagacggttggcatagggcctggcacatggttggtgtgtggtcaagagtaactcttctagaaatgctttttcctcttctgccagagtgagtttgtctgtctttcttttctgtcctttctttcccttctttcccttccttcgttccttccttccttctttccttccttttctttctttttctttctttcttccttctctttctctctttctttcttttctttctttccttactttctctttctggcaggatcttgctctgtcccccaggctgtagtgcagtggcatgatcttggctcactgtacacttgacctcactggctcaagtgattctcccacctcagcctcccaggtagctggggctataggtgtactccaccatgcctggctaattttttgattttttgtagagataggatcttactttgttagccaggttgttctcgaactcctggctcaagcagcttctccctccacctcctaaagtgttgggat

SEQ ID NO: 529936 - DNA, 725 bp, Homo sapiens
  misc_feature (216)..(216): n is a, c, g, or t
  misc_feature (700)..(700): n is a, c, g, or t
  misc_feature (705)..(705): n is a, c, g, or t
ctgggaggaggagtaggactggaaaggaggtgaagaaggattttttacttacatttttatgtgtgttatataaaaagtaaaattaaggagagaaagattgagatgtcaccttttctttaaatacagacaaatgtagttacagtttgagagtgatagggacaacttagatttctttagataagggccaccagaaaggtgaaggaactagaaatcacnctgtataaggaatgtgagattgaggttattagtgtttgacctggagaagggaaatgggagtggggacagagagtgctgaggaggcctggaaactgaaatgaaaatatttgaaatgctatcaagaaaaagatgtgatttgtgccatgttgttataagaatagaactggaaacaacagtatacagttaatacaattgtttatgctataaaccagtggtccccaaactttttggcactagggaccagttttggcgaaggcagtttttccatggactgtgtgggatggtttcaggatgaaactgttccacctcagatcatcaggcattagttacattctcacaaggagtacacaacctagatcacgtgcatgcacagttcacaatagggtttgtgctcctatgataatctaatgccactactgatttgatgggaggtgaagctcaagcagtaatgttcaggcaagctactcactttctgctgtgcggnccagnttctaacagccaggggctag

SEQ ID NO: 529937 - DNA, 207 bp, Homo sapiens
gggggggcccccctttttttccccccccggggggggggggttttttttttttggggcccccccctcccccccctttcccggggggggggggggaaaaaaaaaaatatttattcgaaagaggagaaaatagttaagtttgtgtagtgaaaaaagataactaaagtaaattatagaaaaagtgatattaaaaagaagaaaaaaaaaaat

SEQ ID NO: 529938 - DNA, 1155 bp, Homo sapiens
  misc_feature (226)..(226): n is a, c, g, or t
ggcgagccaggattcccgatccagagaacgatggtcccagatgggatggagcccgtaaggcgtcatcgagagtaacatggaatgagattgttgagcggctattagtagtgacatgaacctctcggagtcccattcatccgaggcgatctacagcgatatggtctcttgagacaagcccgtctgtgcatccagccaggcgagccagttctaccgttggtatcaaggnggttatgcactgctgattgcttgcaagccccgaagtcgtgggaacgtggtgagaaacggtcaacgatatggcgcactactctgaatatctggcaggctacgagttgcaccacttaccgactcgtaacaaagtccaccccagagcccttgggctccgtaggctacgcacagctcggagcacatttgcgccatcgagtcgagaagtacgatgagacaggctgggctccatgggcaacgctaggagagaactagccagctggagactgacgcgtcgcgtgttacatgcgactcgtgatagtccgcgcggggcacccgaaacgatgcggatggcgtagaatgcgtgcagacaataggctcgccatgcgactgggaaaggcgtcctcgcacactcaatcggtggggtacgcacctgtgggcccggctgcgtgctcatacgaagtactggcgtctacgacccggcaagatagcgcatgttgcgccccgcaagagtaacacttcagacggaattgcttcatgtagactggagaacttcgaaccgcctgaaccggaacccttggtttacaagcgctgctggcggaagatcccacgaagtggcaccaccaagggaacttccttaattgggaacctatgttagttttcgccaagagaatatcgggcgtaccacacagcacatgggctaagaatgcgaaagcccactaatgagagtttaaggttatatattgtgggccgttcgaattcgaacggcagcccagtcggaaaacgtgggctccccttttttccatttggaaactttgcttggcccctcggaaagggcggagttggaactgcgcaacatatctgaaacaccgttatctcccacatggcaacggggggaagacccccccaaaatttctcggggaaatttcaattttggggtcccaaaggcaacac

SEQ ID NO: 529939 - DNA, 943 bp, Homo sapiens
gtggggccgggaagttccctttctctgcaggtcagaagtgctgtcagatgcgtggttctccagactcccagtgtctgtccgggactgagcaaagtttggtcaagtccgggcgctttgcaaccgggccgtggtgtgctgtaccactcgggtgatgccttgcattgccatgccccttgctggctcttgcccctccatgactttggtgtgccaactgagcacgggtgagtgcacaaaggtgcttgttgaaaaacggcgggggcccttgcaggttccccatggcacggatatgcagtgcattgctggtggacaaaaccttgttcaattggcagcaggaggcaggatagtggtcccggtttggaaaaggggctggtccacctgggtgaaagacccccacgttttttgagcagcaacatgggactgaacttggatgtggcccttgttggtcgcctgtctgggtttcccccaagtgggagtccccaccctgtgggtggaagttgagaaacctctttggggtggtttttatcccaaggcccccgccacgaatcgtgccaaccccaattgggtgacccaatccatggtaaaacaacttttccgttccccttttcaaaaaaccccgggtagaaaagggtcccccaagaaccttccaagccttatgaacttctcggcagcaaggccgaatttgttccacgcggattgaaccctgtgactttgcggggaaatatacgcgacgactttactccgacatcccgggtggtactacgtactttccccccttggaagaagcctggagccacttccctcaagtggaccaactgttgtgccttgttgcgaaaaagggacagtaaacccacattccaggtgtctccccttggacaacagctgggttctcgggcacctcatacaactggaaagcctaccactcctactgggccatttggttcag

SEQ ID NO: 529940 - DNA, 334 bp, Homo sapiens
  misc_feature (81)..(82): n is a, c, g, or t
  misc_feature (103)..(103): n is a, c, g, or t
atccctgcccccagggggagtgggattgtttccgcccctgtgcctaaaaaactggttattaaggtggggtttaaagattgnnaccccccagccgggggtgcantgcccccctgggaaatttttccaggcccccttttatgcccttttttaaacccaccgggccctgcccccccccctttgggagggggatggatttcccaagtttccccattagggggtttttgccccccttgtcaaaaccccccccaaagtttccgggcaggggggtcagggtccccctgtgggtcccacaaaggggttttttaccaaaaaaaaaaaatgaatttagggtgga

SEQ ID NO: 529941 - DNA, 1170 bp, Homo sapiens
tgaaaaaatccggggggcccagggggtgggtttaaaccccccttggggggggtgttcgatctctctctctctctctttttgtgtgtctctataaatttttgtgtgttttcgcgggttctctccgaagatgtggtgtggggaggggggggggtgcctctccatatttggtctccctccgcgacggggtatatgggaggaggtgtgtctctctctctactctatatatatagagagactgattttcgcgcgctctctcgacgagagacgacgagagagagtgctgctctctctacacatatactctagagtagaaatatatatcattatatatatatatatcgcgcgcgcgtggctgatatgagagaacaagagagagagatgtgacgcgcatcgacacagagagagagagagagagagaagagtgtctacaacagagtgagtgggagagagatgcgcaccggcgagagcgagagcacccccacgcgagaagagaacagcgcggcgggagagagatatactctcgcgagagatagacgagcgcgccacgagaaagaagagtgagatgtgctgagcgcgggcagaaagagaaaagacgtcgtaatagatatcatccttctcagcgccgccgcgacgaggacgaaacaataagaatcacagaacaaaataaggcgaagagaaaacaaggaggagtaaaatataggtggaggaggagtcgaagaacgaaggaagctgatagatgacggggacactacacaaggaaggggggaggaagtcgtgaacccgcaccggcaagagcgggagaagacacaagaatgaatggaggcggccggcgcgcaacaacaacgcaaccgcaccggaagaacagaaacagaagggaacgacagaacgcaccccccgccctactccccacatcaacgagagacaggaagaaggaagggcaggcacgaaaggcacaaaaaaaacgacggacgcgacaggccggtcggcccacaccgacacatacctgagtaggtgggagaaacgcacgaagggcaggacgcacacacacaacatagaaggatggacgataagatgagaagaagaaaggaggaagaacacacccacaacacaacaaccaaccacaggacaggaggatcaacagtatgaacgacatgcgagggaggattgata

SEQ ID NO: 529942 - DNA, 139 bp, Homo sapiens
ccacttccacctttacttaccagacaaccttagccaaaccattttcccaaattaaggtatggcgatgtgaaattgaaacctgtgcgcaatatatatagcatcgcaaggaaaagatgtaaaattatactccacgcataat

SEQ ID NO: 529943 - DNA, 369 bp, Homo sapiens
agcggggcttggcgcggggcggggcgtgcgcaggcccgcccgagtctccgccgcccgtgccctgcgcccgcaacccaagccgcacccgccgcggacggagcccatgcgcggggcgaaccgcgcgcccccgccccgccgcctctggcctcggccctggccccggggcgtcagtcgcgccgtgtgtaacggtggagcaggagagccgtgtaggaggacccccgggcccgccaagggccccttgaagtagccgatcgcaactggaactatatcgcttggtggtggtcgggctcccgggcgggtgtggcgctagcatgtgcgctgacgcatcccagctgactaccaggaatccacgtttgtaggacggactac

SEQ ID NO: 529944 - DNA, 231 bp, Homo sapiens
ggtcggaccttgtgtgtgtgcggtggtgctcgcgcaggatggacgcgaggtgtggcggtgggtgtgctccgcccagtcgtgcagctcctccttgttcgctacctcccttccggcttccttggcgaagaccaccttggccatggacacatgggcgacctcctccatgtggatcgcttccatgtgtccctcgcagaccttcatcaggacgtcccaggccttcctggtgaggat

SEQ ID NO: 529945 - DNA, 156 bp, Homo sapiens
cctattttttgaacaacaagagacatttctctaggagtttaagccagtcgttcatcatgttgtttcagggaagagtatactctgaattataatgtaatacccagactaatttatctcatcatggatactatttactataatttctggcctagctag

SEQ ID NO: 529946 - DNA, 548 bp, Homo sapiens
ttggggtcccccaaaaaaggttaagaaaaaaaggttttttttcccggcgggggccttaaaagttttttttgggtaacccctttggcccccccaccaaaggggggcccctccccggggcccccattttaaggttttttttggaagcccttgaaccccccggttttggggccccagggggggtttttaaggggggggggggggggccctttaaacccagggggccctccctttttgattttaaaaaaaggggtttttttggggggggaaaggggttccccccggggggccgggggcccccaattctgggtgaaaacccttttttgaaattaaaagaaaaggggttttgggtccctggggtttcccgtttcccaaaaacaaaaaaccctggcttttttcccctggggaattgggggccccccaccggaaaataaaacccctggggggggggcaaaaaaaagggttttaggtaccaaggcccgggcaaaaattttttccggggggccccccttcccccaaagggaaaaaaaaaagggggggcccttccctta

SEQ ID NO: 529947 - DNA, 250 bp, Homo sapiens
aatcaccagaagaacaacctctaaacagagtcaactataattcataactccagagattaccagatgccgaaaggtcacggcaggaatcttactaacaggaaccaagaccactcaccatcaccagaacccagcacacccacttcgcccagtccagggaaccccaacacacctgagaccagtggtcctcatactccacatgaccctcaattctaatctaactgcattcgccttttgttttcaaagtagacgc

SEQ ID NO: 529948 - DNA, 342 bp, Homo sapiens
ctcattcctgcggatctgcatgacaacattccgtggagcatctctggctcaggcgagtattctgaccatgctgtgagagctctgtctccagattcttgtagactgagcacgcttgagtctctgttggccagcagaatccttcccttcatccgctagttcttcgagctttgccaacagacagtcacctcgatcagcagtttgagcaacattctgtaaatgcggcgttaatacctgctagcaaacaaaagcagttcctgcgcataaacgtaagtatgtcctctggcaatcacataggagtacatagtcagacatgtctcctcattgtcatgtagagcagtgcac

SEQ ID NO: 529949 - DNA, 615 bp, Homo sapiens
ccacggacacagctgaggatcccgtggcatacatcgtaacacttaggattcagactaaggatcctctccacacgctgcctttgccacgctaaggtgctgtacgtcacgtggagtttgcagacgccatggcaagaccttcagcactgcttaccaccattgcatgcgcaattgatagctatactcaacgatcagccagagacctgtgactacccgaaaccaatgtgcaatacattcatactgctgcatgtattgattgagctaactctggaggtcccctgactaacctggctgaagaggtgattgtagtgaacaccatgactgtcacaggtgaaatttccatggccatacattatgatcggcttcgagagttcctgctactaggtgtgaggatggtgaccctgagtcccagcatccttgatgaactacagctatgggaacaatggtttccgatgctaatcatgatgaactcatccatattgtcatcctgggcttcccctgcacaccgggctgcttttgggccctgttgatgcgaattttgccatcgtggagcagatgtacccaacggtccgaaatgttaatgaacttgtcaaaccccacctcgttggcgtgccgccg

SEQ ID NO: 529950 - DNA, 375 bp, Homo sapiens
ataaatatacattgaaggtagatttaagggaaaaaatagaaggagataagctcaggaacataatatatacatcttgtatgttttgatgacatagaaataaattactaatttaattaaaattgaaggagaatagagagaaagggtaaaaatagaaaaaagttcattgattggtatataagcaataggtgagagtcaaagaaaccattaaaaaatggcaaaccagctgcgccaaaggaaaagtttaaaaaaaaactggcagaccaaggcaaaagtaaatttttaaaacaggggacacagaccccatctcattaaaaaaaaaaaattaataaaaatagccaggcatggccgggcgcagtggctaacgcctgtaacccc

SEQ ID NO: 529951 - DNA, 430 bp, Homo sapiens
gcggccgcatactactactaaattcgcggccgcgtcgacctaccacgaactggttgacgtcggattgccgttggttcttgtcaacggctactcccccagcattacggttccccagatcagtgacgacgatgtatctgccatggatcaggccgttgcgcacttggttgggttaggtcacacgcacctaggtctagccatcggtccgcgacgatacgttccggtgcaacgtaaggaacagggtttgcgggctgccgtggatcgtcatctcgagggacggggcagggtcaccgtcagcaatacggtcttctctgttgacggcgaggctcgtgctgccgttgatgtgctcgggcaaagggtcaacgcccttaattttgggggttccaacctgttggccttgggagctattttcgccgcaagggcgcaggggatt

SEQ ID NO: 529952 - DNA, 925 bp, Homo sapiens
ggatcccctgttccagcaaaggcatcaagcaggtccacgtagatccagtcttgcatgggacgcctggagacggtgacaagcagtgctgtgcacatatgtagaaaagaaatccaagcaagcatagagcagatattcagccgtctagaacgtctggagatttgtccatgctaggagccgcccctaacaaagaggcaaaatgccagacttcgggttgtaagcagttagagtatgatgtccagcacctggagactgtgctcagaaacttaccagcatcggcgtccggattgcaccgtggagtcgagcaggagaatgacctgcgatgaaaggagcggctgtctcgaaccttcaacagtagcgactcggatagcatcataacaactggacgagaatgactggagtgtacactccatcgcgtccagaaatgttcaccaggggcactggtgatgaccgcagtgatgaggaatgggccactagtattctaagatggacatgagcgagccagagaccgagctagaaggggagtcagccgaagatccttggacattgcgaacatgcgtggggcttgtccagcaccggggatgcggctcatcgggaagcgggcgtttcaggccaccgtactgaatgatcggtgggatgctgctgacctgtgtggcatgtcctcgggtgcagtacctgacatgagcagcaagctcaagggggggaccggatccacagctggaagggtgtgtgcgtgtgcaacaaaggggccaagggcgacttggaggtgccgctaccggcacacctgcgggggccacacaacgcagacaacacgggcgaccggcacaccaaaggcggcgcggcgggaagacggaaaggaagggacaaaggcgggcaacccgcgtgacacacaccaggggccacaagagggcgcccaccacgcggcact

SEQ ID NO: 529953 - DNA, 111 bp, Homo sapiens
taaaaatataagaaaatgcagcacaatctgatttttacttggtaccactttcataaatataaagtaacttaaaatatttgttgttgttgttgttcttgttttgccagttcc

SEQ ID NO: 529954 - DNA, 186 bp, Homo sapiens
catatgataaagagaaatagggacaggagttatgtagcatcaagtacttagttaagcactaaccaatccagggcagcggcaagggacaggactatcaggataagcaaaggagaaacgggggcgtggggtagccagtttcagactaattgcttcatgtacattcctactagctcctcctagaggtgt

SEQ ID NO: 529955 - DNA, 492 bp, Homo sapiens
gagttggaaccgtggagatgcggaaggaaaccccacccgccctagtgccccccggcggtccgtggagtggagtcttacccccagaatgcgcccgccgtgcctggcaacggccgttgtaggctgcgcgctcccggtccgatgcagtcgcgtctcctcggggtcctccaccctgagtgtgtggcgctgctgggccggctcctctctgggctttttcaagggacccctgtgtccgcccccaatcgaaggcttctgctccgcggcagtccgagacggcaggctgggagtggctgacctcacttgggctggggagagaggtatgctagtggcctccgattcaggtgctgtttgacatgtgggaactagatgagaatgagacacttatgtcagccaagttctgcaagtatgagcatgatgacactcgttgtctacagtcagggtcttgagctctggcacacaagctgtcagtggtagcacaccgacatctgcatcaag

SEQ ID NO: 529956 - DNA, 286 bp, Homo sapiens
aagagaggaatagcacctcgtggactgtaacgttttacgttttatgcgattatcgaggctctgcatcttaacaaagccctgtgcttgggcatggtgtggagtctaatactaatgtagcagatgatatcatttacggcggtgagaccctttgtgacagtaggccttatttctcttgtccttccttacggagagcgattggaagtagatagaaaccgacctggatcactccgtgtctgaactcagatcacgtaggagtttactcgttgaacaaacgaaccttaactag

SEQ ID NO: 529957 - DNA, 988 bp, Homo sapiens
  misc_feature (459)..(459): n is a, c, g, or t
agcggagtaacgtctttgccccgggccgagaccgatccacacaccatctccctgtgcctccggttcccaatcttcgcattctctgctagacccatcttctcagtcggcacgctcgccgccagccgcgagctgcccacaagatgtcataccaggtccgaacgtgactgccacttgcgctacgtatatcagaagcaccttcagctagacgaacgaaaatcaaagatagatgacgtgtggtgtgacgataattgcggagttgatacgtaggacagaggtctcgtggtaacacgatgacgcgaaaaggtctccttctagtacgttgaatgacggaacccgttggccatgcacgcgagctgtctagcgcatggggcggctttctcgctaattctggaatagcagagtccgtcgagggctccatagttcgacatgagcgcacatacttggctggtaagtacattnggcaagaaatgtgggtgcactatcggggattatctggttacattggcttatcgtgtcgaatacatactatcatctcagtcagtgggtgcggtgtagtcatcatctccactggagatgagactctaggtcgcgaacatcatacaacgtcgctgtatccagagtaaaatcctacttcatattgacctgtgtatcgatcgttagtaagccgtcgctggatatttatctatagcgtttgagcctacgtgttcatctcctaacaacttatagttaagtcgtcacatgtatatatcgtggaactttcttaggaaagcggtgccattggttcttgctcatatggcactcgcaacagttaggaacggctcggactcaccgatccacattagttgccaccaggtgtcacttgtacagaatgatagcgctattgggcctgattgaacgaacggacttgctgaaaggtttccagatagtgctattaatctcagcatgtaagggttgggccacctaacttaaattggccatttactgcccg

SEQ ID NO: 529958 - DNA, 367 bp, Homo sapiens
cccccccccccccttttggggcccccggcctttattccctgggggggttttgggtttttacctttaacaaaacgggggaaccgggccctggaaggcccccgggctccccctttgatttggtttcggccccgggttggcagggccgggggacttttttggggtgtccctgggggggttttgccccttcccgggcgccgggatttttaccgggtttaagggccccttttttggagggaaattttttccccccttggggccccctggggttggcaaaaggtttttaaaaaaaaaataaggttatggctttacccaatttttcccccccgggggggggggttttttaaaaacccctaaaagtgggttgcca

SEQ ID NO: 529959 - DNA, 2050 bp, Homo sapiens
  misc_feature (1916)..(1916): n is a, c, g, or t
gtgtgcgtggagctggagagcggaccccatgatgatgccctgatgcagccccacctgcctgacgcctgtgcctagttaccatcacacccctgggatggatgccgcagctgccgcagccggccccagatcaccagtcacctgcaaaccagtgatgcatgctgaggcctgagacccatgcaagccatgccagacagaaacacacagcaacggagacagaaaacagaaaatttttgcagcaagaacagaaaacacaaaaggcaagagaacacataaaagagcgcccagacctgagccatcccaggcggacagacgtgaatggacaccccgaccactctcgcacatccaccaactcccgtgccacgcgcccacccatgcaccaggacgagatatatcaacacgacacggctcaatcacaacaatacagaaaagagataaccacgagcacatccccgaacaacaacacatacaatcgccgacacacggatacgagacgccaacccgcgacattaacgggaacagaccaaacgacacaacgagagcgaacacgatgaccccaccccacaccgcagacaccagtggcgcaaccgatagcataacccccacacacgagacttggacccagctacccaagggagacaccgagtcagaaggagccccacgcgccagacacccacacaatacgagaccagtaaccgcgcaacgcgcaccgcaagctccgaacgacacgacgcaccacgaagcagagacggacgcgagaagaagagcacacacaacaggcaaaccgaccgaaccacagaagacagaacgccgccgagcgcagaaccgcgacccaaacagaagcaaccacagccgcaacacaacccaaggccacgccccacggagccagcagagacccgaaccgaccgagcagacccgcagaaaaacccacggcaaccgcacaaaactgaccaccgcggacgagcagcgtagcgacaagacgacagcaacgactcacagacacgacgaccgagcgacagcaaccgcacgacgcgacggaccagacacgagaagagagcagacaccaagaactagcacgccagagaggagacgacagagcgaagcgagatatcacgagacacgaacgacgagggacacacggacaaacacgcacacacgacggacgcgcacgccagacgagagctctgacagccgacgaaaactgaagcagcagagacaccacacgagcacgccacaccacgaatacacggacaacacggcagcgcgcaacgaccgagcaactctgagacaacccagacggagacagagagagcgaaagccagaacgacccacgcgaggagacggacaacgcagacaccagagaacaccgcggccgccgaacgctcagcaagcgcaacgccggcagacaccgagacgcccgcctcgagcagaggcaatacgagcaatgagcagaacgcacatgacactcgccacgacggagatgcaacggatcagaatgaggcacctgaccacagcactacagatggagacgagagaggcagcagacgcaggacaggacgagacgaagagcaggacgagcaacgacggaagcagagacagagaacagagaagagacagaggagacagacgacaacgaccacaaacgaaggctgaacaggacaagacaagacaacagacacacgaacaacaagacacagacgacgaacagcacgcagatcgacgcaagagagacaaacagacacgaagacgcatgagaagcacacgccgagccgaaccgatgacgcacaacgacagcagccacgaccatgaatcgacgggaagagacgagacgcaagcgcgagcgacagaatgacagggagagagaagactgagcggaacgaagacagagcagcaggcgagcacagaagaccgagaacganacgacacgacaggaaagcagacgacagcgacaagcggaagcgaagcgacgtagcgaccacgcccgcacaccactcaaacacgagcactcgaatgacacagagagcagcatggactaggcgtaaccactacgcac

SEQ ID NO: 529960 - DNA, 270 bp, Homo sapiens
atgattagaggatccgggaggaggatgtggtcaacaccaaaagttaggtaaggagctgagaaatggcactagatgaacaattctggtgttcgtggtgaacaaatccacagtatactgatcttattctacggtggggatcgggggggcagataaatgggcaaatatgagaggattatagaaagaggttggtggggggcacaaaagttggagtggccagtaaggtcagggagagatatcagaaaacatttagttgtcctcattacatgccat

SEQ ID NO: 529961 - DNA, 125 bp, Homo sapiens
atgagtaatcagacatagatctatacacaatcaccattcgactaacaatatagagactagagatgagtacacatagtagagattagactatgacatactctgtgagagaggacattctgatgctt

SEQ ID NO: 529962 - DNA, 676 bp, Homo sapiens
tacaggcatgagccactgtgcccagcctcaatggtgtttttttgaagtttttataatgctgtttttttcaaaaataaagatttcacatgagtttaaaaaatgaatttaactcatttttaatgaatttgtgatctcttatttcacagtataccacctttagagatattaatgactttcttggttatcatttgatatgtaaataaactcatattttaatgaaaataataaattactattcttgtgatcttagtgctcatcaaaagtagaacttagaccattcagtttacagctaatcttccagattgctaaatgaaataaaattatttttctatttagtaattcattatgaaagataaggaacctgagttttccctttttcatatgccttatgtctgacaacacattttgcacaatattctctattagaattttcttttcttttggtctagctctgtttggttatccctcttactagatgtgagcagccgtagcaatgtagtttttgtcccattcactcctctcaggcatgaatccaccttgtctaggagagctatgttctcaaaagtgaaagcagcctgtttgacaagtactgacatttgaaaatgctataaacctctggtggtgagatactgtttgaataatcttgataagttaaataccatgaattgaagcactt

SEQ ID NO: 529963 - DNA, 164 bp, Homo sapiens
ggtgttggggttccactggttcagccggcctccctgctggggcatgcacaggttctgtcgtctgtcacacccagcactccagccagccattccagcatcccaagctatcccatccatgcacatgttcttgcatcagcatttatcttggccatgcctccacaggc

SEQ ID NO: 529964 - DNA, 848 bp, Homo sapiens
ggagaacgccaccgatttgaggaagcccagtacaggttgacaagttggtcgcggctagggctccgcttggggaggggcaataggtttattacactggatctctgaatacccaggccccctccaccatggccatgccggggtgggggccggggtcgtggccggggaccaggttgaccttcgacgtggaggccgtgggcattgtggaaagcgggtgatgctttgtcactcccacccgaccctgacagccttctcctactcttgtctacttcctatggtgttccgcactcgaggttgctctttgccctcaggctgaggaaggggaatctgtgcctggcagttgatagcacatgatgctcacaggatgtagcgcatagaaggtggcgtcacacacatcatttcatctcggcacaagaccatggtcactcgctaaggcatgagatgttggagcggttgagtatccatgagcaatatatcaagaatggttcatgtgtccagtaatagagtaatgctcatcagtatgtggggaacccttgatctggctggcgtatagcttcgggaatggtaaagatggagaattgcgggaatattggagtaagggaacggtgttacgaattgcatgtctgcctccgggaggaggcgacatttaatgagctgaagtaagatagtgaaaggaaagctactttctcaaggtaattgggagtataccctatatactctgtgttagtgaagagaggaaacgtggataagatggaagttaggggatagatgcaggctgatgaaaaaggtgagaactaaagaagtaagagaaagggtaaaacacgaacgagaaacgttaaattgggaaagaa

SEQ ID NO: 529965 - DNA, 862 bp, Homo sapiens
ttttcgagaattatatcttggcttgttcctgtggcagccaaactttgaagctaatttttgactatgactaaggtcatgctccaaggttttgattaccgttccgggagccaaccttgtgaacaagtttggttacacccctttgtggataaaccagacaagacttaaaccacatgttggaggaaaacgttcccttggtgtttccactgctgtaacattggctgggataaaacaactatggcttttcagctttatcagaggtgaccctagtggaaattacgggggatggaaggccacatgcattggaaattatagcgctgcaactgtgtccatgttgaaaccagactattaagaaggagaaatgacccttgaagtccgcacttgctttagctatccaagtacttaataagaccctggatgttagtaaactctctgctgaaaaagtgggaattgccacccttaccagagagaatgggaagaccgtaatcagagtttctcacaaccaaaagaagtggatgcacgttgatccaaaaacacgaggaagaagagagcccaagctgagcgtgagaagaaagaaaaagtacacgaaagaaaaggataaatagaatccagagattttattactcactttggggcacccctttcacgtgtaaaagcacgtcctactcttccaaccaactagggaggctttaactttttttaactggtgccgtgggaaaataggacattacatactgaattgggtccttgtcatttctgtcccattgaatactttattgtaacgatgatggttacccttcatggacgttttaatcttccacacacatcccctttttttggaataaaatttggaaaatggaaatta

SEQ ID NO: 529966 - DNA, 133 bp, Homo sapiens
ggtctgatctttgattaagtttgtaataacaaatgcaagtgaaatattttatggatctatttgaaaaacatctgtaaaagactggggtgggggtgggaggccagcacggtggtgaggcagttgagaaaattga

SEQ ID NO: 529967 - DNA, 336 bp, Homo sapiens
  misc_feature (5)..(5): n is a, c, g, or t
  misc_feature (11)..(11): n is a, c, g, or t
  misc_feature (28)..(31): n is a, c, g, or t
  misc_feature (43)..(43): n is a, c, g, or t
  misc_feature (138)..(138): n is a, c, g, or t
  misc_feature (153)..(153): n is a, c, g, or t
  misc_feature (158)..(158): n is a, c, g, or t
  misc_feature (160)..(160): n is a, c, g, or t
  misc_feature (165)..(165): n is a, c, g, or t
  misc_feature (192)..(192): n is a, c, g, or t
  misc_feature (195)..(195): n is a, c, g, or t
  misc_feature (199)..(199): n is a, c, g, or t
  misc_feature (207)..(207): n is a, c, g, or t
  misc_feature (214)..(215): n is a, c, g, or t
  misc_feature (247)..(247): n is a, c, g, or t
  misc_feature (270)..(270): n is a, c, g, or t
  misc_feature (272)..(272): n is a, c, g, or t
  misc_feature (274)..(274): n is a, c, g, or t
  misc_feature (278)..(278): n is a, c, g, or t
  misc_feature (280)..(282): n is a, c, g, or t
  misc_feature (284)..(285): n is a, c, g, or t
  misc_feature (287)..(287): n is a, c, g, or t
  misc_feature (297)..(297): n is a, c, g, or t
cccanacacanacttctggctcccccannnncctctttccgtntctctgactaggaaaatgtgatttctctcagtttttgccatctacaccctcaggttaaacccatgagagaatggaggaagatgaactgggaaccnccccagatcagtgtngactncngtatnctgacagctcttgtctattctcagagnctncagnttgctttncaaaatnncgtccagaggccaggcatagtggctcacaccngcagttccagcgatttgggaggntnangtgngnnnannanttgagacagnagtttgagaccagcctgggcctcatagtgagacctcctt

SEQ ID NO: 529968 - DNA, 1432 bp, Homo sapiens
  misc_feature (39)..(39): n is a, c, g, or t
ggcgtcttgctgcgttgggtaagtgtaatctcacacccncgctgcgcttgtgtttatagagtcgcgcccacccccgcgtgctgcggtgagagcggcggctgtcgtgcggttcgtcgatagttacgtctactgcacctgagggcggctctctcactttctgttccggtcgcttcagcacgcacagcgttaggttgtaatcgagccgtcgcgttgtgtgtggtagtcatacacgaggagtagtagtggtgtggtctttccgcccggcgcgggcggggtgttctttgatagaagagcgctctcttcttgttttcggggctgccgccaccggctgtggattagtgcacgcgtttcttccttcgctactccccgcgctgcgctagtgagtagatgtggtgttttggtgttgcctctctcgcgtctcgtttggcccgggtggtggctaatctttctcgtgctctcattagggtgtttggtgtgggccccccactcgtctgttgtggtagctgactgcctcctccgtgttggtttgactcgaggagagggttctgggggtcgtggccgcacgggtatggtcgcgcgtcgcgtcgagtgtggctcgtcttctttgtgttgcctccctcctctttgttttgacgggagcgatttttcttgctagtgacggggtgttgttctcccgccggcgcgcttttgtttaggagaggtgtcgttctcctcttcggtagtgggtgccctgctagataaacatcttgtcatacagcacacgcgtttgtagtatcgacgcacaacttagtgacgtcccgcctcgtcgcacaccacaggtgctggggggggggaacaaatagtgtcgagatgacgcacgtatgaatgctgcgtccgttcagttgggagggagagaacacttgtttgctcaaacagacagtcgcgtgtgttttttacacaacggcgaggagtaggggggggggcccctctttttgtgtccccccgcgctctgtgtagttgttggtcacgaccgtagtttgttttttttgatcgagagcatgtgatagttgtcgtctttttgccacgctcgttcacacacacctgtggtgggtctctacgaggaggtcgcgtcagtaagtttgtcttgttaccacctctctttttccacaagggtggcgccacgaaacagatcgattgtgttgagtagatgacacccccgtccgccatcaagttgtggtcccgcgcggggattaaagacgatctttacccaccccgtggggtgatcttggagctattaaagaaatgggtattatttggggaacccccgccgagggttgagcatggggagggaagaatttataaaagatatcccttttttgatggagaggggggggaatttttttttttttttttataagaagtgtgtggggagaaagaagatttataaaacaca

SEQ ID NO: 529969 - DNA, 236 bp, Homo sapiens
gcaagctgcatcctgctggtgtctctagaggtatcccgcgttacctgtcctctttgtctggagaagtcaggactcccagcgtcattgcttgtcgcacatttggtctgacgcgcatccccttgtgagtacctcacctccccatatttccatagaccatgggttaccgacgctcgatcttctgtaatctctaggtcagtagctagtttccgtgtggtgaaaagcccctggcgattcat

SEQ ID NO: 529970 - DNA, 2079 bp, Homo sapiens
  misc_feature (1398)..(1398): n is a, c, g, or t
ccggcagccgcatgatttattttgccggggtctcttataagggtgtaagcaggcaggactcaggttggagggtggataaagatatgtatcgtagactcaacaagaggttctttgtttgtcacaccgactaaacactactggtgcgcgcgggtgggtggacataagagtagaccagtacgttccccttctgttgtcgagatgtatgctcgcgggcctacatattattagggggagtagcccacaactaaaagaagagacaaatagtttggtcgttgggaagcacacacaacccggtggtgttgttgtaagtagatagaaagagagagttttggggcgtaaagtatagttagtgttggtagtaagtactacgtactcgccctgggcgtatagagtgtgtgtcagcagagtagtgagtgtatgtgagaaatacttgtttttggtgggatagtagaaaatagacacgctctcttgttgtgttgtaagtaactcctcaccgagatgtagttcccctatctaggagtggaagtccccatccaaacgtggtggggcctacgatttgcgttggagataggggtggtggattctctaaaaaagaatgagtgttttcgttcgttgttttttgttgtaatgaaagatgggaaggaagtgtccttgcgtgcggatgggtagttggttgttcctgaccacgaatataagtttgtaaggtgtggtatgagattgttgtgttcgacccaccttgccgttgtggtggtggatggagaattggttgtgtgcctaacgagcttggggatgtgtgttatagtcgttcggcgtaagaataagtagttgtttgactcacagcgacggagtggttaattatgccatctcgcgcttctgcgtggtgcattgatacgttgtgtctacatacttccgtgcgtcatcatcggcgtgggtggtgtgtcatgatactgctccttccgcgtgacagacaacactacaagaatgtatggtgtggtggtctgcgaccacatcgggggtgggctccgctcaactattattatgatgttggctgccaacgacgacgagaccaacatcatgagtgttgatgttgttgaagaaggtacgtcgttcatccatctcctgcgtgatgaggagtgtggttgtcctctctagtagggttctgttctcctcccggttggggggtggttttgtactcctggtggggctgtggtgtgtgtgtggtggtggtgttgttgctgctgctgaggttgttgtggcggtggttgtggtggtcgcctctcgagatagtataattccgccgcgtctacccactacttctccatcagaagtgtcctcctgcgcgaggatagaatgccctcctcctgcttgagatattgtggtgctcgcgtgcccgcggcnccaccactgcacaaggaggtgtcgtctcgcactctcatatatttgtctccgcgggatgattagtaaaatagagttgtagtagtgttgtgtgattattattctactagtggagacccctctccagcagaagaggagtgggtctcagacgacactacaagtattgagcacctgttctgataatataataaaattagtgttgtgtcgtccactataatagatatagtgttgagtatagtccacacgacacacgacacactgtgtggggtatatagacacacacttaggagttaaatagagcggttttgcgcccatagttattgtgtatctcctgtctccgcctgagaaggtttttcgtctgtgtagaggaatagatgtataaaaagacgcgtgaataataacccccagagtgttgtagatttgtggtaaagatccatgtggagacgttctctatgtgggtaaacgccacatatgagttgtgtgtggaataacacacctggggacatcaaacacacacggggcgtgttataagttgttacagaaaaccgtgagatgtgaatatatgtgacaccaccccagctcaccaaagattgtgtgttttatagaggctcaggacgctttctccaatataggtgcgcctcatatagttaataagtgctgaatgttgtgtgtgaaaaaatataa

SEQ ID NO: 529971 - DNA, 106 bp, Homo sapiens
  misc_feature (93)..(93): n is a, c, g, or t
cttttaatcatgttctactccaaaaatatcagcctgatgatgaatttccagcctccgagcaaagcctggcgggcctcacagatgatgactttnttcatcttcttgc

SEQ ID NO: 529972 - DNA, 972 bp, Homo sapiens
agcggggttcgcgcgcgcgcagccccgcgatgcgacatcttgtggctggctgcctagcagctgaagcctaacgctacctcgagttatgatgtttgacggccatccctgagggatcagggtacacgctgtgccatttgtggactgtcagataactcctgctgacgtcagaatcttgccgaccagaatgctcctcctgttagcttgatgtatcatctgtaccttccacgtacgtcgagttggctgagtgcattgcgtgtttacgtcctccatcgatctgtcaaaggccctaatgggtatctgtaggcgtcaagtggagtacgacctggcgaaacttagactccttcatgaggcaatgaatctggatatgtcatcgcatctttaccttgcaagcgtaagatacttgtgtcgcaacacaaacatggggctgtactttcaagtcgaatacaatcgctagagagccgtatactggggcattgcaaagttccgtggtactccaggggccctagcaccaattgcactacgcttggttccgcattacacttctttcctaggaccaattacttgttccttcttggttccccattgtatccgtttcttggccttaacatcgttacaaccgcgttcgactctaaaggagggcgtgacaagagttgtctgaacaattccaacctggagtgaaatttctattcccaaatatttgcttttgccatggggtttcagtgttgccagtttgcatggcaaggtcgcattgcgggggtcacacatctgtacgaacaggggtaggaaggggctactcccggggtagatgagtcccgatcttcaaaagcttgcagggaatttgaactttcccttaaccggggggtttcccgccctttaccattcccatggggtcccttaggggtgggctcctattcctccccttgggacgcacttttcttccaaactgggaggtatcatccttatggttcgatc

SEQ ID NO: 529973 - DNA, 100 bp, Homo sapiens
tcgcaaggatgagaaattgctctgacatgactcactttctcttctgaagcaattccaagttcacttctctgcccactgacagttcctcatcccttgggag

SEQ ID NO: 529974 - DNA, 652 bp, Homo sapiens
  misc_feature (46)..(46): n is a, c, g, or t
  misc_feature (61)..(61): n is a, c, g, or t
  misc_feature (66)..(69): n is a, c, g, or t
  misc_feature (72)..(72): n is a, c, g, or t
  misc_feature (75)..(75): n is a, c, g, or t
  misc_feature (80)..(80): n is a, c, g, or t
  misc_feature (87)..(87): n is a, c, g, or t
  misc_feature (89)..(90): n is a, c, g, or t
  misc_feature (94)..(94): n is a, c, g, or t
  misc_feature (96)..(97): n is a, c, g, or t
  misc_feature (106)..(107): n is a, c, g, or t
  misc_feature (117)..(117): n is a, c, g, or t
  misc_feature (123)..(123): n is a, c, g, or t
  misc_feature (137)..(137): n is a, c, g, or t
  misc_feature (139)..(139): n is a, c, g, or t
  misc_feature (151)..(151): n is a, c, g, or t
  misc_feature (175)..(175): n is a, c, g, or t
  misc_feature (178)..(179): n is a, c, g, or t
  misc_feature (181)..(181): n is a, c, g, or t
  misc_feature (184)..(184): n is a, c, g, or t
  misc_feature (196)..(196): n is a, c, g, or t
  misc_feature (205)..(205): n is a, c, g, or t
  misc_feature (213)..(213): n is a, c, g, or t
  misc_feature (219)..(219): n is a, c, g, or t
  misc_feature (221)..(221): n is a, c, g, or t
  misc_feature (226)..(226): n is a, c, g, or t
  misc_feature (228)..(228): n is a, c, g, or t
  misc_feature (232)..(232): n is a, c, g, or t
  misc_feature (238)..(238): n is a, c, g, or t
  misc_feature (245)..(245): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (283)..(283): n is a, c, g, or t
  misc_feature (286)..(286): n is a, c, g, or t
  misc_feature (293)..(293): n is a, c, g, or t
  misc_feature (298)..(298): n is a, c, g, or t
  misc_feature (303)..(304): n is a, c, g, or t
  misc_feature (323)..(323): n is a, c, g, or t
  misc_feature (377)..(378): n is a, c, g, or t
  misc_feature (380)..(380): n is a, c, g, or t
  misc_feature (386)..(386): n is a, c, g, or t
  misc_feature (392)..(392): n is a, c, g, or t
  misc_feature (413)..(414): n is a, c, g, or t
  misc_feature (430)..(430): n is a, c, g, or t
  misc_feature (445)..(445): n is a, c, g, or t
  misc_feature (449)..(449): n is a, c, g, or t
  misc_feature (475)..(475): n is a, c, g, or t
  misc_feature (494)..(494): n is a, c, g, or t
  misc_feature (523)..(523): n is a, c, g, or t
  misc_feature (525)..(525): n is a, c, g, or t
  misc_feature (530)..(530): n is a, c, g, or t
  misc_feature (547)..(547): n is a, c, g, or t
  misc_feature (551)..(551): n is a, c, g, or t
ccccacgcagggacgccagggttccctcccaccccgtgatcaaganacggaatcggctgcngatgnnnnaancgnaatgngcccctntnnaaanannttccccggnnatctaaaggnaggatncggctgggaaaaananaactggaatttntcgaaggttgatggtccgcagggntgnngnttntaggtggttttnttggttccnctggtgtntgtgtntnttttntntttnttgttntccttanattatttttttgaacttntngtanaggtccagcatgtnggngcccccnatgcnctgtnngaagttgggccacgcttcnttgaagaaggctttgcccccctttttttttttgttttttttttttttttttttnntntttgtntttttnttgtttttttttttttttttnntttttttttttttgtnttgttggtttgtttntttngggttggttatcatgttggttatggngttatggtttgtgcgattnttcagctcatcacgatgtgcgtgtttttngngtttnggggcatgctcttgtgncgtntcgtacacgccgaagtaggccgcccggtagatgatgatgccctgcacggtgacactgaagctctggtacagccccggatgccgtcggacttggtgatcttc

SEQ ID NO: 529975 - DNA, 100 bp, Homo sapiens
gccccgtctctatcgtgttctttccagtgttattttcagctgttcctcatcgtgagcctgaaggcctcgtagcttgattctccttcttcccacgggatat

SEQ ID NO: 529976 - DNA, 962 bp, Homo sapiens
tgataaggatggtacttgcatatggtgaatatactactgtgacagtttccgcagaaatcctatttcagtggcaccaactattagtggccatggcagcaaatgccaaaccattattagtggcacatcagcagcagacatctcacaagagcaccctaggttggttatctatcgttattgtttatctcttgttttttccccgcttctcctgcaatcagcagggcatggaaggcagggtcagggaagttcatgaattactccttccagtagtagctctgaagtgtcacatttaactatcagtctattgttttacaacatgattctagttacaatgtagaagagagaagaacagaggacagtgttcaacgtttgtaaactacactgatttagaaatttagatgttcattactatcagatagattctgaggtattcgactagactctgctactaattgatctgcctattacgttgaccagaggatagaacgcaagggctgaaataactacgggccttatagtaacaacaaagacaatacggacacgccacatagtaacacgagcacagtagacgcaccagcgaggggaagatatgaacgcgaacacacagcctcacctagacatacacacgacaacgaggcaccctgccatgacacccaatgcacccacaggaacgagcaaccacaaaacccaccgtcacacaccggcaaaagagacaaacaacgacagaccaacaacggatccagtgacaaatcaggacaagcacccgacgagacaacacgccaagccaaacaccgcgcacaccgctagcacatacaacgcgacacaaggcgacctagaactaatcgagacagaccatcggccaaccagacaccgcgagccagaccagacagaagcgggcgatagacacaacaactgacataggaggaccaccaaaccaaggcgacacaaccaacccacgaaaggca

SEQ ID NO: 529977 - DNA, 448 bp, Homo sapiens
tagtgttctgaggatcccgtatgctccagcagcggggtagcgatgaatccaggtcaggactacgatgaaggagcagaggaacacgggccaggtgtccctgggccagctccaggctgtgggtgacctatggcttcccagcgtggggccacagaagtaacaggggctagaggaaacttcaccccagagttgctgtcagctaccaggtcctcacctaggagaaggccaccccaacctccatctggttcttgcattgccaaggtacctctcactgtattcttactggcgagaagagaatctaaagacggtaggtgtagagggctgtgggtctagacgactccagatctccagatctattgcacagacctgaggttgcaagcctagaatgagctcagaagccagcaggccgtagagagttggtgcatcggatctagtgcagaatacaaggagg

SEQ ID NO: 529978 - DNA, 687 bp, Homo sapiens
  misc_feature (585)..(585): n is a, c, g, or t
atatgaaaagaggatacagaatgattttctacagtctttgctatggttggtaagttttaatcaagttgtgtaatttaacatctagtagattttattataaagctttttatttgttttttttttttttttaaaaaaagggtaagcaaaaaactgggaatataggataacggaaaaggtctaaaatatacttttagtcagagttccagaaagtgaaggggtagagagaagtggggccaagtcattattataagaggcaattaggacctctacagaacgtgaggaggagggtgtcagaagtttagccgagaaaaaaagagagattactttcaagaaaagaagaactctttagacagtgtgatagctagttttcccaacgaggtgacaaccaattagacttgggaagtgatagcttataattggccaggggaaattacctatcaacggataatggtaggccttgcaaaaatttttttcagtaagagtgtgaattgtgagaaaggggcaccagcagagtctcagtgaaagaaagtcccaaagggtcgattaaaggtgattttacctattcagagacccagaagggacgtngagcaaaacaggtaaataattacttgattaaacctaaggtgaattttaacgtgtgttaagcaattattaggtcttataggatttctataacaacacaaattg

SEQ ID NO: 529979 - DNA, 1191 bp, Homo sapiens
  misc_feature (463)..(463): n is a, c, g, or t
aggcctagtctgcttctgtttatctgcctgtctccgccagctgcctcctcttcctccttcgccaccgccgccaccgccgccgcctgcccgcagcaccgctagcccctcccgccatggccgccgccggcgcccggctcagccccggcccctggctcggggctcctgtggggctggcctgcaggctctagcttccaccctggggcctgcctgccactagctagcctgctagctagctagctagtatcctagctacctagctagccgctctaccgccagcttagctaggcctggcagcccaccgctctggttgcctctgctggtgcagccctgcactagccctgttgcctggctttgcacagcacctgtccacgtgttgtcccaccactttgccctgctccttgctggtgcagtcagctgcacatcaggcttggtcagctgtgacgtcctcgtacgtcccgtgggncccgtgggtgtctgtgtgacaccggggggtcccgggacagccctgacccggtcctgaccggccgtgcgtttcaccctcgtgtgttctacttcgcttgtgtcttccttgtgcccgtgcctaccggccccgtccgaccagcctcgggcgtccccttccccttgaccttccctctttgggtttgccggttacactgtcagacttgtcacgggggggacgccgcttcgtgcgggttgccatgtggtccgcacccttgggacaccacactacccggtagcccttggccgctttccctatacagcgccctgggagggcagtggctaccttgggcccacacccagtgccggcgccggtggcgccctatccatcccggcctttgtgtttgcccacattggggactgaacccctgggcaaggtttggcaccattgtggctcagagacctattgtgccccccgtttggatcaccttatcgccctacggtatctttcccgccttgtcaggccaagtcctcccgggggcgcacgacgccttggaccccccaagcgctcacgtcccggggcgcccccagcatcctacccactgtgatggcccgtcggtgcatcaattgtatggccggggatgcactgacttcacccatccctccccacgacttttatcattgttacatgtggccgggccatcagactcgcgaccttgtgcttgcgtgacatgtggttgctggaactattac

SEQ ID NO: 529980 - DNA, 361 bp, Homo sapiens
atcagctccagcaccgttacgaatctgatttctctgatcaaccaaattgtggaagatgcggctatcgaagatctccgatatgccgttggtcaactcagtcattgagcgtcttcatgcttcccaatcacgtttgctcaacggagataattctgcactcgcagttttgagaaagctcaatagtcttaatagggctggtgaagtggttttttccggtttgatgtgctttggtgtttatccccagcaattcttcccgcagttgtttatcgatgtggcgaagcaccccggacagcaaaaatcggcagatccagaagtacggtttgatcatcgcaaggtgtgtgaaggccacatcaaaggtcgacgc

SEQ ID NO: 529981 - DNA, 107 bp, Homo sapiens
ttctagaggatcccaggggaagcttgctcaggttgtgaggctttctttcaacaagaagaaagagcaagagcaaagactaaaagacttcagttgccaagttgcgtgtg

SEQ ID NO: 529982 - DNA, 180 bp, Homo sapiens
gtaatggtggaggaggtggtgatggtagtggaggaatgtggtaatggtggtggaggaggtggtgattgtgggggaagaggaggtgatggtagaggaggaggaggtggtgatggtggtgaaggagttggtgatagtgggggagaaggtagtgatggtggaggaggaggaggtagtgatggt

SEQ ID NO: 529983 - DNA, 308 bp, Homo sapiens
acatgcagatactgacatgtcgcagatttatcagagtcgccctagtatactgcagaaggaggaaacagatgagctaaaacgggttgatgatccaggtttgatgctcatggtcttcaagctgccgatactgctgacgaatcaccattacctgcagccatcgctgttcgtgtacccagaggagtcgctggtgattgagagctcaaccctgctcagtgctctgctcatcaagtgtctgtagaaggaggttgcagcattgcgcagatacacacctcgcagatgacgccgatgtagtatctgctcgacagcca

SEQ ID NO: 529984 - DNA, 529 bp, Homo sapiens
  misc_feature (17)..(17): n is a, c, g, or t
  misc_feature (54)..(54): n is a, c, g, or t
  misc_feature (62)..(63): n is a, c, g, or t
  misc_feature (83)..(83): n is a, c, g, or t
  misc_feature (134)..(134): n is a, c, g, or t
  misc_feature (146)..(146): n is a, c, g, or t
  misc_feature (178)..(178): n is a, c, g, or t
  misc_feature (187)..(187): n is a, c, g, or t
  misc_feature (231)..(231): n is a, c, g, or t
  misc_feature (250)..(250): n is a, c, g, or t
  misc_feature (253)..(253): n is a, c, g, or t
  misc_feature (369)..(369): n is a, c, g, or t
  misc_feature (371)..(371): n is a, c, g, or t
  misc_feature (462)..(462): n is a, c, g, or t
ttttaaaaagagtaaanggttttttttttaggcagaaattaaatttttatcccnaaatcagnnggaaaaatataaggggcaanacaaaaagatgtatgcaaacaaaaatgttttaaatcaggtcagatatttgngggaaaatacgnaattaatgttaagagcaagtagtttaaaatantccaggaantgagaaacaaaacaaagcaattgtgggttttgagttccatatanttttagcaagtaagggggngtnttgcccctatatattattttcccggattccactccctgttgtgggaatcgcgcccacccccatccgtgtgttgtagccactcacggtttgcatcaagagtgttttttgtaactgcntntggacttgggacagtgagtaggatcaaaaataaataatgtacatgacggggaagggaaaaacctgttggagttgtttccagccagccacgntccgggccagcatgttggaatccagcgtggagcagatgcagtaaaaatgtggttggtttctgtgtgg

SEQ ID NO: 529985 - DNA, 726 bp, Homo sapiens
  misc_feature (365)..(365): n is a, c, g, or t
gacgggcccgaatcctcatgtgaatggtgcagttcctaagccggagcggaggtagaggcgggtcggactatccccttctgatcctccagatgccgacgggctcaagatcagagcatggccagagcttgacggacttggcgggacggctgcccgccgggccctggggcatgggctcggccctgaatctgtctggctggtgagtccgggcgtccgctggcctacggatgctgcagcagaaatcatgtgttcaccgtgcggaatgcgcaggcgacgaccagaagctcatgcttctatcaagttcggatcgggtagaagatgcacgtgaggaccatcctataccatgtgctctgacgggccgttcattntgcacgagactccactatgtgtttctcagatatcccactcttatcattagttgtaactattaccgggagacgctaagaatcacctcgaaaacatagattctcactttcgcacccgttagcagggcgtcccagaatggatccctaacaagaattgtggtggtaaacttacttctcgccatggcgtagctagttagttgcttcgagcgccaatatttgccgtcaggaaggcatttcgcttaggaccagttgttatccgaagacgacgccataggggggtcgtgggtagcctaaccggagggaaagcgaagctggtttgcccggtccaatttgttcaaacggagggtgtcctccaagagatgtg

SEQ ID NO: 529986 - DNA, 184 bp, Homo sapiens
ctaggctttaaaattttctggagttgatcatagccaatagttaaacgcggtaaacccaccacataagggccaatttcatactcgccatattgcaaaatcagaccttcagtacccaagtaataattgttactcaagctaaacttccacgcttgctcatattcatcgacattggtcgctaacttag

SEQ ID NO: 529987 - DNA, 480 bp, Homo sapiens
  misc_feature (179)..(179): n is a, c, g, or t
  misc_feature (239)..(239): n is a, c, g, or t
aagcaggagttggcctaaccggaggagcacttactacgtgactgtctctatagatgtacctgatctggacattgcatataaatgatactcggtaatatgaggtcttgggtgccgtggcttctttcacgttagcataatgtttccagaggtcatccatactggtactatatatgtatcanggacttgatttcctttttatggcgtgtataagtatttcagttgtataggatataccacangttggtttattcatctagtggatagacatttagatggtttccacctttggacggttaggaatattgcagctatgaatagtcatgtacaatttggtgtttgaacacctgtttttcagttacacatctagagtggaattccggagtcatacggtaattctgcttttaaccttttaaggaactgccaaactgttttctacaaccactgcactccagccgggacgacagagcgagactccatctc

SEQ ID NO: 529988 - DNA, 1000 bp, Homo sapiens
agcgggctgcgcgcccggcccgtcgcggacctctccgcgggcggagaccctgtgcgtctcccagcgcggctctcgggcatcagtgctctactggcgaccgcctgcgtggccctacggtagatgatcctggtcgctctcgcgcgtgctgtcactggtgtaggggagcacgagaggcctcgctcataatccatggcccgcgccggcggcaagctcatggcgcacgggcactcggatcactgggggccaggctcctgaggcagagacagatggaccgccccggacgccccgagcaagggaccaacgcagaggacccgaggtacttcagcgggacacggctcgactaggatagtgagacatgctgtctcaccgttcgcccgagacgacgtgctagacgctttcgctacacctgccttcgtgatccacgacgcactcgtcggcctcggtggctctgacgagggtcgaatctgcggaaaggcgaggacttcctgacttgagtcgtctgggcgaagaggtcctcgcgtcgtgacaggttgagaggctgcctgtgacttggacgctgactgagatcctcgtcgaggctattcatggctacgtgtgtggcctagggccatatgtggcttagcattgcctccagtcgttgccattgtgagactattccattttcgggatagaaggaataggagcaattgcaccttcagaacgccctgcatgagaggcaggaggggagcaacgattgaaatgttactgtgggcagtgtgacctcgtgagagacgaaaaacaagaatgaagttcgtgtacagtgctcaaggcacgaatgggcagccattgggtggaagcttgcttgcatgagactcttacaaagttttcctgggaccatccaaggtgggtaagttttagagatgtgggaaaatccgagaagaaatgctaaaaagaggcaaagattgctattcactgttgattggaaggcgcaaaggaatatattaaggccaagtggtggacc

SEQ ID NO: 529989 - DNA, 600 bp, Homo sapiens
ctgagctacggatgctgcgattacagatgactgatcggcatataagttgcgcagaacagtaatttagatatatgtcagaaactagcctgaacacaccaactgcacctaaagttacgctctgatgcatcgttgacataaagaatggagtcctgctcttgaaggactctaacaccacagttcttggtggtgaagaggagacaccttattgagaaatgggagatacagagaagcttatcagaacacaatataggcaatgttggaactcgacgtggaccacagtcttttgggcctcttggacagaagtgtgtatcttatggtccaagtggttagcatagaactagagcgaagaaatcattgcagatacagtgcctgcgtgactagcaaagaaaatgtgaatttgtcaacgtacggtcgtattgtggaagtgcaagagcatgggaccctgacattgaagatgtgctgggggtttagaagttactcaattggctgctggtacccggataggggaggtgtaccgcacgagaagttaccgaatttgtcggacggcaatgggcgttaattccgaagcaattgaggaggtcttatgggttggcccccttc

SEQ ID NO: 529990 - DNA, 512 bp, Homo sapiens
  misc_feature (400)..(400): n is a, c, g, or t
  misc_feature (419)..(419): n is a, c, g, or t
aggaaaccccacactatgtaatactatgctaaattttgtgtttatccttctctggttttcttcagagctttaccaaatatttgtattggtaagaaagtattgtttggttttgcatgtgttatagactgacttgtgcttgtgcactgccccctccctccctgtcaccatccccaattcgtatgttgaacccctaactcccaatgcgattgtagagagggcccttaggaaggtaattaaggttaaatgaggtcatagggagggctctaatccaataagaccagtgttctcaggagaagatgaagaggcaccaggaggcatgcatgcagagaaaagccactctctgcgtgcagagaaaagtcatatgcaagccatggagagaggcctcaggagaaaccaactntgctggtcccttgattcgngaccttcagcctccaggactgtaaaaaaataaattttctgttgttaagctacccagtagatggtattttcttattggtgcactagcagactaa

SEQ ID NO: 529991 - DNA, 152 bp, Homo sapiens
agactgatggttacagtcaatacagagaatccatgtcctggtggtggtcgttgctaatagaccacacaatggagaacacttaccactggaagaccgatacgtccaagaaggctactgaaccgagacaccccacaacgtgtccaccctccgtc

SEQ ID NO: 529992 - DNA, 146 bp, Homo sapiens
aagattggagaaaccccgtctcggctaaaaacacaaaatgggccgggacgtggtggcgcatgcctgtaatcctagctactcaggaggatgacggggggaaaactcacttgaaccccatgacggctagtgggcgttgggggtaccga

SEQ ID NO: 529993 - DNA, 115 bp, Homo sapiens
ctagatgcttctccatgaggtctctcctggtgtcaccccagctcccgggagtgactctgaaatgttatttgagcactgtgcagaaacaacctaacagagcaggcttggctgctgt

SEQ ID NO: 529994 - DNA, 787 bp, Homo sapiens
ggacagtgctgacgctacaaggctcggagctccgggcactcatacatcgtgagttggtccttggacccccggaatgtagttctctacttctatgctcttgaatttctctcttcaacatgtgtagcatatgttgctggccagagacaagcgtgtgtgctatcttgaggatgagatagtatggcggttgagttattcgtccaaccgtactctggtggccattgctggattttgcctgttgtatgtatactaagaccacgaagtatgatgaaggactctactggtacgtattgtgaagggagatcgtttgcatcaatgtttgatgaaatgaatacatatcagaagtgctaagcaggatgttaaaagcaatcgaggtcacttatcatcctgatgaatcatcaaaagaaatatgatagaggctgttacttagaagtccaggaagatgttagaagaaattactgaaatatgaagcatctgatttaaagtagtatgactcaagtattcgatattgtgccggaaatatatcagttcaaaccttacgtccaccacgattgtgtaacctgcacagaccacaggtcaggccacatggcttgaagcacagtgaccagggaacctgggagacggccgacggtgcaattccgtggattatccgctggggcaaagcctcgttccatggacatcggctccactaaggtgcgcgtcaacaagatccgggcttttacttcagttcaacacctctgcacagcttacccagacaattccttactctacctgtgccctccgatggggc

SEQ ID NO: 529995 - DNA, 453 bp, Homo sapiens
  misc_feature (22)..(22): n is a, c, g, or t
  misc_feature (31)..(31): n is a, c, g, or t
  misc_feature (68)..(68): n is a, c, g, or t
agggaaagaatttataatttangggcaaggntaaattcccacgttccctttaaaaaaactcctgtttncttttaaaatacatttttttttcccattaaaaatataacaacaaaatgtggtctctatatacaatggaatattactctgccttaaaaaagaagggaattctgacccaggcatggtgcctcatgcctgtaatcctagcactttgggaggctgaggcaggagcatcactggagcccaggagtttgagaccagtatgggcaacagggagatcctgtctctacaatgaatttttaaaaattagccaggcatggtggtatatgcctgtggtcccagctactcaggaggctgaggctggaggattgcttgagcccaggaggtcgaggctgcaatgtgtcatgattatgccactgcactccaccctgagcaaccgagcaagaccctgtctaa

SEQ ID NO: 529996 - DNA, 1823 bp, Homo sapiens
  misc_feature (318)..(318): n is a, c, g, or t
  misc_feature (369)..(369): n is a, c, g, or t
  misc_feature (475)..(475): n is a, c, g, or t
  misc_feature (642)..(642): n is a, c, g, or t
  misc_feature (1065)..(1065): n is a, c, g, or t
gatttaccattccagaagggacaagaatatcttcgagttgccggacaggagtagagaggtgcggtgtaggcaatctgcgtccacatgggcctttcagcgagtggactggcgatgttccatctcgcagccctcgcagcgaacactgaagacgcggtgcacagtcgttcgagagacatcggacgacatgatgaataggagaaatcctcgcacatgatggagctcctagcctatcccatgcgtacacgtggtaacatatcagcgagcacagagttgcgtgcaatcgcgtccttgcgcaacacgatggcttacgcattggcnccttctcgcaatacgatgaatcgatggagacattggtctacgatagctagnaggggcacgatggcgcttccgtctactggatgccggcgatgcctcctgtgtcgtgctgtgtaaccacggagaaataaaccaatcttagacagtcggactttagacnctgacgatgacttcaaggcacagtgagtctcgcaggcgcgcctagggtttggactggaagtctgtcgcggaagcgggacgtgccggtaactcgtgttgtatccactgattcacaaactcctgagaatcgcgcacgcacagggggagtggggacttggactgtgatgntgactgacgccccagtggagtgcaccagccacaggcgaaactcctggcccagttgggtaactggcgcaggagactccgtgggacaagacagggagcactcaaagtcgtagaacactcgtctgcggtgactgtcattgacgctctctgtcaacgggaacttggcttcactcttgtccaaatgcagaccttcctagggaccacaaatctacttggggcgaccctatgcatatggcacacgtggaacatataacgcggtcaacattttataccagttgcgccatttggcggatacacacccggtaaatagaaatggaacattttgggcccattaacccacatattggagaacgaaacccattgggggtgtcccgccgtttgtgggcatgtttgggcaaggaccgtttggtcctttggggcaatggngaatcacagatggtgcccaaagaacggcaccgccgtctgactgtcccctcggggaatttcgtacggggaacccactgcggcgcaggcaaactccgccggaacttcctacttcggaatttctcggtttcccggagagacattggattcggtggacaaacctttgtaagaacttctgctggtgtgaaccccttatttttgaaacgcccccggattgggcagggcatagacgttaaaaaccactgtgaggtggtcatccaacacaacaagagcgaacctctctggtgggcccatttgggctcagcgtattgtgaaaacttttgtgcgaccccttggaagatccgggcggggaaaaacggagaattgggtcacacagcaacctctcaattgtgaaaccaagtgcaccccacaacagattgctgtcatgcgcgaggagtctcacaacaccgataaacgacggggaggaaaacaaaaacgataaagcgacaccacaccgggggccaaacaaagagacgggcacagaaaaattagagaccaaacgagagaagccgacgaggcctacctagtcaaacaaacaaccgtatggggtgaggagaccgaaagaacgatcgataggacattgcgtaaagaagccaccgcacggaagggggctgaatcaaacactgttaccaccgcccccgcggttacatcacatcaacagcgccgctgtaggacgaacgaccaacatgagagggtgcacacaatcgagaacgacgacgacg

SEQ ID NO: 529997 - DNA, 195 bp, Homo sapiens
tttttctttttaaaaaaaaaaaatttagggggtttttagaccccatgtagatttttaatgaaccaaaaatttaacccccaatatttaaaaggaagcccgaaggaattttaaacccttgggcttcccatttttttttaaaaatccccaaaaaacccaaattggcccctcccctaaaaaaaaaaattgggccgtcca

SEQ ID NO: 529998 - DNA, 138 bp, Homo sapiens
tggcattgatggctcaactctcctgacctcatgatccgcccgcctcggcctcccaaagcgttgggattataggcatgagccatgtgcctggtccaccttggcctgtatagtaacacctttccttgggctcagcaactt

SEQ ID NO: 529999 - DNA, 111 bp, Homo sapiens
cctgtgttgcatttgggcatttaagggtaaatttctatgacccttaaatgcccaaattgcaacacagaattatttttccaatttcaaagagactgatggagatgaagatga

SEQ ID NO: 530000 - DNA, 673 bp, Homo sapiens
ctccattacgtgctactgatgcatcgcttgctggatccacataagtacagatgcgacaatgtacagcacatatgtgaagaatggtaccgtcgttgacatccacgtatagatcgggcagcatctccgagtacctgagccaggacactgtgtctgtgccctgccagtcagcgttgtcagcctctgccctgggcggtgtataagtggagaggcaggtctttggggcggcaccaagcagccaggcatcgccttcatcgcagccaagtacgatggcatcctgggcatggactacccccgcatctccgtcaacaacgtgctgcccgtattcgaaaacctgatgcagcagaagctggtaggaccagaacatcttctccttctaccagagcagggacccagatgcgcagcctgggggtgagctgatgctgggtggcacagactccaagtattacaagggttctctgtcctacctgaatgtcacccgcaaggcctactggcaggtccacctggaccagtgtggaggtgggccagcgggcttgacctgtgcaaggagggctgtgggccattgtggaccacaggccttcctcatggtgggccggtgcatgaggtgcgcgagtgacaggcctcgggccgtgcggtgatcaggcgagtacatatccctgtgaagggtcacctgccg

SEQ ID NO: 530001 - DNA, 518 bp, Homo sapiens
gtgctgcgtgagatctagaggatcccggggggggctatgtattgggtagtcgcggcggcatatggtagcggagctcgaagtcgtagtcctggacctagttgtcgaaggcacccaacacacgtgcctgccctctctttcagctccaggtgccgctcagctcgtcggccatctgagtgagtgtcacgattcatggcataggctgtactccccatctgcaatagtatttgggctccacttcactgatctgcaagtttgcagggtgttgcaataggggtgcagggcggaccggttactcttcctgacatgcagtgagacatatttggcattgaagtactctatcatggctcgagagtgctggtccatcagtttctgagccagaactgaggcgccggatgggaacgctctcacagccaatgaggtgatatgtccatggggcacatcatctgggtccccttccattaaggccaggacataacccacaatcttcccatactcgtccacagacatgtacgagagct

SEQ ID NO: 530002 - DNA, 337 bp, Homo sapiens
tctgccttgggctcagctatagctggggctgcagcagcagacaggagcagctgtggtggcagcagccacaggggcagtagccacgaagggcagatggatcagccaagaaggccttgacctaagcaggacgtgggccggtgtacatcggtctccacagatcaggccaggactcgttagtacccgttgactaagtgaatggggtactgatgcaacaagtgggtatgcacatctgcagaccgacactggaaacattgcggacacacctcgcaggaggtcggagactgcagagcttccatctgtgagtatcaagcagtacagggggggaaccatctagagt

SEQ ID NO: 530003 - DNA, 339 bp, Homo sapiens
tgaattaggaaggatcaaaaaaaaggctttggggggagaatttagggcccccttggccctttagggagcagaccttccactgccattgtcctgtgagccgccaaaaaccccaccggggggccggcaggtcccggtttagggcagcccagggcccccattctggggtcctcacaattgcctcccctagggcggttttccagaccctcctccttttttttccccacatcggcccctggtgttcccattttggggttttcaagtccatgaacagaaattgtggcattttccccaatggtgattaaacataataaacaatccagaaaagcagttttgcccaga

SEQ ID NO: 530004 - DNA, 519 bp, Homo sapiens
atccccaacgccatccagatctgcacggagagcgagaagcatttcttcacttacctttggggcccgtgaccgctgcttcctcctcatcttccgcctactggcagaatgcactgcttgaaaagacgctgatgtccccgcgagctctggcacctggtgcatcagtgctacggctcagagctgggcctcaccagtgaggatgaggactatgtctcccccttgcgagctgaaactggtctggggacccccaaggaagtgggacgatgtgatcagcacctgagcgacaatcacactccatcgggggcagctgaccgcagccaggagccaagccacagtgggttcgcgccgaggcacatagtacacagcccaaaacttatccccgagccagccagcgaccgcagaccatggggcacaggaggaccaacggaggagcaggtagaaagccagaccagacgcctcctccagcacagacagtgaacccggatggactgaagaccccgagccacagagccccacacagac

SEQ ID NO: 530005 - DNA, 108 bp, Homo sapiens
tgtatgaagagaaatcaaatgagaatctaattccagcttggatgccagttactcttgtgacttggaggaagttctttaactctgtttggtattggagtttacagagag

SEQ ID NO: 530006 - DNA, 279 bp, Homo sapiens
tttttttttacccccccaattcccctgggaccccccccccctttttttttcccccctttaaaacccccgggccctttcccccccccggttttttctttggccccggggggggtttctttttttccccgggacccccctttcccctttggccctttttggggccccttttaacccatttttttccaaaaaaccgggttttgcccgtccgggttttcccgggtttttttccccccccccccccccccccggtgggggggggggggggggggccgggtggga

SEQ ID NO: 530007 - DNA, 724 bp, Homo sapiens
ggtggctttgagaagcacccagagcactactgcgagcaggtctggctgcagatgcctgggctgctcccatcgccatgcagatctacaagaagcacctggaccccaggcccgggccctgaccacctgagctgggcctgggctgggccagctggcctgctgctgcctgcaccgccgggccaaaaggaggcctcctatgacccaggtgtacgagaggctagagaagctgcaggcagtggtggcgggggtgcccggacatttggaggccgcctagatgtatccctccttcctccgtcaggaggaactccctacgtgtccagctactggcatgagctccacagtggggctgctccatggcagccctggcagcgccaatcatggagccagtgcccaggcatgcagagacagctgcagagaggcccaagcagtccgtggacagtgactagagcctaggcgggctctctgctgcgctgcgctctggacacttgacctccaaagctgcacctctggacccagcacccctcaggaggccggctgtcctcagggggactacggcagtgagaatcgagctgggggaggtggacccaggatcccggaccacaggcgtgaaaaggactggcccttgtgcatgctctgcgaatcatcgtcgtcaagagccaccgcggattatcatccaaccctggcccgacagaagatggtccacatgctggccctgtacgagtgatgg

SEQ ID NO: 530008 - DNA, 453 bp, Homo sapiens
cttagtggctggcagaggggactcttttccccagtgactcatatgctcctttttttctagctgaatttcagttttattttcagctccaatcagtggcaatagaggaatccgtgtgctttatttctcctgctccacattcctccccacagtctcccagaggctaacattctcccatcctccaaagagaagaaatccacagcccagagcagagcaggcctggtggcttcatgacagtcatcagtgtggccccatctactagtgctctccaagtccagcaatgtgttaacccttacaggcattatcccatgtaacccctaacagccctaggaagtagacactactagtacctataattcacaggtaagaaaactgaggttcagaaaggcaaagtaactggttgagggtcacacagctaagaagtcgcaaagccagagtcgaaaatattcaaaacca

SEQ ID NO: 530009 - DNA, 333 bp, Homo sapiens
ctctccacaccatgattccttcaacaacatgtttcaagctttcccaggtagggcacggtgtcctacagaaaaactttgggtttgtctttcccagcgtcttcctgctgttaacagaagggagggcacttttggtacgggtggccatggaatcaacccattgggatgcgtgttgtacagttttaaccaggtggttgaaaggctcattccatgtcctggttgcccggcccatgggagtgcctttccggatctattttcgtaggttcattacgtatgtagggttctcatttccttcagtttatttattttctacataaaatgataggttatacctta

SEQ ID NO: 530010 - DNA, 350 bp, Homo sapiens
tgcctcaccttgtccctctcctgtctggtaaatccaccaatgagacttgaaaataggcggaaagcaatcagcaaaaagaacagagatctcaacagaggcatccagtttgcatggcggacccctggcaggctctgatggggatcctctggatgagatgcgagggtgagctgaagagaggactctggataaagtccaagaaaaaaagcaggtccctccccagctccatgcagccaagtgatggcaaggagacacctggcagaagctgggactcactctctggagatgctgagccagatgcacccctgcatttggtaccccagacacagctggacggggtgggggttgcacta

SEQ ID NO: 530011 - DNA, 442 bp, Homo sapiens
gctggtgtactccccaggaaattcactgtccagcctcttatcatatttgtcgtgggggaaagacaatggtcccgtaaagtgattctgatcacactccttcaatgtcaaataaataatctcttgaaactggctggatttgcaaaccctaagggaattatgagaataaccctgtccacggttacaatccagcccccagccctgggcgaaaagcccctcactcctctttaccaccagagagatgagaccagaaggccctgattaaacactcaccccttcaggagaacccagagttatagaagggatgtcagtggcgctgagcagtagctttaagtcccagaaaagccttttcttactatgcaaacccactcgtgcctggatgcccactttacattcgtggtggccgcctccaccctggcagaacccattctgagcacagatccca

SEQ ID NO: 530012 - DNA, 365 bp, Homo sapiens
agatgatcgacgtcatcggggtgaacacagggcaaaggctacaaagggggtcaccaggtcgttggcacaccaagaaagctgcccccgcaggaccccaccgagggcctgtcgcaaggttggccctgttatttggggccatggccattcctttcttcgttttagggccttctcttttgggcacgcgcttgggcagaaagggctacccatcacccccactttggatccaacagggaggtttttttaagagttggccacggctatccttatcaaggacgggcaaactttatcaaaaacacagtctccactctactatttcctctcttacagagcatcaaaccccctggggggcttttttcactatggtg

SEQ ID NO: 530013 - DNA, 166 bp, Homo sapiens
ctgctgcgttgacgtgacgaccgactggaacctagacgtgacgactgcacgctgacacgtgacgtgccaatgcaccactctgctgacgtgacttcacgaccctgaacactactgaccgacgtgttggccacggaatgcttggtgactccttggaccggacgacgcc

SEQ ID NO: 530014 - DNA, 658 bp, Homo sapiens
  misc_feature (570)..(570): n is a, c, g, or t
gcaacaagagcgaaactccatctcaaaaaaagaaaagagaaatataaggtgttcaccatgattctgatttttaaaaattcttttgaaaatatgggtattaatctagaagaaagactgaagagcacatcaataaaatattaatagagatttcctttgattatgaatgatgagtgactgtgtcttctttataattggtattgtttgtaagtttttatattatataatcgaaatgtttaagtgcttttggttacaacattcattgttatttattctaggttttcaacaaatacttttgggctttactacagcgtctataaagcatagaaagggttggcatatttagactgcttaccctagggtgggagagaatacagttctttctcagagagatgttcgtaatacaatagctgtattcttcagaggctgagtgtagttgctgcggaagtgtttgactatgaggccccctggggacctgaacatccctgactacacagagggattagactgttcagtttttgccttggctgggtcctaacctatgtgaatgtagctgatggtgcatataactanactcattaagtgacgggtatcggtagttctgagcagttatgtgggaggccgcacgctagcaatgctgttggggagagtgaatgcgggg

SEQ ID NO: 530015 - DNA, 104 bp, Homo sapiens
cagctcggtaccctgatgtgcgatcttgaatatagttggcagagaccacatcgcaataagcatgagtttagtcctccatgtagaaaccagatacactaaactgt

SEQ ID NO: 530016 - DNA, 852 bp, Homo sapiens
  misc_feature (27)..(27): n is a, c, g, or t
  misc_feature (155)..(155): n is a, c, g, or t
  misc_feature (180)..(180): n is a, c, g, or t
  misc_feature (182)..(182): n is a, c, g, or t
  misc_feature (279)..(279): n is a, c, g, or t
  misc_feature (309)..(309): n is a, c, g, or t
  misc_feature (401)..(401): n is a, c, g, or t
  misc_feature (412)..(412): n is a, c, g, or t
  misc_feature (487)..(487): n is a, c, g, or t
  misc_feature (616)..(616): n is a, c, g, or t
  misc_feature (620)..(620): n is a, c, g, or t
  misc_feature (633)..(633): n is a, c, g, or t
  misc_feature (642)..(642): n is a, c, g, or t
  misc_feature (647)..(647): n is a, c, g, or t
  misc_feature (695)..(695): n is a, c, g, or t
  misc_feature (702)..(702): n is a, c, g, or t
  misc_feature (738)..(738): n is a, c, g, or t
  misc_feature (740)..(740): n is a, c, g, or t
  misc_feature (755)..(755): n is a, c, g, or t
  misc_feature (787)..(787): n is a, c, g, or t
  misc_feature (845)..(845): n is a, c, g, or t
tcgcgcctagctgcgctggtaaaactngctaacgcgatctatcttaattagccacccacagctgctaccgccgccccatccccagggaccacacagacccaggggacaaagaagggcgcgggagacagcggctgaggaagcctttactgcggggnggccggaggatcgccgagctcaggntnccccaccgcaccgcgcccggcctcgtcctctgccccaggcccggccccgcccccagcctcggccccagcctcggcctttgccggaacgtcgccgaanacttcccggtgcatggaggtgacgtagttngagccgctggggtcgtccaggcgcatccgcagcaggggcaggaagcgctcggtggtgaagtagcgcagggtcggcttcggggcgcgcaaagngtgaggaaganctccgccacctcctcagggttctgcgccgcctcgcgaaaaaattgcttgctgtgggcgaggtattggtagaagcngtggaaggtgtggatgtacgtacagtccagcacctcctctgggctgcccaacaccttctccatgaaggcggtgtgcactgggccgcactcgatcaggctcaagctgctggccggagagcaacgagtagnaggnggcggacgcagcnaggcccagncccanccccaccccagtccagccccaccacgtcccggccccgaccgcgagcanaccgctngctgggaagtgaggcggaaggcgctggggataacananatttgaacgcgggtnctgccgagcagcctccaaatcatctgagctanagggagcctggtgtcagattcgatctacgggtcctggcgctgtgtgacttgggcagtnactaact

SEQ ID NO: 530017 - DNA, 129 bp, Homo sapiens
cttagttagttggcatgatgagcgacggctgatgttcgatatactatatgggatagggtgtaggtgtgcttgagggtagaagtggctaggcatttttatcttagagcgaaagctatatcactgcgcccg

SEQ ID NO: 530018 - DNA, 174 bp, Homo sapiens
aatttttttccccccatgcagggggggctttttttgggccaaggggggggccggtcctttccccccccaaaatgtgttttttttgcccggaaagaccccccccccttctggggactgtttgggggggggggtggggccccccgtgttgttttaattaaaaacctcgggccggga

SEQ ID NO: 530019 - DNA, 138 bp, Homo sapiens
tctagaggatcctccagaggacaaggaggcagaggcacaatgaggatgaggagttggctacaccttcctgtgcaggttgaaggcatgtcgtggggcctcctactgggaggctagaagcatctccatcgattttagcag

SEQ ID NO: 530020 - DNA, 383 bp, Homo sapiens
cgcgtcgaccccgtcctgtggtctgcctcagtttctctctctctccttctgtctctgcctctgtctctgtctctctctgcctgtctctgcctctgtctctctctgcctgtctctgcctgtctctgtctctctctgcctctgtatctgcctctgcctctgtctctgcttctgtctctgcctctgtctctgcctctgtctgtctctctgtctctgcgtctgcctctgtctctctgtctctgcctctgcctctgtctctctctgcctctgtctctgcctctgcctctctctctgcctctgtctctgcctctgcctctgtctctctctgtctctgcctctgtctctgcgtcgacacgcccgcgaatttagtagtaatagaatagacc

SEQ ID NO: 530021 - DNA, 293 bp, Homo sapiens
gctcgaccgccatccgactaccgctaaacctgccatctgaacctcacgtgtcatgggaacctcgtacctatatgcgccggctcattcaaaaaacgtggtctgaccccaatatctcaccaatatctctcttcaagggaacgtggtaccgatgcgccccaggtcacccgagaaccagatgccggtcactttgccgaccacatcctcatcggccacctgagccatgaagcggctgtcattgctcacatcgcggttgtcgcccaataagtacacatggcctggctcgacgcgcagag

SEQ ID NO: 530022 - DNA, 862 bp, Homo sapiens
tcttgttgagacttttttaaaactgataataatgctgaattatcttaaggtgagatgttaagcccacttagtacttatcaagtgtaatggagcttatgggtagaagaacatgtctactaattacaaaaaaaaaaaaagaccttgcttggcaggctaattccttaccatttccagaaaaaatgggtgtttggaacaactcattggcctggcctcgggaatctgataaaccctgggcctctggatggtttcaagcctggtgtatttcccagtacctaaatttcccctggaaatttggatacacttcggagggaggcactgctttcctgccgttgacgacaaacaactacttctgttggccatattcacgtacccgggggcttatctcacatcaccggattcggatatccatgtcctttccatagtcgtatttggccccgtcaagcttacaacacacttaacacaagattcccaaaatgccgtcgtccaacccggggctcccatcacccaggtttggatttccgcaccgccttacactctgcgcaacttggacccttcggtgggcctccgactttttctaaccgggcacgttccctcttcccatgtcggtggcactttccttctcaactttcgttttttagaaatttaccccaacttgaaaagattgttggcaccatcgtccttctttgtctcacatatttggccacgcacacaccatctgttccgacggttgatactcaccaaacgtcatatcctgtacacaccacttccacctgctaccaccccctcgacactcattctactcccccataacccaccgacgcatcacaccagtccgcagccctccccccaccccacccgtcaa

SEQ ID NO: 530023 - DNA, 278 bp, Homo sapiens
tctatttataaagaggatcccctgctggcactttgatatctgtgcttttaaaattagatttttctgctttgcctctgtaccttccttttccttgcacacagatatacagaccatgacatatttaatgtgtatattaaagattgctttcattctctgaatgtttttcaatcactctctaatagttaatttgaacaaacatgtagaaaaattaagactgcattaacatatttgcttcttaattcacgtaacattaatatggctggccacagtgtctgact

SEQ ID NO: 530024 - DNA, 731 bp, Homo sapiens
atgggaccaggagcccgccacggggccaaggcaaggcgggggcttgcggggccaaggcgggcccgggccccgcctccggtggaacgccctgggacgagcctcaaccccgcccggtgcaccgccgagtcaagggaggcaggtctcccacccgagtaatggtgggacggaggaataccgggcctaaaaagcccccgcgggagccgcaagccgggaacgaacgctctatgagccacagacgaactcgaagggagactctttcccacaccgccttcccgggagacccccacctaacgagcgaacttcaggtgcttcgggaggcgccctcctgccgaaccccacggtgcccacccaccacccgtagacccgggaagaccctcgggagacaacccggctccaggtccggggagcctcccctaatgatgggcggctaactggagggaggctgtgaggaaagaaaggggtcggaggagaaggaggagaccccacacaaggaggaggaggaagaggcctactaacccgcccgcgccgcccccgtaactcggaggaccgaactcggcaggcgtcccgagatgcgccacggctcaacagaagaacttggccctgagtcgggaaaatttaatcgtctgatttgacgttttttacgtagcttttgtatttttttttttaatttgaagggacactgatgaagcctgccatacccctcccgagtctaattaaacgtataatcacca

SEQ ID NO: 530025 - DNA, 179 bp, Homo sapiens
ctcgagtgcgaggtggagtggactaccacgcgtacaacggtctcgacactggcgcgcgttgaactgcgccttgttcgatactcgaaccagggatcgggctcgccctcaagggacaactgcaaccgctagcagagcgccttgcggttgtcggcatcgtcgagcaccttcttcttgacatg

SEQ ID NO: 530026 - DNA, 194 bp, Homo sapiens
caccccccggtctttcctttttttgttcgggggggcccccccccccccccttttttggccgtttcctgggatttttttggtttcccccccgttccccttggggccccttttttcctttttcccccccctccccagttgggttccggggtttagttttttttttttgattaaaaacttatttcccaaaaaaaaaa

SEQ ID NO: 530027 - DNA, 734 bp, Homo sapiens
aaaatggcaataccacaccttcgcacttttttaacaggttatgccaccaaagtagcttctgccgcctgggtgaaataagaaagggtcccgtgccccgaaacgattggtgggaccggcatgcagggtttccccttcaagcagggtgtctttgcccatgtccgtgtccgccggctcatagtacaagagcattcctgttcagtcgcaagtagccctgcagaaagaaagagaaatccagtttgtggctgcattgtgtatgcgaacatgagcgttcgccacttggctcttgtaaaaaaaggaccggagtatactcctggcgtgtcttattttacagtgcctagccgcctgggcccccaaagagctaacagaatccgcaaacttgtcaatccctgtaaaacagataatgtccgccagtatgttgtaaaaaagcccttcaataaagaaggtaagaaacctaggtccaaagcccccaagattcagcgtcctgttactggctgtgtccaacagctcaagcggcggcggattgctgtgaaaaaacagcgtgccaagtaaaataaaggagaggctgccgaatatgtttagcttttggccaagacaattaaggaggctaagtagtagcgccaggtacaaatttctaaaagacgcaatctttcccctttgcgagcttcaacttctaagtctgaatccaggcagaaataagattttttgagtaacagatcaataagatcagactctgc

SEQ ID NO: 530028 - DNA, 180 bp, Homo sapiens
tatatagtgatatatatatagacctatcttttctgacgccatctttccatagggactgttagctggaggctggagtcttaccaaacatatggaaagagattagcttctgtccttcaggactacttctagatttcctagacgtgtcagagaaaatccccacacttctttctttaaaacatg

SEQ ID NO: 530029 - DNA, 496 bp, Homo sapiens
tcgtgtgtctctatattcactccatcacttcgtacaagtgtactatggagacatattcactaaaaaatctcgtacgaatccattgataataaagcactgtatcatacatttactgctttcggtaagcatcctttcagtgtaagtgtggttcgcgatgaaaatggttccagatggctactggattcgtacactttgagacgcacgaaacagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaatttaggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaa

SEQ ID NO: 530030 - DNA, 313 bp, Homo sapiens
agcatactatgggtatgacctggcgtttctcaaagatcacaaagatggaggggtcggacacactgggcacgcagctatcatagaaggcgttgctccagccctccttggccggcggacggacaaaggaggcattgcccctgacgaactcgcccaccagcacccgggccaggaacatcgtgtgggtctgcgtgtcggatttgctgtagtggtggaatatgcagcatctcgggcaaagtagctccccttgccgtaggaagtgccatgaacaccacagacccgccagtcaaagttctgctggcagatggcgtccaca

SEQ ID NO: 530031 - DNA, 164 bp, Homo sapiens
tcccgtacacatacttgacacaactggttttattcccaatgcctcttacaaagaatcgttccatgggtggcaggaggggtgttatcatggtgtgatgcaccgtgacttgttattcacgatgtagtccagtgttccatctatcacgttatatacctttcgaaaaa

SEQ ID NO: 530032 - DNA, 494 bp, Homo sapiens
gcatcacacagtgtgtggcttcccagtgtatacgtgttacgtgacactatactgtaggctattaagtgtgcaggagcattatgtctaaaaatgtacattccttaattaaaaataccttattgctgagaaatgatagcaatcacctgacccttcagcaagttataatccttttgctggtggaaggtctcaccttgatgctgacggctgctgacttaccagtgtggtggttgctgaagtttggggtggctttggcaatttcttcaaacaagaacgataaagttggccatatcagttgactcttccctttaggaaacatttctctgtagcatgcgatgctgcctgacaacattttacctacagtagaacttctttcaaaattggaggccatcctctcaaactctgccactgccttatcaaataagttcatgtctatgctgtattctttgttgtcatttcaaccatgttcacagcatcttcaccaggagtggtgttca

SEQ ID NO: 530033 - DNA, 194 bp, Homo sapiens
ccaaagaagtgaaaaatatgtacacacaaaaacgtacatatgaattttcctttgtttttggagataaggtctcactctgtcacccaggctgaagtgcggtgccataatcatggctcactgcagcctcgaactcctcaggctcaggcgatcctcccacttcagcctcccaagtagctgaggcaagagaatggtgt

SEQ ID NO: 530034 - DNA, 710 bp, Homo sapiens
  misc_feature (40)..(40): n is a, c, g, or t
  misc_feature (101)..(101): n is a, c, g, or t
  misc_feature (116)..(116): n is a, c, g, or t
  misc_feature (159)..(159): n is a, c, g, or t
  misc_feature (217)..(217): n is a, c, g, or t
  misc_feature (269)..(269): n is a, c, g, or t
  misc_feature (276)..(276): n is a, c, g, or t
  misc_feature (300)..(300): n is a, c, g, or t
  misc_feature (334)..(335): n is a, c, g, or t
  misc_feature (353)..(353): n is a, c, g, or t
  misc_feature (386)..(386): n is a, c, g, or t
  misc_feature (400)..(400): n is a, c, g, or t
  misc_feature (444)..(444): n is a, c, g, or t
  misc_feature (446)..(446): n is a, c, g, or t
  misc_feature (485)..(485): n is a, c, g, or t
  misc_feature (492)..(492): n is a, c, g, or t
  misc_feature (516)..(516): n is a, c, g, or t
agaaaacctctgcgaggaaagggaaggagcaagccgtgantttaagggacgctgtgaagcaatcatggatgcaatgaagagagggctctgctgtgtgctgntgctgtgtggagcantcttcgtttcgcccagccaggaaatccatgcccgattcagaanaggagccagatcttaccaaggttgcagcgagccaaggtgtttcaacgggggcacctgncagcaggccctgtacttctcagatttcgtgtgccagtgccccgaaggatttngctgggnaagtgctgtgaaatagataccagngccacgtgctacgaggaccagggcatcagctacnnggggcacgtggagcacancggagagtggcgccgagtgcaccaactggaacnagcagcgcgttggnccagaagccctacagcgggcggaggccagacgccatcaggctgngncctggggaaccacaaactactgcagaaacccagatcgangactcanagccctggtgctacgtctttaagngcggggaagtacagctcagagttctgcagcacccctgcctgctctgagggaaacagtgactgctactttggggaatgggtcagcctactgtggtaacgcacaggctcaccgaattgggtgccttctgactaccgttagaattcatgatcctgataggcaaggttacacaaccagaacccagtgccagcactggg

SEQ ID NO: 530035 - DNA, 215 bp, Homo sapiens
  misc_feature (25)..(25): n is a, c, g, or t
  misc_feature (32)..(32): n is a, c, g, or t
  misc_feature (108)..(108): n is a, c, g, or t
  misc_feature (119)..(120): n is a, c, g, or t
  misc_feature (148)..(148): n is a, c, g, or t
  misc_feature (208)..(208): n is a, c, g, or t
  misc_feature (214)..(214): n is a, c, g, or t
ctcaagttcacctaatcttgggcanccaattntcttagagaaaggccagcgctttcaccctgcgagatggcaaccggtctattggcaccggtctagtcaccaacacgntggcatgtctnngggggggaggaatatcaaatggggttgngtgtgcagatctctgctcagcttcccttgcgtttaaggcctcccctagccagggctcccncctgcnt

SEQ ID NO: 530036 - DNA, 318 bp, Homo sapiens
cttcagcccagtagcagtggagcaggccctgtcctgccctcccagcaataaccacctccctggaggccagctgagatgcctggctacttggcaccagggacttcctgacaccacagtcaattaattcctcaggggctgtggctggagaaaaggtgcccagcccccaccactcctaagctgccccccaacctctctatggcagagcggcagggcgtggaaatgtccatagcctgatggggattgcgtatgatctgtactgttataatcacaaccattttgctaataaaacacaacctctggatggtgaaaacacatcga

SEQ ID NO: 530037 - DNA, 183 bp, Homo sapiens
tcttcgtgtatttatcggtaactcgagggtctcaagggtgccacgaaagcatgtccaccttggcagaattcctgctcgtggaaactaagtcaatatatgactagaatagctccaattggggggagaacttgtaactaagctgatgggtaacgaactgaggaacattaaagttgcgggtttaca

SEQ ID NO: 530038 - DNA, 244 bp, Homo sapiens
ttctttctcattcttttctttttctttcctttcttctttccttccttccttcctttctttttatctttctctctctctctctttctttctttgtgggtttcactctgtcccccaggctggagtgcaatgatgcgatcactgctcactgctgcagccttgatctcctgggctcaagtgatcctctcaccttagcctccctaagtagctaggactacaggcatgcacccccaagcccagttaatta

SEQ ID NO: 530039 - DNA, 135 bp, Homo sapiens
tcctttatccaagcagtcgggacacggtgggttagagggatccctggccagggtgaggggatctgaggaactatgggccgaggtttgagtacagagttggcgttgacttcggttcgactgcttggattacaagga

SEQ ID NO: 530040 - DNA, 1164 bp, Homo sapiens
  misc_feature (274)..(274): n is a, c, g, or t
ctattctctacaaaccacaaagacattggaacactatacctattattcggcgcatgagactggagtccataggcacagactcataagacctccattattcgagccgagcatgggaccagacacaggacaaaactatctaggtaacgaccacatctacaacgttactcgtcacagcccatgcatttgtaataatctctcttcactcgctaactaccccactcactacactcgcgacgcgcttcgcgcacactgactacgttccaacataaataantcaggatgacccccgaaatatggcgatattcccccgcactacaccaacactcaagcctctcctgaactcatataacacatcacacatcatcatacacatacatccatgacatcgacactcctgcataatagataggaggcacgagagacaggcaacaggcttgaacagatctaccctcccctctagcagggcaactaactcccaccctggggagcctccgtagaacctaacccatcttcttccttacaccttagcaggtgtctccatctaaatatctagcgggcaccatcaaaatcacccatacaacaaaaaactatatacaaatataaaaaccaccaaagaacaataaccacaaatacacaaaagccaaatacttacgaaagaatcaagacctaactcccaccccgcccctacttctccctatctcatcacagaaacaaaaagaaggagataaaaaataaaaaaaaacagcgacgctctccacacctactcacagaagaaccacgaaggcgcgaaggaagcaccacaaaaaatccccacaccatcaaatagaacaaccagaccaaactcgcaaaacaatcaaaaaacaaaaaggactcacaaaaaaacaacacaacaagacatcataacaacggcaaaaaaagaaaaactgcctcaccacagaaaagaaagaaacctcccataacagaaaccatcaggcaccaagagacaccccatcaaccgcgacctgcgtcccgccctctctcctgcaggcccatgcaataacaggacaaaccaataaggccaccacagcacccccgccgcccgcgccgccagccctcgccgcacgcggccacaagcccaccaaacagaaacacacacccccgcacacccccccgccagccgcgccg

SEQ ID NO: 530041 - DNA, 103 bp, Homo sapiens
atctggacactatgtcatcaattatattaggaactcctagacagcaatgctaccgttgcatacttccaggcagagtgacagatgaactgtgactggtttatag

SEQ ID NO: 530042 - DNA, 1634 bp, Homo sapiens
  misc_feature (339)..(339): n is a, c, g, or t
cgcggtccctaagtataagggacatctgtcaaacaatgtctgcagcgccgtctctgtggtaagtagccagagactggcacatggcatggcatggcagtggtagccctgaaggcttaccatctgcctagcctagtgtagagcccgaccttgaccgttcgtgcactgagactgcgtaggatgtgtgccatcaatgcgtatactaggtgatcaattctcatcaagagagtgagacaatatcgactagggagaatcttgaatcatggaatagagactctcacaatgaggcagcagtggtagaaagagcgttcatgtcatgtgtggagtactcgtatgtgcacntatgatcgcccaaactttcaaggagcctgcatgactggagtagctccagttggttgatttactccatcctaggaaattcagctgggttaccaattcaggtgtactgggcgggcttgtgatagcttattagcctgaattcgagcccaccgtgagggaggaacctgggatcccatatcactgtggaatggggccccgacgtaacaccagctttctcttggggaatagctcgttcttcccttatcaccttgcgaagaaaatccccattgtgggccttggctctttgttccctgggccgtattggaacatccgtaaagttaatcccctagggaatggccgttgcacatgggggttacaccccatatgcgggggttttggaagccaatctcacatagccccttctcatcccagttgggcattggggcgcactcctctttaataaggcctggaagggttcctaaagcgtttaaccacatactttttgtcggctcggtcgttgggctgtgagaccttccttaggcaaagttgtggataccccctcaaagtgtgtggccacaatgtgcggtggtggaccgagtcttatgccctaaaccacctccaatttgtgctattcaaaagcgctctccgcgtgtgcagggcggtccacccatagcaggggctgtgggggtacccgcaagcgaggcgctgagcagcgagagagtgcaatttgtggcaaccggccctaagggggctatgtcttggcccatgcgttgcacgtgggagtcgacccagtggtttgccactacggtatcgatattaccggcccccatgtggggctatagccctgggtttggcgctgtggcttccctgtgggaaccgccacgtacgtgggggcgatctcccgggagggggggccccttgctccgccagagggccatggtgggcgcacaaggccgttggcgccggcgtgggacccacaacaggcggggtggtggatagccaagggggagcaggggaagacccctatacacgtggtccgtaggcagtgaaacgacgcgaacacggggggatctacccgacgaggatccccacggaggcccatcatgggagccccctgtgtggacggcggcagcaccaacaaacttccgtggtgttgcacccgcgggggaccacacaggagagagacgagcggccggatagcaccaccaacacacgagaggggcgcactacagctgaggacaacaggggcgctgcaaccaaatggtggccgcgcagggaaagagaccgcccgactaaacccagcctgccactacagagta

SEQ ID NO: 530043 - DNA, 802 bp, Homo sapiens
tgcgctgtggctgactgggaacgctagagtatcgtcctagaggaagtgggcagcacccctggagcgctggcccatatcatggcttacactacctagtggtcgtcgataccacacataactttgtacggtgattgtccaagagaatgtcttgtccgtcgttgagccaacctatacaagcccacgaaagaacgatctttgagggagcaagattgggttcgaatctgcagacgctcgatgcgagcgattaccacttgaacgcacacaatagttccttagcaaatttctccgcataaccaaggtgagcccactttgatgcccccgtttctctggcatttggacactggcgttggaacatagcagtggcattaggaggactacctagtgtcttcctcaatggcccgaagtcgacactcaatgcgttgcaatgaggacaacggctccgatacttctttaccccgtgtactgtgtcacacgagggcctaccgatggtcaaccctttgaccggaacttggacgtttgtaatccccttgcatgccgacggtggtcgcgatcctgtaagcatacacaggcatttccgtgtccgcgacctgtgatcacagacggctcccttttgcttccctttggggcatctttcctacgcgacttggttctttaccgggtacacttgcgtggccgggtattctacgtgtacccttgggttccgcatgggttgtggtcgccgcgactcatcgggttcgtcccttcgcgtccgtttcttatttccatatccctcccccgctcgttggcctttgcgttctacgcg

SEQ ID NO: 530044 - DNA, 396 bp, Homo sapiens
  misc_feature (268)..(268): n is a, c, g, or t
  misc_feature (273)..(273): n is a, c, g, or t
  misc_feature (303)..(303): n is a, c, g, or t
  misc_feature (305)..(305): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (349)..(349): n is a, c, g, or t
  misc_feature (354)..(354): n is a, c, g, or t
  misc_feature (375)..(375): n is a, c, g, or t
  misc_feature (381)..(381): n is a, c, g, or t
ccttctctccggaaagagttcaagagttaagaaccttgctgcaagtcatgcccttccaagtgcagcaaccccagcccatggagattgcctcttttaggcagttgctcaagccatgttttatccttttctgaagagtagtttagaccaagccaattgcagaaccacattttttggttcccaggagagccccattcccagcccgtggtttcccgtgccgcagttttatattttgcttcaaatcagccttcaggtttcccacagcatggcncctgntgacacgagaacccaaagttttcccaaatntnaatcatcaaaacagaatccncncnccaatcccaaattttgtttnggttntaactacctccagaatgtgtncaatanaatgcttttataata

SEQ ID NO: 530045 - DNA, 107 bp, Homo sapiens
ggtcctcccttggaataggtaataggagggcaagagaagggctaagggccctccctagaggccgttacacaaccatacaaatatatccaagagtacatatcaaaggg

SEQ ID NO: 530046 - DNA, 313 bp, Homo sapiens
cgtctctagcaggatcccctcacacgctcttcttacatgaatctgtgtcttgggttaactccactttgttgaacttccactgaaggcttatattgtcttactgctgctccaggtatttttgtttggaacatctatcacagtagggcacagctgtttattgtattagcagaatcgaccgatatgcttgtggccaccagaaagttttacggtctttcaagttgtatcaaatgcacctgcagaaacgtttaatgtcttctcaggatgccaagttggagcttaaatgtgacatcaaaccagttgcaaatagtgttca

SEQ ID NO: 530047 - DNA, 1266 bp, Homo sapiens
tgaaaacacgggtaatccaggtttattatagaaaaaatgccaccattactctttatggaatgcaagcgccagcacgggcccctttctctccaaagcacagggggcaccgcagggcaagggggcaccaaagggcaaggggcctccgctcccctgtggccagagagtgcacgggagaaccgcctgggcgctccactataccatattcaccatacaggccaggaaacccctccctcggagcgccctgtgggggctccagagagtcgtctgtgtgtctcaacaactctctctgtgtctctccacagaggaaagaggctcttcacactctgtgagagaggcgtttgtgcgcggctcttgtggtgacaacacaccctctctggacacttctcatgaaggacaaactctctcaccaagaggcggaaaaaagtgtgtgtgccacacaaaaccacgcgtgtctcaaaaatagagcggcaaacaaaagtgtcgttccaagggtcctcacacaaaaagtgtctccacaccacctgtggtcgttgtggtgggcgcctccccacaacaaacgacccctcttaatgatcgcagggcgcaacacaaaagaaggccccccccctggtggtgctcttcctggttgtggggcgcccaccagaaaaaacgcccgccctcgctgggggggggagaaacccacccaacaggggtcatttcatgtaggagtggtgttagtgtgtcgatccaccaaccaaccatgtagtaattgtttatttcttcgtcctccccccaacaacaaccaagttagtttttccaataaagaggggccgcctcttactttcttcctgacagtaaaagccgcacacaatatatttcttcactacagcccgcactattggatagacaaagtgtgccgcttactttctatacgccaggtagggcgctccccttacacagcagagggggaggggcggagatatttacacccccccctcattagttcaccacaacacaagaattggttgtgcgtgtcccaaccacgacaaggagagagggggggcgagatatgaattcacattccgcacaccgcaagccgatgtaattaacatacgacgcgggcgtagcattttatactcgcagcacaacaacaaacaacaatatctcttcctgcgcttctagtatcttttccccggcccaggacaagcgagtactttccccagcgacggggggggggggggcgccccatcatagtaattgataggggcgggggatcaattataatac

SEQ ID NO: 530048 - DNA, 508 bp, Homo sapiens
  misc_feature (337)..(337): n is a, c, g, or t
  misc_feature (375)..(375): n is a, c, g, or t
  misc_feature (407)..(407): n is a, c, g, or t
tgtagaggaccctgttgctaggctggagtgtaatggcgctgaatagctcgctgcaacgttgacctcccaggctcaagcaatcctccaaccttagacttttgagtagctgggactatagcgctatgccaccatgccctgctgattatttgcatcttttatagagatggagcctccccatgtttcctgggctggtctggaactcctgagctcaagcggtccacccatcttggcctcccaaaatgctggcattacagcggtgagccacccaggtggcaaaccttttaaaatatttatttgttttgtttgaaacaatgtctcgttgtgtctcccaggctgnagtgcagtggcacaatctcggctcactgcaaccaccgnctcccaggtgcaagctattctcctgcctcagnctcccgagtagctgggaccactggtgcctgccccaatgcctgggtaatttttgtatttttagtagagacggggtttctccatgttgtgcaggctgatctca

SEQ ID NO: 530049 - DNA, 102 bp, Homo sapiens
agtctacttagagtaaaccattacctgtgagaggaagcacacggaatgaaagcagtaacacggaagggtacacaacccctcaacctatcttatagtagtacc

SEQ ID NO: 530050 - DNA, 1006 bp, Homo sapiens
tggagacggagtctcgctcggtcgcccaggcttggagttgcaggggcgcgatctcggcttcactgcaagctccgcctctcgggtttcacgccattctccgtgcctcagcctcccaagtagctcggactacaggcgtcctccaccatgccgtggctaatatttggtatttttaaggtaagacgacgggggtttcaccggggttacgccgggatggtctcgatctccttaacctgggtgatccggcccgcctcggcctcccaaagtattggggattacccgggttgagccaccgggcccgggttgcaaattaatctttcttttttctcttttttctctgagacagagtctcgctctggtggcccaggcttggagttgcaggggcacggatctcggctcacgggcacgctccggcctcccggggttcacggccattctccggcctcagtttcccggagtagctggggactacgggggcccgccaccaggcccgggttaacttttggggtttacagtagagacggggtttcaccgggttagccaggatggtctcgatctcctgaccttgtgatctgcccgcctcgagctcccaaagtgctgggattacaggcgtgagccaccgggcccgggggggaaacccgattttggtgctaacatcttaacttggtgataaatctcaaaaacccctgacatagtctccgagatctgtaggggccaggttaccttggggaaaccggtatctaggggccaatccatctcttggcgcgggtcaattgtgcccccccacggacaggctgtgagccatggctcaatgttttagcccctatatgtgtgtccccagaaccacgccttatgggtggttcacacagggggattctcttctccccaggagaaaaggctgctcgcacacctgtggtgccacctttgtccattcggtggcgacataccccctgggtagaaaaagagatgttttacccagaacgagagccctgttgtcacagacaatagt

SEQ ID NO: 530051 - DNA, 141 bp, Homo sapiens
agaacatcctctttaacccagttcccaccctcacagtcagaggaaaggagcagtggcttccggttgaagccaccaacgctgatccacggccaagcccccagcgcaggtctgccaagccagaagcccaaggagcagcagcgc

SEQ ID NO: 530052 - DNA, 352 bp, Homo sapiens
gtggtgaacagctcccaaaaggattactttgaaaaaatagttttgtggcttttaaataaggggcatgttatcagctccccttagttatggcccaggcctcccacggaaggactttggggggagggaaagtcccgtgcagaatgcaggggagtcaacagggtcggaactttccaaaaaaggaggactgctgtggctgaccagcctgttttcctatgagcccaaaagacccaggcatagctgcaaaggaaaaaccacccaaaaatgtgtggggaggggcaaaaaaaaggggctgccccttggattttggaaagtcaaagccttttaacaaggaatgaacaggaataaaagccca

SEQ ID NO: 530053 - DNA, 255 bp, Homo sapiens
  misc_feature (17)..(17): n is a, c, g, or t
  misc_feature (79)..(79): n is a, c, g, or t
  misc_feature (88)..(88): n is a, c, g, or t
  misc_feature (145)..(146): n is a, c, g, or t
  misc_feature (188)..(188): n is a, c, g, or t
cgattctcctgcctcancctcctgagtagctgggagtataggcacgtaccaccacacccagctaattttttgtattttnactagagangggtttcacagtgttagccaggatggtttcgatctcctgacctcatgatccgcccgnntcggcctcccaaagtgctgagattacaggcgtgagcactgtncccggcctcaaaatcttaagaaaaggttcttttgggtgcatggagttttacatgggaataaattagt

SEQ ID NO: 530054 - DNA, 100 bp, Homo sapiens
tagagcaccccacagacaaatttatgcgaccaggcagaggctgtagatactcatatttccaattgggagggaggactcgcttgatcttataatatcgagc

SEQ ID NO: 530055 - DNA, 890 bp, Homo sapiens
aaagatttgctagagctcagaagtactgctggaatatgctgtgcaatggggcttggcgagtgatgatgatgtatgcccatgctgcccaggaatctacagaaaggctcttcaaggtacggacgacaggctgcgaattgctgccgttgtaatgacagtagtccatgtattgttcttggccatgatggccactagagcagttcctagtttagcgtcttatcttcagcctagtgcgaggagtcacaggtttttagaggcagaagacgttggttattgtatggcaatatgatccatgaaatctgttgtgtgatcatgattaattgaagtcattcatcagcacgtctcaaccagtgacattgtccggcttatctagattcaatcgtctctgagtatatagggctgatgttagcaagaccctaaaaatgtccattgaaccctgcttcaaaaaatgaaaacaccacctctataaaatgtgtactgggaataagcttggtatcttacatacattaggggaatgttaacaatctgtaatgtcggacaaacagatgatattacttgtataaaattataaatgtcaacttgtaaataaagataggcagaatattctaaatagaaacttacgttttgtgtttcctcagaatagacccatgtaacattctaactgggggtgaatcgaaagactttagtcaattaacttatctcatattaaatatcccttaagttactcctggcgcccttcttaggacggggaacccttccgatcgaaaggggtccggctctttgtaagcgccagtggtgggcagcgggggtgtccaaaactcgcgcgcggggggaaacctcgggagcaaaacgggaatacaagaggcgaacgagcggactcatcggtgctggcg

SEQ ID NO: 530056 - DNA, 509 bp, Homo sapiens
  misc_feature (350)..(350): n is a, c, g, or t
  misc_feature (359)..(359): n is a, c, g, or t
  misc_feature (361)..(361): n is a, c, g, or t
  misc_feature (443)..(443): n is a, c, g, or t
  misc_feature (498)..(498): n is a, c, g, or t
  misc_feature (500)..(500): n is a, c, g, or t
  misc_feature (502)..(502): n is a, c, g, or t
  misc_feature (508)..(509): n is a, c, g, or t
cgggagtgcttgagggcctgggctttgggcaggtccagggttttttcatctcttggttcttttgttattcctccctgatgtattcaggtcgtttgggattccttttttcacccctgttgtcccttcttgaggttttggttgtcaaccctagagttcagttggttttccgaaacggtctgtaggtccccttttcgtgctttttcttttattgatccgcgactgtaatcttccgcgctttcccacggggtttttgtgccctaatgtcgtcccagattcttgtgcattgtgcagatgtgactcatgtttgtgttctgggtaaggggagctttacgacgcccttgtcgtagaanggtgaattncnaggggggctgccggggggggtgctttttttaattctcctccaattccccccccctcttgttgttttgtgtgccaaaaagatncggagcataatcttggtgccgttcttcctccaacccctgggtttcccgctttttntntncggatnn

SEQ ID NO: 530057 - DNA, 194 bp, Homo sapiens
tgttgactagtgtcatagatatgtgatgtttgctgggatggcgctaatgaacccaaccaatatacggaggttgagaccacatcgaaccccacagtgccactgggagagccagccgagtagccagaagaagcccaacaaaatgaaactccggtggaataaatcaaatctggaacatgtagtcatcatctatccac

SEQ ID NO: 530058 - DNA, 339 bp, Homo sapiens
tttttttttttaaaaaaaagtccgggggggggttccccaagggcaaaggcaatttcatttggttgggaggcttttaaaaacacctttaggttaaaaaaattggggttccccccccccctaagggggtgggggggggcggttccccccaaagggaccaaggtttttttttaaaaaaaagtgggcagttcaaaagcaccccttaaaaaaaaaaaaaggggaaaagtttaaaaatttgtttttaaaaattaaaacgggggggtattttttggaaaaccccaaggtttgggcccttttttccccaaaaaaaacaggccctttttaaccccgggttttggggga

SEQ ID NO: 530059 - DNA, 314 bp, Homo sapiens
  misc_feature (212)..(212): n is a, c, g, or t
ttcatcatggctggagacttccgtgaatataccctttcccaggagggatggacctgctcataagagagaatatagctacaaggttgtcagagctagagtcattaaatggaaactggaaagggggcatcgacagaagagcaagcctaaaggaatgctgctgagaagatttctgtgccaatattgtcagtaatataatctccagtagaacccangttcttacctttagagtcttagagtgtgctctgagattcgggacgtcatatgaagactctgatcatacgatactcagcgtcggatgcagacgttattactag

SEQ ID NO: 530060 - DNA, 150 bp, Homo sapiens
agaacagacgacgaacacgctctacaaagcctcattctaagctgctgtagtctctgtcaatgaaattaggactctatagcgcggtccacagaaatcatgacgcctcaggttgtcatcccacgtcatcagtctatgcagcaactcgcttcc

SEQ ID NO: 530061 - DNA, 833 bp, Homo sapiens
cgctgtagctcacgcctgtaatcccagcaccttggaggcccaggcgagcagatcacaaggtcaggagatcgagaccatcctgccaacacggtgaaaccccatctctaccaaaaatacaaaaattagctggatatggtggcacatgcctgtaatttcagctactcgggaggctgagacgggagaatggcctgtaccctgaggcagaggtggcggtgagccaagatcgcgccaatgactccagcctgggcgatagagcaagaattcatctcaataaataataactttcattcattcatttcttgtgctatgtagactgaccagaatggattctgtgggctgtgcaggtaaagacccataaatgatgtactgtggcattcaagggctccactgtggtgtgggtcttgggttaatatctctggtcccatctgccaccattccccagcctagtacctttaccctccagtgaaaagatctctctccctcttccatactctctcagtggcctctgaccctgtgtacaggctgacagatccatatttatttcacctcttgtcatccacctcctcggggaagcttctgtgattttcccaggcagtgtgggttaccttgcctctcaatctgtatgtccacagttctgtgggcagggcatatggtcgtacgatcatgtctctgccagtatggtggtcatgctggatctcagcttgggaggccagtaggggtcactgaagcagagtcagcccatgcaatggaacctctataaataaataggggggggggcggaccacaacggggcgggaaactaatgacagggggggaagagctcacggagagcc

SEQ ID NO: 530062 - DNA, 821 bp, Homo sapiens
gtatatggcgttgtagggttgttataattttttatttttatgggctttggtgagggaggtaggtggtattgtgttaatattagttgggtgatgaggaatatgtaaggagtatgggcggtaacttactgggtggggcccatacggtaggtattctagttgggggccatttaggttttaggcaattgcgaggtaggctacgagctaacgcccacacacacaaagacccaaaagcacaagacaaccaagccacgaccacacaacccacaccacacacaaacaaaaaacaaaacacaaaccacacacagcccccacaacacaccaccaccccaaccacaaaccaacccccaaccaacacaccacccaacacaccaacgacacaccacacgaccccaagctgaggagacaaacaccacaaccgacaacagaccacagcaaacaacaaacacgacgccacaaccgtccaaacacagccaaaggcacacaacagacacacacacccacggctcacacacccggacaccgacgcccacggacccaacacaacccacggcagcacgacacacgcagcacccacgaaagcacacagccgccacaacacaacggagcgcccccgcgcgccccaccgagcaccacgagcagagacagacgagccgcgacacgacagagcccgccggccgacaacacaaaggcaaccgagcacaccacccgacacaaaagcgacacgaagcccgccaggcgcagacgcggacagacccagagcgcgcggccgccgcggcagcagcgaggagcgagagacgccacgcccacgccagcggaagcgc

SEQ ID NO: 530063 - DNA, 936 bp, Homo sapiens
ggtcgtggccctggatgctttggcagctcgcgactgattgctggaatcactcgaatgattcttctgaggctcttcagagttctcctctgcccccattcggtcatccgtctcagtccactttgcggcatggaacatccgctgttagcagtcgaggtggccagttcaaagtaaagggacactcgactcctatccagaaccccccttgtgtgagaccaccgagttacgaagaactacaaatctaatgcgaacagagcagtctgccatgggaccttgctctgagtgcgtacggtctcagaggtagtcatgccaatgaagctggaagaagtggaggcgtgttatctaaggctacaaagcaagtgtttggtaaatgccaagatcaactgaactacgagtttccccagcacgttgcttgagactctcttgacaggagtccctacacaatttcggccatgtcagtcggacaaagaaaccccccgagggccctgaagcgaacactaagagtttgccagagttcagactcttggtttaatttctcgttcagcggactttaagtatgttacagagcataaggttatgaagtttttcagaaataaaacattgcactttcattacactgtcaaaatgttctctttagctttccttgaagttcccaacttttgccatctaatttccgcgtgacttggtctggcaaaaaaaaatcaataatatacatacaaaccaataatctgaaacaccttcttctttgggcccgcctctggggccctcttaaaaaaacgcctttttttacgaccaatttccgcgtttgttggccccccggggcccccagtagtgtgcatcgggtgaacccattggggggctcacacgtgggtaacccacaaggggaaacccctgtgggacgtcgtccaagagtcggttgggaatctcttacacaatcga

SEQ ID NO: 530064 - DNA, 503 bp, Homo sapiens
atcaatttgttcaaccaatcgctactgatgtcctcccactctgtgccaggacttacaataggcatcaagtatagaatgtgaatgaaatagacacagaccacccaaagcagtctactgggaaaaattagcaacacacaggtccatgagcgaatacatatgtaattataaatctcgagaggggctataggaaccaataaggggatactgccttcacttagaggaagtcagcagggatggcttgcttgaggatgcatcagttaagctgatacttggaggctgagaaagagccagccataggaaggctccatgcaacactgcagctgaggagtagcacgtgcagaaaggcaactgaggcagcaacgctggagaggctaacggggagctggagttgataggggaggggttggcagggactagattgtgcaggacctggtggttcaggtaaggagttcactttcattctcggtgcaatggaaactctagatattttaagctggaaagtg

SEQ ID NO: 530065 - DNA, 226 bp, Homo sapiens
ctagttcaaggcagatgggtcactagtcattgcacttttgatggtaggaggggccaaatataacaacttgtacttcatcttggaagggatgtcttaacatgccccacacctctggacccataggcatttcactgaggtggaagacctgcattttatcagatttgtttcctgcactcttaacacacaaatgtcttaccagtaagtctggagtagttgctgcttctca

SEQ ID NO: 530066 - DNA, 423 bp, Homo sapiens
  misc_feature (13)..(13): n is a, c, g, or t
  misc_feature (63)..(63): n is a, c, g, or t
  misc_feature (95)..(95): n is a, c, g, or t
  misc_feature (209)..(209): n is a, c, g, or t
  misc_feature (322)..(322): n is a, c, g, or t
  misc_feature (380)..(380): n is a, c, g, or t
ccaggctggagtncagtggcacggtctcggctcactgcgacctctgcctcctgggtacaagtnattctcccgcctcagcctctcgagtacctggnattataggcaagcatcaccacgcccggttactgtttgtatttttagtagagatggggtttcaccatgttggccaggctggtctcaaactcctgacctcaggtgatccccccgtntcggcctcccaaagtgctgggattacaggcatgagccagcatgcctggcctgtgaacgcagaattcttataaggtgtttagaacagtgcctagcacctaataaacctccagtnttagctaatttgtttattctagggagaattttaagatgtcggttctttgacaaatganccatcacatactctgaggtcattttctaagtcaccattcaaag

SEQ ID NO: 530067 - DNA, 132 bp, Homo sapiens
gactggtgaaaaccctgaggacagaggtggaaagatcgcgtgagctgggacgttgaggctgcagtaagccataattgtgccactgcagcgcagcgctccagcctgggcaacagagtgagactcgtgctccaa

SEQ ID NO: 530068 - DNA, 244 bp, Homo sapiens
  misc_feature (158)..(158): n is a, c, g, or t
cacgagcgcctcaagtagctgttattacaggtgcgtgccaacacgttcgggtaattcttgtatacatagtagagatggagtttcactacattggccaggctgccctcgaacgcctgacctgcaggtgatctgcccgcctaggcttcccaaaacgctgngattacaggcgtgagtaactgcgcctggccttgagtgatgatcttaactggcatgctgtgaaagagaatataggagtgcaggctta

SEQ ID NO: 530069 - DNA, 185 bp, Homo sapiens
tatttacgtctcttctctgtctccgtacgggtaatcgaatcataagataaacagatcaaacgtgcttagagctacctcgtgacactatgcagtatggttggaagacctgtggttcaacctcgttgtctctttatgttaacgggatttctgcattaaatgactgcccccttgttagcgcgtgcggt

SEQ ID NO: 530070 - DNA, 555 bp, Homo sapiens
agccagttgtacgtcggattaccgggactcgttggttcccttaacctccttcctgggaggggtgggattgggagtggtcttggtttcattacttggaccctttccctaaaagacaagggaatgccttctccacaggccttagctcaaacagggaccgatcttgttcttctccagtgttggacacctaatttgcacatcaggactgtcatggaccatggtgcaatgaagtgtgaagactggagcactcatcacccacggtgggttcccaatggactctccagtctactgagggaataccaccagtctaccactgggtctcactttgttagcccaggctggagtataagtgccctgatcacatgcttgtctgcaaacctcaaagctcccatgctcaagcaagcttcctgccttcaacttcccaagtagctgagaccacaggcatgctccatgacacctgaatctcctgaatctcaagcgatcctcctgcctcagccttccaaagtgctgggattacatggcatgagcccctgaaccctgcctaccctctgtttctat

SEQ ID NO: 530071 - DNA, 898 bp, Homo sapiens
ctcgggatatacagctgttctccggcccccctcctcttggtccccccccccaaatgtttttttttgccgggatatttattacatatattggcgggataccaacccccccctttgtggtaacgcacaaagcaacacaaatacattgggtcgccccagtgaaacacacacaagaggtagagagttggcgacacagcggccttatacatacggttttttttatgttgccttggatttctagggagtcttttattctttctttttttttgggcgtttgaatatccccagcgcgatttttttaagcaaacatgtggagacgcgttgtcaagagatgcacacaaccaacgcatcgcggttgtgggagacggaagcccatacccccccccccaaggttctcacccaaatagatggtcccccgagggcacatctttgtggagtctgccccacccacatgttgtgcgttgttttttaacatagagtagctcatatccccacaaatatatgaggagagatgcctcatttgcgtttcaccagcgagaagatccccctgtcccatttctcttaaaacgcacccccacactctctctctataagaggaatggccccatcctccttcccacagctgccacacaccacaggggagggtgataacaccttcgctgttcgtacggaaaataatgtaagaagcaagaaattttttaatcgtccccctatataatctttcttattcttgcttttattttgatatcatgagagcctttgtgcccccccctccccctctttttgtccccccacttgaaaatattttaagggttttggtttccctgggaatggggggaggcaaccacagggttaccctgacaccgattgagaccccttgaataaaagggcccccccttta

SEQ ID NO: 530072 - DNA, 1191 bp, Homo sapiens
  misc_feature (65)..(65): n is a, c, g, or t
  misc_feature (127)..(127): n is a, c, g, or t
  misc_feature (142)..(142): n is a, c, g, or t
aaagaggaagaattggaagccctgatggcagggtcaagaagactccaatggctgcatcaactacnaagcttttgtcaagcacatcatgtctatctgaatggagctctcaagaacaagcattgtttangaagactggctgganacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaatgttcaagtcacattgcatttttattttcttaatgaaaataatttttaaaacttcaattatttgttaaatgtagagaatattgacaaattataaacttttaaaagaagaaatcactgaagtctacatagcaataacaaattgaataataaagataatcatatgttactgaaaaagtaaaatagaaatctgaggaaattcaaactggataagagacattttataaaaactatgcaggtaatttaaagcgaaaacaggtttcttcggattgtgtaaatcatttgttcatggcttgatctatttcacttctagtgacaatctggcctattagaaaagtctagcaagccctgatccttctcacttaatgtcttcaaggataagatttaaagtgacctttcagctataacttttttaaaaaaccctctgggatgggatgtgcttaagaactcaagatcctgtttattaatattctctctccaactatgattcctcccctttgcatgtccatgtcccaaatattagtcaatctttaattacatgtcaacagtggtagaccaattaccgaaccttctagtgtaacttatttcgaatgctcaccgtaacttttttgacctctggggtgaacactgcggttcacaatgcgtgaaatttcctccctaaaaatttaattgtttacaatgaacgcgcctaatagggcgaacctctagggcaagggctgagggcacaaggatacccgtggagggaccaaaatcacaagcacagcg

SEQ ID NO: 530073 - DNA, 100 bp, Homo sapiens
tgtatttgcggcgactcttccacgccatgccaggtaagccgtggcggacggagcagacggatctcctgttcccattcgtcaccgccattgtcacagtccc

SEQ ID NO: 530074 - DNA, 960 bp, Homo sapiens
  misc_feature (65)..(65): n is a, c, g, or t
  misc_feature (127)..(127): n is a, c, g, or t
  misc_feature (142)..(142): n is a, c, g, or t
aaagaggaagaattggaagccctgatggcagggtcaagaagactccaatggctgcatcaactacnaagcttttgtcaagcacatcatgtctatctgaatggagctctcaagaacaagcattgtttangaagactggctgganacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaaaaaaaaaaaaaaaaaaaacaaaaaaacaaacaacacacacaccacaaacaaaaaaaaacaaaaaaaaaaaaaacgtgagtgcgtggggcgcgcccgcggcgccccaggcaaaagacatattaatacagcaacagcgtggaggcgcggcggggcgcccccagcaaatcaagaacgcagacaggccgggcaacagagtggcaactcgagagagaccaactcgggcggcacaaaagcaaactgggagggtggtgttctattcgcaacaaaaaaaaaaaacccggcggagggcagacaagacaagacgcaacgacagaccacccaaaggagagccagaagagcagagaaacaggggggacaatcaaagagagagagagcacagaagaaaaaaagaaaataaaaagaacaccaccgatggcgtgtgagaaaacgacaaagagaagagagctgagacaagatacagaacaaacaaacaaagacaaagagaagacaagagagcgccgaaaagacagaagaaaagcagaggacgaagacgaaaaaagacaacaataaaaagacagaagcgacacaaaaacagacagacgacgagagaaccaaaaacagcgaagataaacatagac

SEQ ID NO: 530075 - DNA, 808 bp, Homo sapiens
ggaaggctgtggtgatgagacggaccgagaccggagatgttttcaaggcctcggcttccaggcggattttactaggcgggcatgctagcgggcagacgaagacaaacagacagctgacggttacggcctgaagctactcgtgtccagggaggtgaatgccgtccatgcgccgtgacttgcctcggatccaggatgagaagactgattctaatgaagaagctagctgattcatgctgtaaatatgcgcataatctgggttcacaaaagacaattcagagtgataacattctggacagtgacgagctagactatggtatgagaatagccagtatggagagatagagacgtaaccgacgagatttgccttccgtagcagcatagaagtccaagtgatacttgaacgcgtaaggtgattgtggagcaaggtcgatgaacagagaattcgatccagtgaaaggtaaattgtcctttgatctattagtccaatcaatgaaatgtaagataccgagattcagacacagagaaagaaggtgcagacaagaggattgacaaaaataggtacacgctggtaatgagaaatccagaacagttagcaattctgtttgggtatatccaatcgtctggagcgatatagggagtggcacgttcattgatgcggatgagcagcaaggatgacaataggtaccagattgcaagagcaagattatcgcatcagaaacaatcgtcgtggctggaaagaaatgttcggcgagttctgcatctcgagagaaagatagagttgataaaagaactgaaggttgtgggaaag

SEQ ID NO: 530076 - DNA, 174 bp, Homo sapiens
tgcatgtatatcgcggtcgattaattatatagataattgcgtcgcacggtcggccgcgtcgctacgcgatttggttctcgggacaattagggaactttcgggatgtagtcacgatcagtctctggttcatctcgcggtttaactactgcattcagtcactctgctctgcattca

SEQ ID NO: 530077 - DNA, 475 bp, Homo sapiens
gcaaagtgttcctttagccaaaggtgtgcccctttttcttctggataagggcaggaaccggttcacattccccctattgtaagagtacccgcgggtagctttcattattttggccccaccccattttattgggatttaaatgttttaggccacctaagaaccaatgtaaaagtaaaaaggccggaaaaatgaattgcttgggattcatttcttcatgtatatcaagcccaccagtaaaacaaaaacccatggatttaacttttttttaggattttggcctttgggaattttttttttttttttttgaaacttgcccaacaagcatgggctgtaaaaaaagttaacagggaaataacttgagatgatggctagctttgtttaatgttttatgaaattttcatgaccaatcccagcataattgttaagaacccgggtattaaattcatgtaaggggaataaaagttttatgaatgga

SEQ ID NO: 530078 - DNA, 105 bp, Homo sapiens
caatagctggcatgtagtggtgaaagcgatagttagggattctcatcttagccaaagtatttgataccacactattattattagagctcgtttcgcagtgtctcc

SEQ ID NO: 530079 - DNA, 1079 bp, Homo sapiens
ggaccagtatggtagaactgacatttagccactaatcagctcacaaagatccctgaggactgtgtctggctctcgtttctcttgaggttcttatcttatcaaacaatcttctaaagaagcttccccatggtcttggaaaccttaggaagttaacgcgagttggactctagaagagaacaacacttggaatccttgcccacatgaacacttgcatatcttaaggactttacagaaacttagtcttgacaaacaaccagttgaccactctctcccagaggcatcggctcaccttactaactctcacacatctgggcctcggcgagaacctacttactcaccttcctgaagaacatcggtacactggagaacctagcaagcaactgtattcgaactgacaaccccaacctgcatagccttcccttcgcagctggcactctgcagcaagctttcaatcatgagtactgagaacctgtccactcagtcaccttccacctcagatcgtcgctgccggggccttctttcatcattcagtttcttacagatgcagggctccatatcgcgccactggtctgattataaactctgctgggtccaacacactggttcaaaaatagcactggcattaactgctgtcttaatctactatctgcaatctaattcactgtacactcatcggcgcatatgcgcccgacttcactcccccactcggcaccacgcgcgtcccggcctaactcgaagcgcacatcctagccccactagcgaacactatcgcaagactctggccaccacgcgcccacataccgaccgcacccagcccgaaatctcgcacgcatgctcccccacgcgccgtgcgagcacccgacattgccaacactggcgtacacaaccctgagacaccaccgtcagtgactacccgtacacatcaacggcgccacaggcaccacatcagaaccacactcctcacggaccccatcgacggcgaccaagtcgcgcagcaacagcctaagacaatcgcccgacaactgcaaccctatactacaacgcggcacccagacaccacccgctcgccagcgcacacg

SEQ ID NO: 530080 - DNA, 366 bp, Homo sapiens
ggaaaatttttttttggggggccccccccccgccccccccccccgccctgggggggtgttttttaaaggccccccccccccacaaaaggggggggggggggggggggggacccccgggggtttggccccccccccgccccgggccctttggggggggttgccgggcccccttcgggcccgggggccccccccccccccccccggggggcccgggcgggggggtcccccccccccccccccccccccccaaggggggcgggggggttttttttttttttggggtcccccggtttgggggggcccccccggtttgggtggtttttggggggggtttttttaaccccagaacccttttttaaaggggga

SEQ ID NO: 530081 - DNA, 902 bp, Homo sapiens
  misc_feature (377)..(377): n is a, c, g, or t
cccgtaactcccctaacgtccgtcaagatcctgtttgggggactgggcgggtaagctcaggccccaggtatgggaaaagaggaggaagggaagggcaaaaggaagcggggccggtacatctctgggtctgtggctagtgaactgtgccggactacggggtcagcgcgatctccagcggtatttgcgagtttccccgatgggctgcgtagaggccccagttgtctaggacccttatggagctgcttgctgggtcgtagcacgaaccccgtcgggccatgctgagctttcccatgtgcagttgctaagctcgggcgggtggcaaggggttccagggccatataagattggctgcctgccagcgaactaacctgtggagntgccatagaaatcttgtggatgaccgccattacactccgcgcatcgccgtgttggtaacggatctgaacgtgcaagcactccagagtcagctgcgttgactagtacatgcaacgctagcgtatgcgatgcactattctagtatagcaatggccgccttacttagaacgagactaagagcgttatcaagaccacgtggcacttgggtgtaccatatacgactctctatacgacatgctcaccagacactcctggatctcgttgaatctgcagtggcagggcaccatgatgcgtttgtaagactcttgctggccaggatcgcagtgggcactggtagatctggaatgccatggccttcagtcgcacctctgtcgttccccgcaggatgggagctacagtaatgtccagcccctggacctggtgaagaaccggatgcagttgagcggggaaggggccaaagactcgagagtacaaaaccagcttccatgccctcaacagtatcctgaaaggcagaaggcctgaggggc

SEQ ID NO: 530082 - DNA, 334 bp, Homo sapiens
aaataaaaaaaaaattagccaggcatggtgatgcatgcctatagtcacagctactccagaagctaaggtgagaggatcacttgagctcagaagtcgaggctgcagtgagctgtgattatgccactgtacaccagcctgggcaacagaagactctgtctcaaaaaataaattaaattaaattaaaaattagctgggcatggtgacatgtgcctatagtcctagctatgcaggaggttgagatgggagggctgcttgagcccaaaaggccatgattgtgccactgcactccagactgggtaacagtgagatcctgtctaaaaagaaaagaaaaaag

SEQ ID NO: 530083 - DNA, 161 bp, Homo sapiens
tctctaaggacccggtgtttatcgatgccaccttcgccgtggccttaacctgggcagagccgtggctcaggtcgaggtgcgggaagtaggtcttggtggtgggtgcctgtagtcccagctactcaggaggctgaggcaggagaatggtgtgaacccgggag

SEQ ID NO: 530084 - DNA, 386 bp, Homo sapiens
cgtatatacacacacacacacaccatacatgtatatatgtggtcttcagagggtgcttatagaatgagttttagattggtatttagatgtgtcattacctcttctaaacacaaaccagctgatgtgttttaatctgtgtctgtgtctatcttgtgattaatttggtgggttctacttggtttaacatatataaagagtatgcagcacgtttaattcttctttccacactttatattccttagattctgtgcaccttaatcgcaacacatgggtatggctttttcctgctacaactacagggtacttgagcctttcccctcaagtgcattcggtcacccaggatgagactcactagtagcctgctttggcagtgtggctttttgcac

SEQ ID NO: 530085 - DNA, 418 bp, Homo sapiens
ataggtcggtcctcttctcccctgacatgggattctgacgcacgagttccagataatctgtgaatgtgccccgccaacgaagtgcttcctcctccgcgcgatacgagctcaggcgttccaggaaacccatgatcccatcctccttgcgatacggatgcacgccttcgcgtctgaagcggtgagtgacaggaggctttttctcatcctatgaacgagcggcttttccacatacccgtgccgtccagtttgggcgcgcccggccgcgaattccgccctcgcccatgggcatgcgaaaagccggtgggtttcaccaccggcctgcacggttgataggtcttcctcacgtggtgagcgatcacatcgacaagctcgtcatctcagcccacagctcgcgctcggctgtcaggggagaagaggt

SEQ ID NO: 530086 - DNA, 147 bp, Homo sapiens
caccagagatagttggaactacagctccacaccaccatgcctggctagattcttttttttcctggtagagatggggtctcgctagtgcgtgtccatccgtggtctcaagactcctggcacttcccaaagcacgtgggacttacaggc

SEQ ID NO: 530087 - DNA, 196 bp, Homo sapiens
actcgggaagtgcccgcgcgtcttgatgatcttgcgcaggcgggcattgacgctctcgatggcattggtcgtataaatcaccttacggatcggggcgggaaacgcaaagaacggaatcacccgatcccaggctcgacgccaggcggctgccacggtcggaaacttctggccccacgcgcccgcctcgaaggcatcc

SEQ ID NO: 530088 - DNA, 547 bp, Homo sapiens
  misc_feature (75)..(75): n is a, c, g, or t
gatggaagagggtcgggctcgcagcactcattattcaggtctgttaagactcctatctgtgagtgcactttgtanggtacatagagcaaatcccagcagtgaagatttcctctgtcgtttgaggacttcaaaggtttagtcttatctagactacaagttcaggtgcgatcgtgttatccagagtcgtggggactcaggattcttcctgcagtacatacacgctggcctccacaggtgagaagaggctgcagggaaaccgtgtgctgcactgtgcttacttaggctaggtcctgtgattctcagaccagaggccctgtattctgggcttttccaatatcttctattcacatctgactagagtagaccttcttttaggaaaaaaaaaaatttatggagcacctatgttagaaatacatttatgtgtataatcttagtcctcagaataaccctgtcgaaaaatatactggctacctccactgtgtatggatattaaggagaccaaaattgtgtatcataaggtcatgtgcatcacttgcagctctgtgcc

SEQ ID NO: 530089 - DNA, 350 bp, Homo sapiens
acgaaagtggctttaacatatctgaacacacaatagctaagccccaactggggattagataccccactattgtttaggccttaaaccctcaaacaggttaaattcaacaaaacttgttcggccagaacacttaccgagccacaagcttaaaaactccaaagggccctgcgcggtgcttcatttatttgtccctatgggttttgggttttatttgacttcgatgggcattatttttatttcgcaataacagaaaagggatttgcatcgtatgaagttttcattcgtggggcttttctttgttgtggggagggggtcgggggatagtttgatttccattttctgaaaacgac

SEQ ID NO: 530090 - DNA, 827 bp, Homo sapiens
  misc_feature (184)..(184): n is a, c, g, or t
  misc_feature (734)..(734): n is a, c, g, or t
tccaaggtatcccaaggttaatggatagatacaagtttttaacatcggggcatgaacttgactgtgataatttaggtacacttaattccaatactataataggagggaccaattcaaattctccccattggtttacaccccccacgaataacacccatttcaggggctattcaacgatctctcnaaaaatctggaatccagtttttggtggcaatgtaacccctatggttccttttcaaaaagcatctttgtcggcacttgcccgaggctcagggtattattaaatatcttagccactattaaacgccctattcacctaagcaggttagaatatcaccgggcacatctatcactatattcacggggcaccaacacctatcatattccaacggttgaaggcatattttctctggtaacacacacccaatcgggtatccatatccaatatttattgcgcacacaacatctcgagatgtttattcactggcaccccaaaatgtggctattccataacgagtatatcaccagtggtgccgcttattacaagtatttcgctacctctctaaaaaccagcctcttaatgaaataaaactctgggccgacgctcacacagacaaagtgtccctctttgcccacataaggaagcgtggctcctcttggctgtgaaagaaactctatcattgccatgctcaacatcatattgcgcctagttgccctgcctaacaattattaanctaatctctaaaacactttaagacagtattacctcctctaaaaaatcatcattttggcacgggttaacacctcaggactttcacagacactta

SEQ ID NO: 530091 - DNA, 403 bp, Homo sapiens
  misc_feature (129)..(129): n is a, c, g, or t
  misc_feature (154)..(154): n is a, c, g, or t
  misc_feature (172)..(172): n is a, c, g, or t
  misc_feature (181)..(181): n is a, c, g, or t
  misc_feature (228)..(228): n is a, c, g, or t
  misc_feature (359)..(359): n is a, c, g, or t
  misc_feature (368)..(368): n is a, c, g, or t
  misc_feature (394)..(394): n is a, c, g, or t
ttccatagtaatctccatactcttctctcttgaggttaggaattcaggacaagcctgggcaaaataggcaagacccaatctgtcacaaaaaaattaaaaacgtatctggggcgtatttgtgcacatttnaagtcttgggctatttgggaagctngggagggaggactgtttnaacccaggngttagtggctgcagtgagctgtgatcacaccaccacattctagtctnggtgacagagcgagatcctgactcagaaaaaaaaaattttttttaatttttaaaaattaaaaaaggcaaggcatagtggtttatgcctgtaatcccagcattttgggagacgaagttgagagaattgcttnagtccaggngttttagtatgtaatcacgccactgnacttcagcc

SEQ ID NO: 530092 - DNA, 408 bp, Homo sapiens
tttacctcccggggttttccaatttcccccccctttccgccaaaggggggtttttttgggccccaaaaccacggggcttttccaaattttgttaccaccccccccccttttccccaattggggggtgggggtttccggtgggggttttttttaaccaagcctttttttttgacccgccggttcccctggagcgccccccccccttttttttccctccttagaagaccccggggcggtttccaccctcgggttttttccttgggcccggggggggttacctttttcccccgggaacccctttttccctttggccctttttgggtgcccttttaaaccagttttttccaaaaaaccgggtgggtcccggcccggatttcccgggtttttttcccccccccgttccgttta

SEQ ID NO: 530093 - DNA, 225 bp, Homo sapiens
gaccctgtgccggggaatctgtcctggtacagcgtaaaaccatggtcgatatgaaaacccagggtctacacgagtaaataatagaatacacaagtcaaactagctcacaatgttctatgagtgacactaaacataagagagcttacctgctactccaggccaacatactctgtgtcaaagggaagatgcttgaactccccaagacaagagtgggggtaccgagct

SEQ ID NO: 530094 - DNA, 109 bp, Homo sapiens
tctagaggacccccgtagtctcatggtgtcacttggagttataaacaactcaggtgagtattagctatattggggaggggtgtgatctaaaaacactctttatgcctgg

SEQ ID NO: 530095 - DNA, 292 bp, Homo sapiens
tgcactgaagcagttagatgagcagaggctcaggaactggaggaccagtaccgcgcgagcgggaggaggccaactaccgtgggtggagcagcagctggctggacatatgagagcacagctggaggctctgcagaagcagattgactccagtgtactacccggaggtgaacgaggaggaggaggagcccgagaatagaagtccagtggacagagcagggagtgtgagctggcgctctgggactaccggaagtggcagtggtaccagttcacgtctctgcgggacctgctgtgg

SEQ ID NO: 530096 - DNA, 336 bp, Homo sapiens
  misc_feature (21)..(21): n is a, c, g, or t
  misc_feature (180)..(180): n is a, c, g, or t
  misc_feature (281)..(281): n is a, c, g, or t
  misc_feature (300)..(300): n is a, c, g, or t
ctgccatgagccttgatagtnctactgtactccagcctgggtgacagagcaagactccagctctaaataaataaattaagcaatgaaacactggtaaatgctacaagctggatgaatctccaaagcataatgctaagtgaaagaagccagatgtgtacaactacatattgtatgattctntttatatgaaatctgcagaaaaggcaaatttatggaggcaaaaagcagatcagtggtttcccagacctggggggtggtagaagaaccagagatgacctgtnaaatttaggttgggggggncatttttgaaggtgatgggaaagttttgaaactagg

SEQ ID NO: 530097 - DNA, 591 bp, Homo sapiens
  misc_feature (453)..(453): n is a, c, g, or t
gtgcggcccccaacccaaaaaatatttttttttggcccccaaaaaaagggggggggggggggggccccccaaaaaaaggcgggggttttgttaaaaaaaaaggggaggggggggggcccccccctcctttttttgggggggggggtttttttgtttaaaaaaaaaaaataacccccccccccccacctaaaaaaaaaattttttttttttataacaccttttttttttaaaaaaaaaaaaaaaaaggggggggcccccccctctttgggcccaaccccctttttgttttttcacccccccccccccaaaaaaaatttttttttaggaaaaaaaattcggggggggcgcccttttttccccccccaaaaaaaaattttccccccccttttaaaaaatattttgggggcccccattttttaaaggcggcccccccccttttttaaaaaaattttntttttttttttttttttggaagaagtttcctttttttcccaggggtgaaaaccaaagggggtgtttttggtccattgaaaccctccctcccagggtcaaaggattttccttttttagcctccgaggaattggggactc

SEQ ID NO: 530098 - DNA, 271 bp, Homo sapiens
  misc_feature (20)..(20): n is a, c, g, or t
  misc_feature (24)..(24): n is a, c, g, or t
  misc_feature (26)..(26): n is a, c, g, or t
  misc_feature (45)..(45): n is a, c, g, or t
  misc_feature (120)..(120): n is a, c, g, or t
  misc_feature (124)..(125): n is a, c, g, or t
actaagtggcccgatggtgnctgnantactgattttaaaaccgtnaagactcacccatgttgagtgtatgggttcagtggggtactctagtcatactactacttcacagtaacatctttncatnncactccggaaaagaagaagaaaccctgaacctgccatgaacagccacttgcccttcctcctcccagccccgggcaactgtgaatccactttctgcctctgtggatttgcctgttttgaacctttcatataaacagaatcacacact

SEQ ID NO: 530099 - DNA, 238 bp, Homo sapiens
ttattttccttctttatggttggtttctttttggagacgggatttggctctgtcacccaggctggaatgcaggtctccatcgtggctcacggcagactcagcgttccaggctcaagcaagcgatcctctcacctcagcctcacaagtagatgggaccacaggtgtgtaccaccacactcagctaattttattgactgattgattgagatggggtctcactgcagcccaggcgggaatg

SEQ ID NO: 530100 - DNA, 442 bp, Homo sapiens
ggacaaggctactgtgcccagtagtgtggcgacagatcagaaagctgtgtagtgatgcacgaggagcccagaacagcctacaacctgccttccccgttccccactagggcacagtgtttccagcccccccaccagtcccctaccgcccctacaggcagggccctcctccctcttaggttcccagagaggctcatctgcatcccccttcccaggctccggcttgatttgcgaccttgttttccaaaggcaagcctgcctccccctcccccattccccagggggttgcttcagcctccattaccaaaccctgtgacaagaaatgcggcccccttattaaaataatgttatgtctaactaaaatagaaaccccggataacagtttttgatgttttaatgactgggctcattagacagacttcccacttaaagcgccgcggccgct

SEQ ID NO: 530101 - DNA, 444 bp, Homo sapiens
  misc_feature (150)..(150): n is a, c, g, or t
  misc_feature (190)..(190): n is a, c, g, or t
tggccggcagctgaggactcctgacgctttgccgagacgctgaaggtggaaggcccgcagcccacacactggaacaccagcgctgcttgctggctgaggccttgaccttggcctggccgtgtgaagacactggacaaaaaccacgcacgntagaagtcagcgcgtgatgctagagcagcgagcaccacgnaagcggctggtagcagattggcgcggaggtcctttgctgtgccaggacggattctacagggccatctcgatggcaggcccggctcttgagaggcatggccccgtacttgctgtagaacgtctccccgatgttccccgccaacaccgccatgtctgtgcaggtcaaaaacagcaaaccttcctttcactcacaggcctgcaccaggttgcattccagggaagggtggctggggcttgccataagggggtccagaa

SEQ ID NO: 530102 - DNA, 136 bp, Homo sapiens
atccaaagaattcggcacgagggtttgccgccagaacacaggtgtcgtgaaaactacccctaaaaggcaaaatgggaaagggaaagacttatattaacaatgtcggtaattggcaaggaggattcggcaaagtcca

SEQ ID NO: 530103 - DNA, 407 bp, Homo sapiens
gtgggagctcttgcttgaggccctggcctggctccagaagcactgacatgtggcatgcgtaggagacgtgacctgtcactgcacgatgacacagctgatggacactgtccactgaacatgcctttgcctacaagacattacagtggctttgatggactgtccacttgccctgagatcccaaacataagccctgccttgctaggcactgattaatgcatgggtggaccatccaagactgcaccgaagggcaaggtggaggctcatatgagagctatattaactagaggacagagtgctactcttactaatgtggacagatgcctgcaccatagatatgtcatcttgagcagagacagtgacacctatatgtgcttacccacatgtccactgcacactgttatggcctg

SEQ ID NO: 530104 - DNA, 204 bp, Homo sapiens
atagaagagactttcggcggcgcccatggggtctgaggagtcaatgatgatcacgtcgaatgcaggctgattctgtatcatgaactcaaaaccgtcacccacatgtagggtcagcttcgagctagagtagccaatggccatgcctggcaggaacttcttggagacttgtatgacatcctcgtcgatctcacactggaccacgga

SEQ ID NO: 530105 - DNA, 411 bp, Homo sapiens
  misc_feature (326)..(326): n is a, c, g, or t
  misc_feature (342)..(342): n is a, c, g, or t
  misc_feature (383)..(383): n is a, c, g, or t
  misc_feature (399)..(399): n is a, c, g, or t
  misc_feature (409)..(409): n is a, c, g, or t
tcaggctgtgaaagaaaatatcttgggccccaaaatcactaagctacaaggaaaattcaagctgggaactgcttagggcaaacctgcctcccattctattcaaagtcatccctctgctcactgagataaacgcgtatctgattgcttcctttagaaaggctaattaggattacatcatcgagagagggccaggaagctcctgcagggaaggagctggcatctgtattaggcaggacctagtccccactctgggaggaacagctcttcctcttcaagggcccgggaaacggcttttccctcttgggcttgcccaccacacctggaantttcccccaggtaggncccttattgggggagggagccttggggagggggtttggggnaacagatttcttttgnacctgttacnat

SEQ ID NO: 530106 - DNA, 504 bp, Homo sapiens
ttcttaatcatttgtgctcggagaggtatggcagtgccacagagagtgtgtgcgtcatatgagagtacttgcgcttgaattgatgcaacacaaaggtactcttgggcaggtgagcgaaggggtccttggccttgggctcagcagccagcgcctgctcacattcatccatctcctcctcaggagcaggggcagccgccttttgctcctccttccgctcagcctggggcttctgcttctcttcccgtgaacccttctctttccgtggttgtgtcctttttaggttgggtctctgcaaactttttagcatcaaactgggccaacttctcacacagtttcacttcccccaagacagccgcggaactgtgggcttggttaattgcaggtgaggaaccagcggttgatattgggaaaggcctggcggaaagaaggctctagaacctgcttatagagccacaacagggtgcagaccactgtgatgtctgcaatgtactccttcaccaagct

SEQ ID NO: 530107 - DNA, 641 bp, Homo sapiens
gaaagaaggaagaagaaaggaaagaaaggaagaagatagaaacgaggaagaaagaagaaaaaagaaacaatagaagaagaggaagaaagaaaagaaaaaagaaaaagagaagaaagagggaagaaagaaaacgaggaagaagaaagaagaacgaagaagaaagaggaagaagaaaaaagaggaaagaagaaaacgaataaggaagaagaacacaaaggaagaagaaagcagaagaaaagaacagaaacagagggaagaggaacgaagaacgaagaaaagaggaaacgaacggacggaggagaagaacaaggagaagaagaaagaacgaagggacgaacggacgaacgaacacacgaacggacgaacgacggacacacggaacgaaggcagaacagatcacacggacgacacggaacgacggacacgaacgaacgcgacgacacacgaacgaacgaacgaacgaacgaactaagaagaaacctaacgaaggacgaacgaacgcaggcgagcacgaacgaaaacgaacgacaacaggcgaacggacagacagaagaacttaacgaagaacgcgaggacagacacgaaggacaaccgaacgaacgaacgcaagcgagaaggaacgacaggagaggagaagaacg

SEQ ID NO: 530108 - DNA, 100 bp, Homo sapiens
aatgaaagatttaataaggcaaagcagaatctgttgtccttaagtatatttgcaatgtggaatttgtgtgagttgatttagtgaaatgttaaaccgttaa

SEQ ID NO: 530109 - DNA, 440 bp, Homo sapiens
caaagaaagtggctgtttgaaaaggaatctattcatgttgaagactctgtaaatattgttgaaatgacaacaaaggatgcggaatagtgcataaacttagttgaccaagcagagacaaggtttgagagaattgactccaattttgaaagaagttctactatgggtaaaatgctatcaaacagcattgcatgatatggagaaatcctttgtgaaagggagtcaatcaatgcagcaaacttcattgttgtcttattttaagaaattgccatagccattcccaacattcagaaactaccattctgatcagtcagcaacctgaccctgatcagtcagcacctatcaacattgaggcaagaccttccacaagcaaaatgactgtgaatctagtgggcacggtgatgtgggcctgtagtcccagctcctcagcaggctgaaacaga

SEQ ID NO: 530110 - DNA, 266 bp, Homo sapiens
agttgactagaggtccctggcaggctctctaccttaagctaattaacttcatcacctcaggtatttaccattttcctttcttttggatggtggtgggggagaacacttaaaatctaccctctgggcaaatttcaggtatatagtacctggaaactggtagtcaccatggcggttcatggagatctccagaaacttatccatggcggcataactggaaacttgggtaccctttggactaatcaatctttccaatttctccccggggg

SEQ ID NO: 530111 - DNA, 391 bp, Homo sapiens
gaccactcactgccttccacacccacatcgcactcattgccttccgtacccacctcacaccttccacacccacctcacactcacggccttccacacccacctcacaccttccacacccacctcacactccttccacacccacctcacactctcctccttccacacccacctcacactcctccttccacacccaccacactctcctccttccacacccacctctcacactcacctccttccacatccacctcacacctccacacccacctctcacactcacctccttccacacccacttcatacctccttccacacccctctcacctccttccacacgcacctctcaccttccacactcatctctcacactcaccttccacatccaccgtcg

SEQ ID NO: 530112 - DNA, 194 bp, Homo sapiens
  misc_feature (8)..(8): n is a, c, g, or t
  misc_feature (51)..(51): n is a, c, g, or t
  misc_feature (61)..(61): n is a, c, g, or t
  misc_feature (104)..(104): n is a, c, g, or t
acaatganctgaataaataacattcagctccaaattcgcaaaaaaaatttnaacatttgtnccaaaatgtgtggccaaaaggttaaaaatatccaagtgatctnctgtctcctggtttcaacgtcatcagggtccatttggccaccagagggtaaggaaggctctacaaacacggcatgtttctacccaccccg

SEQ ID NO: 530113 - DNA, 314 bp, Homo sapiens
ctgagtttgagtccctcggccagtttctagctgtggacccttgagtccctcggccagtttctagctgtggacccttgagtccctcggccagtttctagttatggacccttgagttccttggccagtttctagctgtggacccttgagtctgtaggtcagtttctagctgtggacccttgagtctctaggtcagtttctagctgtggacccttgagtccctcggtcagtttctagctgtggacccttgagtacattgctctctgggctgcacttgccccttctgtaggaggactgtgaattcctctcctcctgga

SEQ ID NO: 530114 - DNA, 214 bp, Homo sapiens
  misc_feature (4)..(4): n is a, c, g, or t
  misc_feature (26)..(26): n is a, c, g, or t
  misc_feature (104)..(104): n is a, c, g, or t
  misc_feature (139)..(139): n is a, c, g, or t
  misc_feature (174)..(174): n is a, c, g, or t
  misc_feature (205)..(205): n is a, c, g, or t
tttncaagacagggtctccctatgtnacccaggctggagtaatggcatgacctcggctcactgcagcctcgacctcacaggctcaagcaatcctcccatctcancctcctgtcataggccaccacacgcagctaatttntgtatttttttgtagagctggggttttgccatgtnccctaggctacacttgaattcctgggctcangcaatctgc

SEQ ID NO: 530115 - DNA, 133 bp, Homo sapiens
acaaagcctccctaaaaagagaaggggcccctgggaaacagtcttaggggacccaaagtttatgcagataaaccagccgggccctttttttcatttggaaagaaaaagtttaggttaaaagacattacttttg

SEQ ID NO: 530116 - DNA, 117 bp, Homo sapiens
ctactaggagcgcaatagcatcgaataatcttctcaccctgaacaggtcaactcgcttccctacccttactaacattaacgaaaataaccccacccgactaaaccccattaaacgcc

SEQ ID NO: 530117 - DNA, 100 bp, Homo sapiens
gaccactctgcttcttcttattaattccttgtaatttgttgtactaaatagattgtcttctaaatttcctgtagtctgaattatgtagtattgtataaag

SEQ ID NO: 530118 - DNA, 1008 bp, Homo sapiens
  misc_feature (55)..(55): n is a, c, g, or t
  misc_feature (99)..(99): n is a, c, g, or t
  misc_feature (255)..(256): n is a, c, g, or t
  misc_feature (259)..(260): n is a, c, g, or t
  misc_feature (289)..(289): n is a, c, g, or t
  misc_feature (341)..(341): n is a, c, g, or t
  misc_feature (361)..(361): n is a, c, g, or t
  misc_feature (381)..(381): n is a, c, g, or t
  misc_feature (389)..(389): n is a, c, g, or t
  misc_feature (425)..(425): n is a, c, g, or t
  misc_feature (439)..(439): n is a, c, g, or t
  misc_feature (444)..(445): n is a, c, g, or t
  misc_feature (447)..(448): n is a, c, g, or t
  misc_feature (458)..(458): n is a, c, g, or t
  misc_feature (482)..(482): n is a, c, g, or t
  misc_feature (500)..(501): n is a, c, g, or t
  misc_feature (524)..(525): n is a, c, g, or t
  misc_feature (919)..(919): n is a, c, g, or t
ccaagaagccgctcagatatgaagcatcaacaaacgaattgataaatgaagagtnggaatagcttatccaatcattgatgggatccctaatatgatacnacagcagctaggatgacacgtcaagtaagagcaagaagaagtgagcagcgctagtcataattaaaaaaataaaaaaacgcaacagccaactttctaataccaataccttttaaaacacagtggcaggtaataagtggaagagaagaatgtttctgnntcnnctacgttgactgttcttattccactggtntctttagcaggactgttctactcagcctctgtggaagaaaacttcccacagngctgctactagcacagccancctttgcttttacagccccntctcgccnattaccataccagtgtatgtagcctcccacctttgnacttggatgggtantaaanncnncaggcataantgaggcaactagaggcaatatgcngtatatattaatgatagnncttgggcatcgatctctgaaagnncaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacatnatcaaatagaaacctcatgtactcaccaacactgcgtttgtaacactacctccattcctttgacactcaacgcttatactagcaatcaa

SEQ ID NO: 530119 - DNA, 478 bp, Homo sapiens
  misc_feature (468)..(468): n is a, c, g, or t
  misc_feature (474)..(475): n is a, c, g, or t
aacggggcggggcgcggacgaacggggccacgagcccgggggggccgaggagcgaggccgggaacgaaccgccggcggacggacgcacaccgcgggggaaaggcgggggcggccggccccaagagagagcggccgagaggccgagaccggcgcgcggaaacgcccgccggcggacgggaaggacacaccgcccgccaaccattggttgggaatagcggatggcatgggggaccgggaaccaagcaaggcagtaagagctggggggacagtcgaaaaatgcgccccggcccacagccctggcggaccatgcgcgcccaaaaaaaaaacctgcccgcccccccagaaaataacacttcccgcataaaacaggggacggctcaggccccggggctgggggcgagggagccagtgcagggagggtctgcaggggcgggaggctcacgcaaagtgaaataaacactattttgncggctnnaaa

SEQ ID NO: 530120 - DNA, 984 bp, Homo sapiens
  misc_feature (398)..(398): n is a, c, g, or t
gacaaagagttattactgacaaacacagaagtcttgtgccctcaacatacatgcgtgtggcgatcatgtgggattgatgtcatcgtgcagcttacttgcttcctcctgagcattgggtactaactagaataggagcgaagaaggtacatgacacgtagataattatggatagactcggtcgttaatacttccacaactatagcgagatacctactaaatactgcgcgagtgcctggatccacgtggcgcccacggcatcagcgtcgaaaccctaatgtctcgtcagacaatcgatgcaggtctcttcctactcgattattctccctagtcccatggtgctagtgccaccttgcgagcaagctacttttcccacttcgcaagcctcgtcctcttcatgnccatcgtaggcacgtagctattgtggagggaaacgacataattcaactaatctcgtgcacaacgaagggatggaagctgtgaggtggtcgtcgacaaagggacacaccctaagcccaacttaatctggggtgtcctcttggctgtcactctaggctcactatgtcttgcagcctaaccaggaaattctacactgcatatccacatagatagacaaaaagaagaaacatggcaaacggtgcgagggggtgggacggcgagtaccaaacgccgagaaccggtaccttttccgtgatgtcgtggccgcttcagaccgctaatgacttggttcctgattcccaccgacgaaggatagtaaggattggaacccacgaccaagcgatgtgggggcttcccacattgtggtcttttgggggctacacggtctccgaaccatcgttcctaagaaggtctccagaggcggcattcgcctagtttgggcggacataggattggtgcataggcgataagtgtctatgactttcaagaagttttgggggacaccaaaagcatgtttcttagaactcattagaggaaaacacaaacttc

SEQ ID NO: 530121 - DNA, 109 bp, Homo sapiens
gtgatgaatgttcttagctgtcatgtttaaaaatacttctgctccgcttactgacccagcaggcgtgaccgctccgcttacttacgcttactgatgctccgcttactga

SEQ ID NO: 530122 - DNA, 131 bp, Homo sapiens
ctcggcgcggcttattgtgaggaagcagggattgtcataccaacctgatggcgtcaagggaatcaagggcccacactggtttttggatccacccaaagccacagcttcagcctccttcatgaccccaagag

SEQ ID NO: 530123 - DNA, 179 bp, Homo sapiens
aaatagaaagggaaaaatcataaagagtaagtatgagtaggggaaaaaagacatttacttcatggatatatgaaggtggtcatggtaggtaatacttatgccacagaaaagggcccgattccttttaagcctgaaaatgctatgggtcatagaaagttttttttggagacagcatatca

SEQ ID NO: 530124 - DNA, 447 bp, Homo sapiens
agaactgctcactatggctccctgccccaaaagtcacacggccggacccaagatgaaaaccccgtagtccacttcttcaagaacattgtgacgcctcgcacacctcccctaatgcctgcggagttgtgcacgtagtaaggtcaggccacggcagcctaccggcaatttccggccaacagttaaatgagaacatgaaaacagaaaacggctaaaactgtccctttctgtgtgaagatcacgttccttcccccgaaatgtgcccccagacgcacgtgggtcttcagggggccaggagcacaaacgtccttgcacgttaccccctcaacccttgaactgtctttccggcgaggctgcggcaccctagcgcttttgctggtcactgccatggaggcacacatctgcagagacaaagaggactggggcagcagagaggactgctgacatcca

SEQ ID NO: 530125 - DNA, 1612 bp, Homo sapiens
  misc_feature (263)..(263): n is a, c, g, or t
  misc_feature (338)..(338): n is a, c, g, or t
  misc_feature (540)..(540): n is a, c, g, or t
  misc_feature (776)..(776): n is a, c, g, or t
tagcacgtctataagaaatgcaggcttaattatatttccacaatgtctttccaaagtattcattggtttttatggtaattcatcactgaactcttaatttttgcttttctattaagaactatatagtatgtacaaaattacttgatcacaaaattacttgctagttccaggaaaaatatgaatgaatcttctgtggccagttaggaatacatcagtttgatgcatttttaaatggctctaaacatctaataaggtactgtatntggagagaaaaggtggctatctccatattcaaaatatttcttccagtctccaagatactctattcttttaatgtntggcttgttcctatcacagttatcaagctgagaatacagctgaggaagttcattctctaagtcaccagaggtataatatgtgcttaaactgtcaatttagtgccctaaaaatccattaaccaaaaacaaaaacgttttctcccttggtcatttcatataataaaaaaaattaatattttatagaggtttttccttgaattangtgctttaacaattgatttccaagggaatattagtatgattttttcctcagaaaagcaaatatgatttaatagggaaaattattattctatgatatttcttatctcataagaaatttcttatctaatattttacacaggtaaattgaagtgaaaaataagctactatatggtacaatcaaaatataataaggagaaaaagtagaccaataaagtgctctctaaaaatttatttttnggacttaatcaaaataattgcctcaatccttctctttatgtatatgtagccttaactaactatatacttataaactcagctgggctgatgcacagtaactttattaaaggagaaactggactcttgttatttcctaaagcagaacatggcctgttctccctgatacaagaaaacaatgttttcaactttataaccataaatgcacataataacagggaaaattagccacagttctcctcccctactcccctgagcccctactttaaaggactatttgttatttatatagtgttaaagataatattccatatctttgaagtataagacagagaggcacagtataagaattatttataactttttagaaacaattacttgaaaaggaaccttatacaattagggtattatttttagatttggtgaacatttatagtatattaaaaattaaatgtttaaattttgcaggtttttttatattaggcaccttttaagttcccagcatatttggctaccactatcaacttggaaacattccatttgtagtatcatcaaatatatattttgtaggacaatttatatatgatgtgatttgacctaccatattaaagcagacacagattacgtatcatgctttcaaccaaaattacagacttcctttgaaacatgctgcagatttgatagaggtatattatgtcttaggaaaatacaatgaagaaggtccaaatccctattgaggctggatgtctgatctgcactagacttaagaggatatatcatttcatctgcatgtaacacatagggctgaatgtgatgtcaaaagggtttcccgttaataa

SEQ ID NO: 530126 - DNA, 325 bp, Homo sapiens
  misc_feature (42)..(42): n is a, c, g, or t
acgcacattactagtacgcacataactagtacgcacataacnagtacgcacataactagtacgcacatatatataactaaaaaaaggtaaatgtcagcaaacaaatgcaaacctgtagggtaaatggatatataaaaaaaattcagtatatcaaatttcatcttctctggcatattagattgggaactataggttatttagaaaatttagactggtggaacgttcatttctaggctccttggcatatgtttcatttcatacaaaggcttccagattgtgcccggtagcttccttggaggtccttttccacttatctcctctgggc

SEQ ID NO: 530127 - DNA, 306 bp, Homo sapiens
aaaaaaaggggggaaggggcccccgggatttgggttttttccctgtgaagggaaaaaaaacctttagggtggcttttttttttttacccccggaaagggtgggaccccccccaccaaaaaaaaacctggcctggtttttggaccggccctttttttttttttttttttcaaacggggttttttccccggggggttttttttcccaagggaaatgccgaaggaggcaaaaaaccccgccaaggggtttggggccagccccttccctccttttttggcaaaaaagggatttttttttaagggcctgga

SEQ ID NO: 530128 - DNA, 209 bp, Homo sapiens
  misc_feature (42)..(42): n is a, c, g, or t
acgcacattactagtacgcacataactagtacgcacataacnagtacgcacataactagtacgcacataactagtacgcacataactagcacgcacataactaggatgggggtgggggtggtggtgcatggacgctcttagttggtggagcgatatgtcatggttaattccgataacgaacgagactctggcatgctaactagattatg

SEQ ID NO: 530129 - DNA, 523 bp, Homo sapiens
gtaaacttgggtaactagagtaccggcgcgagttaactatttaaggctatctcagggtattgtggactttcattactaattagaagtagactccatatctctcctacccctgttatacaatgaacattacacgtctattctctgctgacctactaaagcagtttatcagttgattctcttggatttcctaggtattaaatatcttagagcccaccatcaccccggctaattttggtattttttagtagagacggggtttcatcatattggccaagctggtctcgaactcctgacctcaggcgatccatctgtctcaggctcccaaagtgctgggattacaggtgtgagccaccgcgccaggcctcagcccacttcttttgggtggcaatggtttggatatcgttggtcctcactaaaattcatgttgagattcgagccccagtgtggcaggtgttgggatgtggggcctcataggagctgtgtggtcttggaggtggagtcctcatggatagatttaatgctg

SEQ ID NO: 530130 - DNA, 181 bp, Homo sapiens
aatgttacgacataagataaaggcttatgataaacatacaaggagttatctgtattcttgagcgaaaaagactttgtggctaagcagataagagcctgatgccatactccccatagtgagatcatattttctaaaaatggtgtcactcaaggctgtggcttacaaaagatatttttagagg

SEQ ID NO: 530131 - DNA, 351 bp, Homo sapiens
actggccagtctgggaaaccgcctgccacgtggaagagccaaacccgactctctgctgccacatgccgttcccatgcctggctgctgggcacctgggagagcttccagaatcctcgcagacagcccagagcctgccgctaccctcgcctgccccacctccaagcaagcgcaagcaagatgggttctcatcagttcttcctcccacaatgagggcccttcccttaccctcccatgggttaaataggtccggggtcctagtccttttccttagccccggaaccaggtttttaacataaccaccccccccttttttttaaataaaacaccggattttcaacactgtcaaaaaaa

SEQ ID NO: 530132 - DNA, 424 bp, Homo sapiens
taaagacagaatctcactctgtcacgcaggctggagtgcagtggcacgatctcggctcgctgcaacccctgcttcctgggttcaagcagttctctgcctcagcctcccaagtagctgggactacaggtgcccaccaacacgcctggctaatttctgcattttagtagagatggggctttaccatgttggccagctggtctcaaactcctgacctcaagtgattcacccaccttggccccccaaagtgctgggattacaggtgtgagccactgtgcccggccttacattttgtgttttttcctgctgcttgtatgtgtgcaagtctgtgtatcatcaatgggtatatgtgtacctgcgctgacaacaaaaaatgagatgcttatcagctactacacaaagctgttataaggatgaaatgcagtta

SEQ ID NO: 530133 - DNA, 778 bp, Homo sapiens
  misc_feature (380)..(380): n is a, c, g, or t
agcgggtgcttccgttttccgttccgctggcctgtctcgcttcgcggccacctcttccccaacgctacccgctccgtaccctgactcgctgctcctctgtgctggcagagagcgcgcagaacgtagctggacccaagggtttatttaccacattggctggtgtgtccatctgctgtgcaaccacatttatctccggtgagataaaccccatttatctcctagcaagtccctggcgcacagtgagctctgataaaagtacgttgaattggaacctggaactggactaacagctcccaagttcgtatctccgcctcagatctccttttaaactctagacgtgtgcatccatctgcctccatgcatccgcctccatgcatccngctccgcatccgcaccatgcatccagctccgcagcacctcccttgggatgcctaatagactctcaaatgttacatgccttctgtattgctccttcccccatcatttcatgcgtaggcagctagcagtctctgccacttttcctttgctgtggtcttctgctcaaatatcagctttcaaagagctcttccttttcaaagaggtcttgaacaacctaagacagtctgtcatcctctctggtcctggcctttcccagcactctcttgttctgctttatttttctttatgatacttatacctacgctgacattcatatgtcttctgcctgttcccacactcttatgaggacaagaacctattctggcctagtatctcctctggaatcctagtgggaacaaac

SEQ ID NO: 530134 - DNA, 1356 bp, Homo sapiens
agcggggcagcgcagggttacccctgaggaggggtgtgggggagaaagggtaggggtgggacccgtattcatctcccagcacggggagatcaaggacaggccatcatctgtcagaactatgaatgggtcccaggacaggtggctgtcagcaatgtctgcagttcccgcgtcaactgttgtcgcggagcctccgcggaggacctctaggagagcccggactaggactcagggtccctgggcctccactcgactactcccacaatgagagaagctggcgtgctctacagagctcgctcaaagggtcctcggagcaggtcctggtgccgtgagagtgtccaaggatgctccggaatgacgcgaagactatatcagcgagtcgttaccgagtcagagtagtgagagctagagaggtgggcttggtaaccctgaccttatatctagcggctgatgttgtcatggtcctgaggtctgcaaggctgatgggagggaatcggattctgcgacgagcgttgatacataccgatttcataagctcaaccgatgcgatcactatttccaatacgcctagtgatccattgggatcgtttaacgacgagcattgcaacaggagcatcatctgagggatgaactagggactgagacgaaaacaggttgaacgatgcgcctttttgaggtggaaggccacggtgtggtcgtgaccgaagacgtaacctttattttccttcacgtgccgtgaatggcccgggaacattggacagtttggccttggatgactttgttgccccctgtagccgaatggaaccatcttccttaaactaaaccgattcccttatacatgcgggactcattttggcaggaatacccggcaacggaaatcactttgggcgaaacctagggcgagatagctggttcgcatgttttggcaggaaccatcttggtatcagcacccagttcacaggacccccggcaccttttgggaacctcagtgtgtccagagccggccttagaaccaggttggggaggcattaactatcatccttcccccttagcgaacggggtttgtttccccaaaaaagctcgcccgtttagagaggaaacccccggatggatacaggtgcacgtgcagaatcacctatccaaggaattccggtaggggggttcgcgccccactatggcgtctggcctggagctttacccgtctcagttcaattggcagacccgtacgctctgacggtgtgccaaaccaattcccccgaaagattaaccccaagccttccggggagaacaagaccgtttggcgatccccggaagccatctgaggagtgttcgatgttccgaagaaccgagaggcatatc

SEQ ID NO: 530135 - DNA, 131 bp, Homo sapiens
agaccagcctgacaacatggtgagctgtcgtctccactaaaaatactaagacttagccaggcgtgatggtgcgcccccttattccccgcgctttgggaggcctcggcatgtggatcacgagctccggagtt

SEQ ID NO: 530136 - DNA, 220 bp, Homo sapiens
  misc_feature (5)..(5): n is a, c, g, or t
ccccnaaagccgcaaaaaccccggaagccaaactacggagggaaatttggtccactgcaacctccgatgataaagatgagaggcacaagggtacacagtacagttaaatgatgcaaacaaaaagcttctgttcccctccgatacaaatgagaagcctccatccatgtctcttacagaaataccacatacttgatgctgatactaggttactctgacgcgt

SEQ ID NO: 530137 - DNA, 828 bp, Homo sapiens
gaggagaacggtggccgcgtgggtgcagtgcctgactcgggccctgatggaggaggaggaggccgcctcgtgaagacgagaacggcgacgatcagggtttccaggaaggtggaagatgagctcggggacgaagaggaatggcgctgtgtgctgactgatgaactgtggcactggtgtgatgcagcaagccttcaacctgcctgtgctgactgcatgcatgcaacagcccgcacctctgcttgttctgctggtgactgggtgtgctgcctgccctgtgtgtgctgatggcatggggccatgcaagccagtgctgtgtgatgtggggagcgggcaagaaacatagacagcgatgcacacattgggctgtgcacggaataacaacaatgatgtgcggcgttgttacaacaaaagaacaccaccggatgcacacgaattcaattggaccgttcgtggacttacttttattggatgcgttagcgactattgcaacggacggaaccccaatggtaattaatgccaactggcaggccgaaaaatctcccgttcaaggccacccattggtttggagacgacagggaaatgcattgacagcgacagtatcggacttgaaccaacaggttgtgtattaggtcctttggattaaccgttaataaaacgtttcgtagaagtccttaaccacaatatcattacagacaacttaattcacaacgggatggaactccggttcttccacgtgtggcatttacattatccccctttttaccacagacatggggcactcgaacgctttaattggcgtatattactatttgggaggcttaggcacgg

SEQ ID NO: 530138 - DNA, 215 bp, Homo sapiens
agaggaatttgtttctccgcgtatccaaacttgtgtgtggttatcttgtctttttcattttttttttaaagacaggatatcactgtcacccaggctggattgcagcggtgtcaccatggctcactgcagcctcaacctcctgggctcaggtcatcctctcacctcagcctcccaagtagctgggactacagaatgagccaccgtgcccggcctta

SEQ ID NO: 530139 - DNA, 826 bp, Homo sapiens
agcgtggtggggcgtacggaaccagcatcatcccatgtagcataatagtcatctatgtaacaaagatcatcgaagggcggtgctgcccacaaggatgggaggttgcagattggagacatagatcctggcggtcaacagtgtggggctagagtgacgtcatgcatgaagattctgtggcagccctgaataacacgtatgatgttgtctacctaaaggtgggcaatgcccagcaagtgccgtacctgatgtgacagtgtactgtctcctctcgcagatgagtcatcaaccttcgttattcccaagcatgcgtggacaagtgagagtcagtcacatggagctacctgggcaccgactacgccatagccatggaccccacttcccctcggcgctactctccagtggccaaggtacctgctcggggaggaatgactattccccgagaaccgaggcgacattgtgatccaccggggctccacgggcctgggcttcaacatcgtgggtggcgaggacggtgcaaggcatcttcatctcctttatcctggccgggggccctgcagacctcagtggggagctgcggaagggggaccagatcctgtcgggtcaccggtgtggacctccgaaatgccagccatgagcaggctgccattgctcttgaagaatgcgggtcagacggtcacacgattcattcgctcagtataaacccataaagagttacagccgatcggagggccaagaatccacagacctttcggggaaccagttccattgaaccatgtcagccttgggcctccaggggcacttggcgtcccttacgggatgcaacccc

SEQ ID NO: 530140 - DNA, 107 bp, Homo sapiens
ctaatctatctggacaggcagctatcaccaggctcgcgttgtcgcctctacctataaatcttcccactattccgctacatagacgggtgtgctcttggagctgtact

SEQ ID NO: 530141 - DNA, 248 bp, Homo sapiens
cgtcagtgcttccctgttcgtgtgagggaggttgtgcacggacacgaagccaggcctcagaggcttcatcagctctgtactttgtccttgactacataagactgtatgctggcccccgttgaacacagataagaccacacggttctccagctgtttagccatcatctccacagggctccaggcgtcctcatcctgccctgttgccagctggtagttggtgcccatgccccaggagaaaacacgagcat

SEQ ID NO: 530142 - DNA, 183 bp, Homo sapiens
  misc_feature (62)..(62): n is a, c, g, or t
  misc_feature (74)..(74): n is a, c, g, or t
  misc_feature (101)..(101): n is a, c, g, or t
tagaagtcaatagcattcagatagtagcaacaaaatgggaatggagccaagatgactgtgtnctatgccaattnctgagacttttaacagatgtaaacttngacttctctcaaagagccaaaatacactaacataaattatatatatatatatatatgtgctattgaaacttctaaaactagg

SEQ ID NO: 530143 - DNA, 403 bp, Homo sapiens
  misc_feature (9)..(9): n is a, c, g, or t
aaagcttgnagaaggattccaatgcactgcagctgtcttgaagacagactgggcccatgtgatgggggatgtgagtggtatctagaaactgaaaggagttccctgcctgaaggcccaacagggaaatggcagcctcagtcctaccatcataagaaatcaactctgccaacaacctgaatgagtctggaagtgaattcttcccccagaccctccagataaggccctggtcagccaataccttgactttggccttgtaagaccttaagcaaacaactcagccaagcctactggacctctaaactactgagctgtgaaataacaaatgagtgttgttttaagctctcaagtctggagtaatgtgttatgtagcaatagaaactaacaaatacacattgtcttgata

SEQ ID NO: 530144 - DNA, 631 bp, Homo sapiens
cacctcctcggcgtcgtatctgccggacactttcgtcagactacatcctatctgaaaacgctccacgtcacaatagttttactcacccacttgcttcactcttgccagtagcaagtctgcgaactcgtgccttaggcaagggcatttattctagagaaacccggactctgcatcaaatgatgacattaccactttcacctatttctatggaaccagatacaaaactaggaaactgccagaccatctagtgaggtggacactcttctgtaatcctgggtagcttcctcaagtccctttaaatgacccaaaactattaataggtattataagcaataattattaaaaacaaaagtgctacatcacctgtctttcgccctgactctccaaatgaacataaagacacaccaaaaggctggtcaacagagctagctgggcacaatcactgcatctatagaacagccaatacttgaaaaactaggcacaagtacatgaggaattcttatcaaagatcatgcccaatccatgccacttcaatgggtttcagctgaggtaaggtcatgtcctctgaattcttaggcagatcagtgacctcaggttagagctcccggggaccgactcgatacgaaccagg

SEQ ID NO: 530145 - DNA, 242 bp, Homo sapiens
tgtggctcacgtgaaatgggaattggataaatccacatatccagttgggtgcagtagtcacaccttgtaatcccagcccaacacttggtggaggtctaggcgagaggaaggcttgagtgcctggagtttgagatcagcctggccaacataacaagacctcatctcttcaaaaaatttaaaaaccagccgggcatggttggtgcacaccttgtagtcccagctacttgggaggctgagtgtgg

SEQ ID NO: 530146 - DNA, 576 bp, Homo sapiens
cgtggagctggcagttgcttcgatgttggctcagcttgtttcatactcctgatcttcctgtgctccacctatctacaggctcctcctctagcagtcattctgggcgtgtgccagcatgcccgtggccctacgtaccagaacggcggttcagtcttaaacatttgctttaagaaaacagtcttgaatttcacatgctgctatttttatatttggccattttacagtactgtttggttttgagttcatgcatatcattgaaaatttctcgttttcattttcttagatgacttcttgtctgagacagaaaaatctcctactacaggagtgcagtccagaggttacgatgtattagaattataccaatatcagtttaaaaatctgtatgcataaaagaatgcaccactcaacttttttattcataagctaatattttttaacgttaccattaagattttttctcttttgcagctacatttgaacagtgatagaatacaagagattttaactgagttatcactttttcagctgatataattcatttttaatggcttttttgacagttccttttgcatgaac

SEQ ID NO: 530147 - DNA, 733 bp, Homo sapiens
  misc_feature (292)..(292): n is a, c, g, or t
ccatccccccaggcactggtcagggttatatgtccagtaaaccccccttccattggcccccagaccatggtcttcttacaagtgtctcactcaggaagggtttgtaggtataggccccaggaaccagttgggggctttaccaccaaaaaaccgcttcagtgttcgggatatttcccccaaacatgcagagaacctctccctaggcctccacagcaggcttccagagatgcttaaggccaagccccctcgcagtcaataaattatggttatggtcccccaccccttcttcccncacctttgtgtctggtgggcacactcttgcagaagcagctcacactccccgcatcttggtcctcagcaggtcctgtttggaggctgagaacagcagacccttggcatccagaggtccaattatgtcgtaccagactgggcagccatccaggtcatagccacacataccccctgacagatgctttcggaactccacatgcttccggagcatggcctccgacttctgcaggtcgaagcttctggctcggagccaacgcaggagaaaatagtcacctggattcggcagggccggcagcacatcctggacattctcccgaaacttggccaatgcctccttctgcctggggctcagatcgccgactctgccgctcatcgtggctcaaccgcggggatggggtttgggggcgggaggcggcgggtgcggcacctcaccagcacagac

SEQ ID NO: 530148 - DNA, 882 bp, Homo sapiens
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaggaagggaaaaaaaattggctttatacctcttcctggtttcaacggccatgaaatttctgaagcactcccaaattccggtggattaatccaaaacaaaatttataagtctcaaaactattttcaacttcttatacgtactagtatactttaaaaagcctcagggtatatatcttctaaacagctacaatttcagtgcagctactttaaccaccctatgtcctctagttgagaccaactaggcctattccactggctgtgtagcctcgtgcctaccagtgggtgccacaattaattttcgtagaattaccttgattgtaacaacccatctcgtttctgttttacaatgtgcccaaaaattcttcaaaaaggggtctgggattaactgaactcctttggcaactatacattcaatttcggattctcaagtaatggcgtgctgggtgggacttgatacttagtcctcagttttttaaaacctcaatagtgactgtttaaaaaatcctcctttttacaagaattgtcacaaccatgggacccccaaggatttttgcgtcaaaaggtcaattttgttcgcaattgtattcccaatctatagcatttcgatgggggccctgttacattgtg

SEQ ID NO: 530149 - DNA, 652 bp, Homo sapiens
ctatgtctgtactggtgtgtctttaggtcgtgagtgcgaatataatctaacacccattctattgcagtaagtacagcaagcctgaaaaagcagttgctcagacctcagccacctgccgcgactttgtgtcatcatctttattgctggggacagtcctgtgcattgtagagaagccagcatcttgtgctctacctcatctaggtgatacatgacgctatacccttgtgtgtctacatccatgtgtgcagacctagataattatacccggagcaagcatgatcgtactcatgcggaggagaccattgtggatcagctaacgctgagccaccctgatgcatcggtactgaggctagacgaataacaaggaactgagaggcagtgagggcagaacgggcttataaaacaacataattggaaatctgtaagaataagtgtaccagaaaatagcaatcaagacacctcaaagacttgggctggtgagctatctcagaatatctcaggagcatttagtagacagctatgcttagaacatgaaatgatagaatgggtataggtaggacataaaagcagaaaagacaactttattttacataaccataaatgataagctcactgttagtcttgcaggttatttactgtgtggtagtgctta

SEQ ID NO: 530150 - DNA, 176 bp, Homo sapiens
tctagaggattagtgtcatccccttcgtgatacggatgagtaaatttctttaaattcattcatccgctctttcaacgaaaacgttctgagatcactatgtgctagacacactattagggactggaggattaaaaggggacttaagggaacagggtaatcagataagtgaacaacac

SEQ ID NO: 530151 - DNA, 191 bp, Homo sapiens
  misc_feature (26)..(26): n is a, c, g, or t
  misc_feature (66)..(66): n is a, c, g, or t
  misc_feature (92)..(92): n is a, c, g, or t
tcctttcatcatatttcttctgattnttttagatcggttttggtttaaaatctcttcttcctcagnagtcagcttggctcccttcttgcggnccaggggcagcgcatagtgggactcgtaccactgtcggtacggtgtgctgtcgatgagcacgatgcaattcttcaccaggggtctggtacgaaccagct

SEQ ID NO: 530152 - DNA, 223 bp, Homo sapiens
  misc_feature (47)..(47): n is a, c, g, or t
  misc_feature (103)..(103): n is a, c, g, or t
  misc_feature (156)..(156): n is a, c, g, or t
  misc_feature (165)..(165): n is a, c, g, or t
  misc_feature (217)..(218): n is a, c, g, or t
gcacaagcttaaaaacccagagagtaatcctcaacttaaaggtttanaatgtaaattctctggtcattgagcaaaaccaaatgaacaaagcacctaaaatgcnccgccggacctacaaagctcatggtcggattaacccaaacataagctctcccngccacaatnaaatgacccccacggaaaaggaacagattgttcctaaaccagaaaaggaggnngccca

SEQ ID NO: 530153 - DNA, 474 bp, Homo sapiens
  misc_feature (92)..(92): n is a, c, g, or t
  misc_feature (394)..(394): n is a, c, g, or t
  misc_feature (433)..(433): n is a, c, g, or t
ggcagacagcttttcgcttaacgatgccttagctggctctggaaacccaaaccctcaaggatatccgggtgcatgggggaaccagcctgggnagggggctacccaggggctgcttatcctggggcctacccaggacaagctcctccaggggcctacccaggacaggctcctccaggggcctacccaggacaggctcctcctagtgcctaccccggcccaactgcccctggagcttatcctggcccaactgcccctggagcttatcctggctcaactgcccctggagccttcccagggcaactggggcacctggggcctaccccagtgctcctggaggctatcctgctgctggccttatggtgtccccgctggaccactgacggtgccctatganctgcccttgcctggaggagtcatgccccgcatgctgatnacaatcatggggacagtgaaaccaacgcaaacaggattgtt

SEQ ID NO: 530154 - DNA, 412 bp, Homo sapiens
ttttttgtagaaaccccgtgtctactaaaaatgcaaaaattggctgagtgtgatggcaggcgtctctagtcccagctgctcaggaggctgaggcaggagaatcgttcgaacccggggggcggatgttgcagtgagccgagatcgcgccattgcactccagcctgggcaacagtgcgagactacgtctcaaaacaaaaaacatcattgtcaatattcatctttggtttgagcctccgtttctttctcctttaaatgaaattgcttaagagcagataaatgtttttcagcactttattcctccttctcagttctctttgtttcccctgctttattaaaaatcttaaataatatccatattgttggcaccagactctcattgccgaaaccccatttaggctaagctagtgctgtg

SEQ ID NO: 530155 - DNA, 377 bp, Homo sapiens
aacaagttccctccaaatgggcagtcccacagtccttcatcaaaatacctgcacgccttgtagctcatagactccttgtattacagaaagagtatctgcttctcttctttctcctccaaccagtactcaattggaatgacaaagttagatgtgatccggcattctgggcaggactttatgatctatgctctcaaattgcttagcactcctccacttgcgaatgcacttgcgcacagtaggtgtggttgcagttggcgaggatcccgaagcggcgctcactggggttggctttctcatagaacacctccatgcagatcccacacaacatgtccttgctgcgctgcacggcaaatgagagctccatgtccctctcatga

SEQ ID NO: 530156 - DNA, 375 bp, Homo sapiens
agctcgccttcttgatccaggttctggaagcgctctgcgggccgtctaagtcatgctgtgagctctgcgttaggaacgtccagccgcccgccgaagctcagcaatccccgcgacggcatcataggtaaacagcaccgggaagcagatcgtggcccgcatgccaccaggctgttgtctgtgatgaaggtcagcgccagcagtggtagtgtttcagaggccagagtcgcgacggacatcttcttgtcggcatcagccaggcagacggtgctgtcgtggcttacccaggccacgcggctcccgctggctgagaaacagacgccatgtacccagccgcagctactgctggattcgaaccgacggattggattacaagga

SEQ ID NO: 530157 - DNA, 834 bp, Homo sapiens
tggggcgccaaccccaaaacagggcataaatggccccgaattattcaaaagcacggcttcaaatgcgtcaccgggaagatcgccgggagccatatctttgcccttttggcgagaaaggacgtggtgacctaccaccaccggtggggagagaaacaacgcgccccactccggggagccaggcagtgtccccccgcccccagagagcgtggacaaccccgggtacaagagaccccccgcgatgggcgcacccacccatggttgttggcgaccctctacaaggattctatgagagccacttcgctaagaccaccaattcttctgggccccactacttgttccgcccacggctcttcgctctcttccgctaagactaaagtaacccactccccacaggcccgctaatctttgttaacaacgcacgcctgtagacacaccatctgtgcacatcttgtgtcgccacacacaataaacgctcccacacgatttctcctgaaaacaaacaatatatcaatattatgtatacaatactaccaagaagagctggttcttctctttcttgggctctctcaataaacaagctccccgcgcccgtaactaatcgtggaaaatatttagcagttgtacctgtgtattctaccatgtagagcaccaccttgttgattaccaccccgacggcaatgacccttttttcccggaataagatcagattcccccctggtggagtccctgaccccatcacaccggttcgcgatgatgatcagcttgttccccccgacaggatgctgttttcggaaaacacccaactgatgcgtcttaaaaggaaaacaattgtca

SEQ ID NO: 530158 - DNA, 1158 bp, Homo sapiens
ggaaggacttctcgttcctcatgtagtgaactccattgattttcctatcttggtgctgatagctctctaaggtgtagggcacacctccccacagacaccctccctctatcagagagccacacagacagcagcaggacccatctgcctagcacatcctcaggcaagtgacacctcgctggactcagatgaggcacatagtagacactagacagaggaccaagacgggaccaataagcatcagagctgacaagaagaaaatgcacacgtcaagtgagcgcaagcaaggaaggctaagactcttcataggaaggtcaacccgtggtggagcacacaagggactgggaagacacagggcgacaggacgaaaagacgcaaacctacgaaagagtctcataagagacaagaacacgcggccacggcaacaagagagcaggacgagaatacagatcatggaactcaagcataagggcccaaaagaataagccatcatatcacaagggggaacgcaacggaggccatagaagacgatgacaatcgcaaggggaaaaaagaggaaaacacctagaacaagaacaccgaccatagagggcaaaatacagccagaaacccgacatggacaggagagcgcgaggcaaagtcagagagaaggggaacgaaagaccactaaccgacagaaaacaaacagaaccaacgccagcaaagggaccatggaagggaagaccaaaacaaaaaccacaacaacaatacaagcaaaacacaataacagaacacacaggacaccaaacaaccataggaaacggcaagcatacccatggaaagaatatcacccacgaaagaagacaagaaagagacatgcaagccagcaagatcccaggacacagtagcaagacaaacaccaaggcggtcacaccacgggaccataccacaaagaggacagaagatggacacacctacatgagaggacaaaacgaatgaagcataggacacaagacaggcgcgcaaacaagacagccgaaaagacgaaaaacaacacaacaacaagacggggcaagaaagcaagaagaagacacacgggaaaagtaaaacctaacacacaaagccgcacggaccccccagcgcaagcgcaagagcacagtggaagagagaaacaaaacacag

SEQ ID NO: 530159 - DNA, 449 bp, Homo sapiens
ttttccacagtacagaagcaggcagactgtgagccagttctgaggcccagtgagttgttacaaagagaacagggactagccactttgccgtgtactcagagaagaccagagacagatgcttcaagtgcagcaaaagaaatttcagtcaaactgaagcaagaactcaccaagaatagcaggagacgcaagacacgaaaatggtttacaaagtgaagctgtgggatcccaaaccctgcctgtctttaagaacaaaggcagcactcacatgtccaaacggcctttgggcaaagctaactctaatccaaacgaggcccttgatctttgatctaaagcactgcaagctggtgctggacacaggagcacgcgatccctttttcaacattactaagcaggttgtgccagtcctggctgggcactgagtagacaatggtgaactggacaaactccag

SEQ ID NO: 530160 - DNA, 264 bp, Homo sapiens
ttgcctatataatgttgtttttgttgttgtaggtctcccattgagaaacatggccctgtttttcctgccctctacccccctattgctgggcttctgttgtccaagttggccccccctggctgggactgggctgccattaaccatgcccgttttctttgctgtcttgaagccttttcctagtagctccagggaacgcatgtggatcctaaacagccccttatatataattaagtgaccgagtaaataaattcaaaattaaactta

SEQ ID NO: 530161 - DNA, 103 bp, Homo sapiens
gcggtggccttacgtatcgcctagtgtcactactaaacgtacggcatccagcaggagttcgtcagaactctagcagcccttcctcaagaatgccccacgtccg

SEQ ID NO: 530162 - DNA, 206 bp, Homo sapiens
  misc_feature (31)..(31): n is a, c, g, or t
  misc_feature (95)..(95): n is a, c, g, or t
  misc_feature (110)..(110): n is a, c, g, or t
  misc_feature (155)..(155): n is a, c, g, or t
  misc_feature (161)..(161): n is a, c, g, or t
cagaccagacgggcagttgctgctgcgagangctgcccgcaccctggagaaggtgggcgaccggcgctcctgcaacgactgccagcagatgattnttaagctgggtggtngcactgcattgccgcctcctgaccaccaggctcagcccacccgtncaactntctctcgatttctctctctccccctcagcatcttcccgctgagag

SEQ ID NO: 530163 - DNA, 175 bp, Homo sapiens
gatcagttcacatccaaactacacagagtcaagattcaaacagttgctgccaaacaaggtgaatccgacccagatgaggaaagaaacaaggcagaaagttgtcgtacgtcaggttatcattagatagaagcttctatagtgcgcttattaaatctagatagacggtgcaggacat

SEQ ID NO: 530164 - DNA, 207 bp, Homo sapiens
  misc_feature (135)..(136): n is a, c, g, or t
  misc_feature (168)..(168): n is a, c, g, or t
gagctcacagagcactgcgtcagttagagatcagacgtgcagcaggagcgctgctgcggagaccagccctgcgcaagcttctctctgaaaggacagcctgctacagcggagcgctcatcgagcaggagaaggccnnagctgagcagctcttccaggacgagctggccnaggcacagcagctgcgtgaggagcagcagcggcagcagc

SEQ ID NO: 530165 - DNA, 103 bp, Homo sapiens
acaagaggctgtagaggatcgtcaacaacatctagagatgaactgaagggccaacctggacatgcatatctgggaacaatgaaaacactgaaagatgtctaaa

SEQ ID NO: 530166 - DNA, 149 bp, Homo sapiens
cgagctcggtccttgattcacgcaggatccattctctgtgtcagcagacaggcttaagctaatgtatgcctctattctgtaaagttctgtacataggttctcacagcttctgcagtggtggtgatttttagctcttgtccggggttgtg

SEQ ID NO: 530167 - DNA, 205 bp, Homo sapiens
taagatttagtttatgccattgcaggattcacagatagcaaggaatacacacatacttacatgtgcacacatgcacacacacagcacagtgtaatactgcattactataggtgattacagattgaggcatacagggaccatggatggcaacacataggaggaggtggcctacagtgcctggtagctagggaaggtgcctggagga

SEQ ID NO: 530168 - DNA, 139 bp, Homo sapiens
  misc_feature (75)..(75): n is a, c, g, or t
gtctaaggtccatcaggcgaagatgtgggactcttgatgcattgttctgcactaaaattatcactgtgtcactgngcaccttctgagtacagactaaattgttatttggatagaaaactctccacagtctatggcttat

SEQ ID NO: 530169 - DNA, 631 bp, Homo sapiens
gttccagaatatcttgaacatatagtctgagcatgatgcgcacgtgacagcagaaactgtgactggcaattgtaaaagcaagcggaagaactttgtggattaacaccttaggactttacgatagccgtgtaatggatacaaactgatgtatatacagacagctattataagctcacatctatgagtaagaagtctactgtatactgaggctcaagctagtgaagtggcacatcacttattgggaagtcaagaatggtacgttcctccagattttagataaatatagtgctgtgtagcagaagccatagctgtgagaccatagaaccgtttgagagtcactatatcacctgaacgacaggcacagaggttaatcatggtacatattctggaggatcgtgactggatgtgcagcaggcctaggagagagaagtctgtacagagtttgtgggaggcaaggatcacatgactgagtgaggatatacctgtgcagagctgagaagagaatacacttatgacaatgtgacgatatcaagtgcctcatgctatagtctatgaccacacatggtcacagtgtagtctgagatagggagctccaaggtgaatgtgtatcacgcgagaccacagttgatat

SEQ ID NO: 530170 - DNA, 431 bp, Homo sapiens
agcttgaaggcagtgaaaaagtaaatggaagaaagctctctgccctccacttgcctaaatgcaggatatagatttagaaggataaaaggggtctgctccctctttcgaccagggaaaagttaaccactgaagacaactttagactcttatgggcctggagctggaaccagaggaatggacatgaaggtgctttactaactctatttatctgccagttacttacctttctacaagttctccctttagacactcaaagttcttttcctttgtcctgtcgcttccctaaaacttggcttttctttgttgaagatgctatacaagctggaattcaaagctaccactttgagaactactcaattcctgcgtgtctcccaggcagatgtgaaatacacatgttaataaacttccactggtttttcaaaaaaaaaaaa

SEQ ID NO: 530171 - DNA, 110 bp, Homo sapiens
gttgtgtgaagcagccatgggcatctggtggggatgggacatctggccagagagcaggtgaggagcacccaagggcagagggagaactctggtcagagcaggaggaggcg

SEQ ID NO: 530172 - DNA, 506 bp, Homo sapiens
tcacgctttatttcataccgggaaatgaaatgagaagcgtgaggaagtataaacgttgaggaagtataaagcgtgagagagtataaagcttgtgcgaagtataaagcgttgaggaagtataaagcgttgagggagtataaagcgttgaggaagtataaagcgttgaggaagtataacgcgttgagagagtatatacgcgttgaggaagtctaacgcgttgagaaacgtataaaagcgttgagggagtataacagctttgtgcgaagtatcaagcgttgaggaacgtctaccacgttgaggaagtctacagcgttgacggaagtatacagcgttgagagagtataaagctttgtgcgaagtactaaagcgttgaggcagtataaaagcgttgagaaagtataaaagcgttgagggagtataaagctttgtgcgaagtataaagcgttgcggaagtataaaacgttgcggcagtatccagcgttgagacagactaagcgttgagggcg

SEQ ID NO: 530173 - DNA, 159 bp, Homo sapiens
cctctccgtctacactccggccccggggctctgagtccatatatactgaccctctccatctacactccagccctctccttctccagtcccggcccctgcgaatcccagtgtatatatactgcacacctccgagtgtatatacactgggagtcgcacggg

SEQ ID NO: 530174 - DNA, 584 bp, Homo sapiens
  misc_feature (584)..(584): n is a, c, g, or t
gttgttttttttttctttgtttgtatatttaatacagacagggtgttttttcgtgtccgcaaagaaggactcaataccaatgaactgacctcgtgacccgcccaccttgggctcccaaaacgcggtgattacagccttgacctccggttcccggccttttgaatcaattaattaatttgggaaacgaagccttgttttggccctccggccaaaaattggaattttaagaggggagggttttcaacaccgtggccccgctgggcttggacccccggtctcaaaagaaacaactgtctttgggcctaaaagaggtgtgaatacaagcgtgagacactggcacccgcgccaaaatcttcagttggggataaaaaagctttacactgtgttgggataataatgtgtggggacataatatttcaaagggcataatatttttttaggggacaacacaaaaaacaagtttttccctgctggaaagagcccccggagatttagagaggagaaacccttttagacaaagccttccccgggaaaagaaccctctttctgcgggggtggcgcttttccccccgggggcgcggccn

SEQ ID NO: 530175 - DNA, 183 bp, Homo sapiens
ttggtgcccgtcggtccgcgagccaagagcccgtctctgcaagattctatttatttatttatcgtggtggggctcactctgtctgccccgctaggtgtgtggctccatctctattgtttgatttattgccagtatggcccggagtgctccgttcgcctattgctatgcatgctaggtctatgt

SEQ ID NO: 530176 - DNA, 212 bp, Homo sapiens
  misc_feature (187)..(187): n is a, c, g, or t
ctgcattatagcagcctcgtaggctccagcctgggtacaagggagaccctgtactgggaaggggagggaaacaaacttttttccctaagtgctttactctttatatcacaagaagttgtgtgtcacagattttttgggtccctagaggttacacagtgacagcacacttatgtctctgccaacagangaagataagaattgggtaccggagc

SEQ ID NO: 530177 - DNA, 713 bp, Homo sapiens
  misc_feature (28)..(28): n is a, c, g, or t
  misc_feature (68)..(68): n is a, c, g, or t
  misc_feature (83)..(83): n is a, c, g, or t
  misc_feature (87)..(87): n is a, c, g, or t
  misc_feature (98)..(98): n is a, c, g, or t
  misc_feature (131)..(131): n is a, c, g, or t
  misc_feature (158)..(158): n is a, c, g, or t
  misc_feature (171)..(171): n is a, c, g, or t
  misc_feature (176)..(176): n is a, c, g, or t
  misc_feature (184)..(184): n is a, c, g, or t
  misc_feature (186)..(186): n is a, c, g, or t
  misc_feature (246)..(246): n is a, c, g, or t
  misc_feature (256)..(256): n is a, c, g, or t
  misc_feature (284)..(284): n is a, c, g, or t
  misc_feature (318)..(319): n is a, c, g, or t
  misc_feature (324)..(324): n is a, c, g, or t
  misc_feature (348)..(348): n is a, c, g, or t
  misc_feature (352)..(352): n is a, c, g, or t
  misc_feature (371)..(371): n is a, c, g, or t
  misc_feature (375)..(375): n is a, c, g, or t
  misc_feature (393)..(395): n is a, c, g, or t
  misc_feature (424)..(425): n is a, c, g, or t
  misc_feature (428)..(428): n is a, c, g, or t
  misc_feature (440)..(440): n is a, c, g, or t
  misc_feature (444)..(444): n is a, c, g, or t
  misc_feature (446)..(446): n is a, c, g, or t
  misc_feature (452)..(452): n is a, c, g, or t
  misc_feature (458)..(458): n is a, c, g, or t
  misc_feature (478)..(478): n is a, c, g, or t
  misc_feature (497)..(498): n is a, c, g, or t
  misc_feature (506)..(506): n is a, c, g, or t
  misc_feature (509)..(509): n is a, c, g, or t
  misc_feature (529)..(529): n is a, c, g, or t
  misc_feature (564)..(564): n is a, c, g, or t
  misc_feature (579)..(579): n is a, c, g, or t
  misc_feature (589)..(589): n is a, c, g, or t
  misc_feature (601)..(601): n is a, c, g, or t
  misc_feature (629)..(629): n is a, c, g, or t
  misc_feature (635)..(635): n is a, c, g, or t
  misc_feature (640)..(640): n is a, c, g, or t
  misc_feature (647)..(647): n is a, c, g, or t
  misc_feature (651)..(651): n is a, c, g, or t
  misc_feature (653)..(653): n is a, c, g, or t
  misc_feature (713)..(713): n is a, c, g, or t
aaaggacgaaaaatcattcatacatccnaccagcgagaggctgtactttctttcatccttcacaagtnatgtccatatatgtnatanacaaatgtacnttttacctttcaaaaatatgatattcacatatnacttagcctttttccattttatatctnaccaagaacctcnttttnacaaatgngnaaagttcttttattaaaagacagagacttggagattggttcaaaatacaataaacaatgngatgcagatnacaagagatacatctaaaaccattaatngcaacaggttataagtaggaatatggacaaaggnntatcnggaaatgctaataaaaagcaagcnatanggtattgttaatatcaganaaanatcaaggtaaactacatnnnataggggggaggagggtttcgattaaccnnccnacgcatcactanaagntngtttcngactcnccttatctcatctatttcanccacttctctaaacatatnntcattgcntanatgcctgtggtgtatatctnctttaaacgcctggagagaaagaatcagcctttcnctaaaagtgcctttngctttggccnccgcctctagcntcccctccgcggctggcttttcctcagnctttgnctctncctcatncttntnttcactctcattttctttttttccttccatttttttacattatttcatcttttatcttcn

SEQ ID NO: 530178 - DNA, 118 bp, Homo sapiens
gcggccgcctactactactactgctcgaattcaagcttctaacgatgtacggggacatgcccaattttcattctcactttatatgtgtaaataataaaatattcaactttccaaaaaa

SEQ ID NO: 530179 - DNA, 322 bp, Homo sapiens
gactttccaccccggtattgtcctttgtcccatggtccccggtcacctctcaccccttggtgtgcaagcccattttctcccatgcttctaagtgatagctacgggctatggactactgcatcctattggtagcagcttatgcgggtgcggccaaaaaaacagcttcaggacaaattgtccaaacttaacaaggtgggattaaattatcaactctgacacttacaattctacacaaacatgttaaaaatcaagcaaagatcccaggatggaacctatataatcatcccatgtgtgaaaggaacgacccgggccccgcgcctca

SEQ ID NO: 530180 - DNA, 153 bp, Homo sapiens
catccgccgtcgcctggactggccgctcgtttgacaatcaacctgatcgaccagcccaactacaacaccgcgctgttcgataccgccggcacgcccgacggcaacctgctgctgtcgatcaacaatccgttcctgaacccacgtggcgtctgt

SEQ ID NO: 530181 - DNA, 360 bp, Homo sapiens
taaaaggaaaaaaaaaagggttttttcccccattttttcccaaaaggtcaaaaaaaagcccggttaaaaaatttaaaaaacctaacatatttttaaagggtttaaagggccccaaaaaaggggggaaaaaaaaaaagaaaaaaaaagggattttttttaatttgaaaaaaaaaaaaattggccaaaccccaccctaaaaaagggggggctaatttttttaaaaaaacccttcaaaaaaaaaaattttaaaaacggggcagggggggtttttttccaaaattttttttggtcccaaaattaaaaaccagggcttggtaacaaaaaagggaaaaaaaaaaagtttttaaaaccgatcaattt

SEQ ID NO: 530182 - DNA, 102 bp, Homo sapiens
tctgaggttcccgacggctatcggatctgcccctacgtccagccgtcaactcccgccagctcactgtccagcctgcgatcccacacgggggacgcccccttc

SEQ ID NO: 530183 - DNA, 685 bp, Homo sapiens
  misc_feature (95)..(95): n is a, c, g, or t
  misc_feature (97)..(98): n is a, c, g, or t
  misc_feature (103)..(103): n is a, c, g, or t
  misc_feature (113)..(114): n is a, c, g, or t
  misc_feature (156)..(156): n is a, c, g, or t
  misc_feature (164)..(165): n is a, c, g, or t
  misc_feature (167)..(167): n is a, c, g, or t
  misc_feature (172)..(172): n is a, c, g, or t
  misc_feature (209)..(209): n is a, c, g, or t
  misc_feature (216)..(216): n is a, c, g, or t
  misc_feature (224)..(224): n is a, c, g, or t
  misc_feature (228)..(230): n is a, c, g, or t
  misc_feature (232)..(232): n is a, c, g, or t
  misc_feature (234)..(234): n is a, c, g, or t
  misc_feature (237)..(240): n is a, c, g, or t
  misc_feature (251)..(251): n is a, c, g, or t
  misc_feature (268)..(268): n is a, c, g, or t
  misc_feature (272)..(272): n is a, c, g, or t
  misc_feature (274)..(274): n is a, c, g, or t
  misc_feature (290)..(290): n is a, c, g, or t
  misc_feature (294)..(294): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (334)..(334): n is a, c, g, or t
  misc_feature (340)..(340): n is a, c, g, or t
  misc_feature (358)..(358): n is a, c, g, or t
  misc_feature (375)..(375): n is a, c, g, or t
  misc_feature (403)..(403): n is a, c, g, or t
  misc_feature (423)..(423): n is a, c, g, or t
  misc_feature (468)..(468): n is a, c, g, or t
  misc_feature (668)..(668): n is a, c, g, or t
cttcgttttcccagcctaggacggctgtgaagaaatcactaaaagggtttggaggtttctgaatacctgaagaacaaagcttattcagatctgtntnnctcgntgggtcttgnnaggtcccctgtcctctgggtgggagcttatggggtggtgggncagaaggnntnaaggnaattcactcctagatcgcagtggctggctgcttggcnaggacantgatgccnccannnananttnnnnttggtgaccanggacatgtcccagatgnacananaagcccctctctgccncccngggattttttagactttnacnttngatttccctaggatgnaagagnataggtgggagataaggnaagtggggtgagagganaaaggaaatgttggcatgggcctgtgtnatgtccctgaggcagaaganccggggactgatgggttcaggtgggagctgctgggtgaggcaggnaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttccgcttttgtanaactgaggtttcaataa

SEQ ID NO: 530184 - DNA, 112 bp, Homo sapiens
actttgataatatctttactaaggagctcctgaagggctgccctggccagggagcctcgaatcttcagtctctcagagcacacatggttgggatgagcaccaggtggggatg

SEQ ID NO: 530185 - DNA, 697 bp, Homo sapiens
  misc_feature (95)..(95): n is a, c, g, or t
  misc_feature (97)..(98): n is a, c, g, or t
  misc_feature (103)..(103): n is a, c, g, or t
  misc_feature (113)..(114): n is a, c, g, or t
  misc_feature (156)..(156): n is a, c, g, or t
  misc_feature (164)..(165): n is a, c, g, or t
  misc_feature (167)..(167): n is a, c, g, or t
  misc_feature (172)..(172): n is a, c, g, or t
  misc_feature (209)..(209): n is a, c, g, or t
  misc_feature (216)..(216): n is a, c, g, or t
  misc_feature (224)..(224): n is a, c, g, or t
  misc_feature (228)..(230): n is a, c, g, or t
  misc_feature (232)..(232): n is a, c, g, or t
  misc_feature (234)..(234): n is a, c, g, or t
  misc_feature (237)..(240): n is a, c, g, or t
  misc_feature (251)..(251): n is a, c, g, or t
  misc_feature (268)..(268): n is a, c, g, or t
  misc_feature (272)..(272): n is a, c, g, or t
  misc_feature (274)..(274): n is a, c, g, or t
  misc_feature (290)..(290): n is a, c, g, or t
  misc_feature (294)..(294): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (334)..(334): n is a, c, g, or t
  misc_feature (340)..(340): n is a, c, g, or t
  misc_feature (358)..(358): n is a, c, g, or t
  misc_feature (375)..(375): n is a, c, g, or t
  misc_feature (403)..(403): n is a, c, g, or t
  misc_feature (423)..(423): n is a, c, g, or t
  misc_feature (468)..(468): n is a, c, g, or t
  misc_feature (655)..(655): n is a, c, g, or t
  misc_feature (660)..(660): n is a, c, g, or t
cttcgttttcccagcctaggacggctgtgaagaaatcactaaaagggtttggaggtttctgaatacctgaagaacaaagcttattcagatctgtntnnctcgntgggtcttgnnaggtcccctgtcctctgggtgggagcttatggggtggtgggncagaaggnntnaaggnaattcactcctagatcgcagtggctggctgcttggcnaggacantgatgccnccannnananttnnnnttggtgaccanggacatgtcccagatgnacananaagcccctctctgccncccngggattttttagactttnacnttngatttccctaggatgnaagagnataggtgggagataaggnaagtggggtgagagganaaaggaaatgttggcatgggcctgtgtnatgtccctgaggcagaaganccggggactgatgggttcaggtgggagctgctgggtgaggcaggnaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtaanggctnccgaggtaaggctccggggatcctcaagtcagccaga

SEQ ID NO: 530186 - DNA, 113 bp, Homo sapiens
tagaggatccgacaacatagatgtgtgacccatatatgatttctttaaggatggtttagaaatggcaaaatgttcacacatgtggcattattttggactcctatcaacctgtc

SEQ ID NO: 530187 - DNA, 296 bp, Homo sapiens
  misc_feature (10)..(10): n is a, c, g, or t
  misc_feature (97)..(97): n is a, c, g, or t
acctgtacancgtgtctctatataatgcgtaggggtgagttaatgtcctttgaagtatactgaggaggggacgggcgagtgtcgcgctcaggtcctntgcactaagcactctactctcaggtttactgctaaatccaccttcgacccttaagtttcataagggctatcgtagttttctggggtagaaaatgtagcccatttcttgccacctcatgggctacaccttgacctaacgtctttacgtgggtacttgcgcttactttgtagccttcatcagggttggacacgaatgttca

SEQ ID NO: 530188 - DNA, 320 bp, Homo sapiens
ttacaccccacgatcacattagcattaggtttggtttaaatactaaaaagcaaatttataagactggtgattgagttataattttaacataagcccagaaaaccacagaggacaggccgggcacggtggctcatgcctgcaatctcagcactttgggaggccaaggtgggcggatcacgaggtcaggagatggagaccatcctggctaacactgtgaaacccatctctactaaaaatacaaaaaattagctgagcctggtggtgggcgcctgtagtcccagctactcaggaggctgaggcaggagaatggcgtgaacccg

SEQ ID NO: 530189 - DNA, 126 bp, Homo sapiens
  misc_feature (6)..(6): n is a, c, g, or t
  misc_feature (117)..(117): n is a, c, g, or t
gatatntcgtggggggacgggaagatggcggcgcggagagcgttcggggctgtgtgccggcgcctctggcagggattggggaatttttcggtaaacacttctaaggcgcaatacagnccaaaaatg

SEQ ID NO: 530190 - DNA, 1664 bp, Homo sapiens
ctcttttgttttagtggacgaaataatagactgctctgttcatgctgcttaacgtgttatagcaaaacaaaatacacactactggcttaacgtctaactgaactagctctcttctgcttttatcacgaactggcaacagacagcacagtacctttgctacgaagcattgcaccttccctacagcctaccttacagacaacctctgcaccaacgtaacgaacaacaacacttgctacgaaacccaatatctgcgcaacacacaacactgcacacacttctacggcttagttctcccaaacgctttctccaaaacgcacaaacctgccttcaaaccaattctcttaacttctcccacttttccaacttacacacgcaaacccaaaagaccccgaactaagccttgctatctctctaacttttaacgttctttccaactccttggaacaaaccgactttccccactatgctctcctctaaacttccctcgcaacgacccccttgtgacccaaagcaaaaccttcgtctccgaacttattctggacggaaaggctttctctcggaaccatcgccccccggccttcctataatcggggaatagtcggcccaccttatattgcccaaatttcatactcctctcggggcaatgccaacaacccttactaaacacctctcttcaacacacccgggccttggacaagcgcaaactctcctggtcgtgcccaacaatctccttcgggccacccacaaccttggtcccaaacgcaggcatttggcccccaacggcctcttgactcacctctcgtataggcttttcaacacactttggtctctcaacgtctgggccccgtttggccttacggcgcgttctccactcaaccagcggggcctataccaaccttcaccacgggcacacacacacctcttcaccttcctcaaaaagccgtttaaacaccctcccttggcgggccccatgccttctgacgggaaacagttatacacttcgcgggcctccaacaacctttcttaccacatcctctcttataccccccccgtttggctaacaccgctttttacccccccgtttgtcccccattaatggaaaccttcactccatcccggcacttatcgttttctccccatttaaacgggaattaaagcagcatttcccacaaacactgtgcccttcaacattataccacacttccccacagcggtcttggtcacaaaccactcttttggcccccagccacctacccaccagcgtttcaacttttattccccccccctgaacgagtctctcaaacctcccccccttatctcttggacaagcccccccacagggagctctccacatctcactatcacaatcactcactgatcactcagcaggcaaacacacacaatcttcccccttatttaaactcctgttttgtgccccctttcagtaggtacctctctaaccaccctattctggggcacacaacaactttccccccccccgggactttgtgcacacactatactgcgacatttccaacattatcaacccccacacttcccctatccccctgtggacggcgctttgacctttcaccggagcccaaaacaaacccacacctatcatccggggaaactattcataccacaatgcgcgacaaacgcgc

SEQ ID NO: 530191 - DNA, 99 bp, Homo sapiens
  misc_feature (91)..(91): n is a, c, g, or t
aggaccggagcccgtcagcatctcaaacatcaacaccccataggaccaccagtccgcactatgggagtggccctggcggttgacgacctcnaggggcca

SEQ ID NO: 530192 - DNA, 410 bp, Homo sapiens
cctttcatctccgcattacatatcagtattactctttaacataactagattaaatgctctacttcaaagatacagattcgtggaataaatttaaaaagcagatccaactatattctgcttatgagacatttgccttactcataaagacactgtacagactgaaggtaaaggggtacaaaaacatattccatgcacccaaaaatcaaacgcaagcagaaatagctatacttatatcagacaaaacagactttacatcaacagtagtaaaaaaaaggaagtctttatgtaataatacagcaaccaatgcaccaagaaaatatcacaatcctaaatatatatggacccaccactgcagcacccagattcataaaacaagtattgctaaacctaagagaaaaatatagatagca

SEQ ID NO: 530193 - DNA, 420 bp, Homo sapiens
  misc_feature (24)..(24): n is a, c, g, or t
atagaggtggatgttctcccatgnaattccctgaagacataacgcagtgacgaacgagccctgtgaacaacagaccaaaacaacacctccatacaacgttacacgaaggggcacatcctaacacctagttctttcctaatatacctatcactttgtctagggcaattctatagttttccacctataggaaatttgtatcagctcctggtcttgtggctctcctttctgagaagacttgctctatgcattccttgtatccctagttagacggcctaattcctcacctggcacatacacttgtatccatggaaaccatcagcacaaacacactgcaaaagacctggaccatcaggtacacaagatccattctcaggacacatttctggaggccagagagaaatagagaacatcagtttatcc

SEQ ID NO: 530194 - DNA, 106 bp, Homo sapiens
ggagtatgtagtttcggtcgtggagtcttgtgacagtgctgagtgggagacgtagaataggttgtctcagtgtgtataggtcgggctattggaggatcctactaga

SEQ ID NO: 530195 - DNA, 206 bp, Homo sapiens
ttgcatgtctgatctagaggatcccatcccagatactacgggagctgaggaggagaatcgcttgaacccaggaggcggagattgtggtgagccgagattgcgccattgcactccagcctgggcaacaagagcgaaactccgtctaaaaaaaaagaaaaggaaaaacatttgcacttcaattctccttcaagttaaaatgagttaaa

SEQ ID NO: 530196 - DNA, 129 bp, Homo sapiens
gctgattacgggcattggacatctgcactgacttgtgtacatctccgagacttgcctctaacctttacctacggttaatcaacgctatctcctcccaaaggcaatatcttcccaaggctatctcttccg

SEQ ID NO: 530197 - DNA, 1300 bp, Homo sapiens
caccatgcctggaaagtcctcagtatgcagagcaaccggctgaccaagatcgatggtgtctgcagtatacctgtgtgaagcctcgcggtgagacttgtacgcttagtccacaatgtgcattcggacggttctagtctgatggtgcctggcaggaggcaataagcaacactcgaacgactgttgggacaattgtcgatcaaagagtaggaaatcaagaatagtattgaacagagtatccacgtccatcgtaatcgacgcaggcgtgtcctggagattactggagtagaaccgatgaatgtccattgatgatgctggacgcgaggctctatcgatctgtgaaagggagccgaggacgccgtggaggacatgtgtagcctggtagctggaatcgcccttgcgagacaggacccctctagtaccggcggatagggtcgatgcgtcgcctctccccgtctcgtgtcgggcatgattcgtagtgccgacggttcgtcgagggttcgtgagatccttgcttggcgtcctcatgctggtccctgtcgtccgtcggcagagaagtgtgcagccacgggtttttaacccgacctggtatgctcctgaggtcggtcactgtatcaacagtcactaaaaccaatggcaattaaggcactgacgatagcctggcggcgcgcgacgccgacataccattttcacgatgccgaagcaagttaaatctttgccacacgtgtcaacatttgttgccaatctctggttgaaagggggacgagcatgaaaggatcccaggggggggcctgacttgtgtctattgccatgggtatgttggcccgaagggggtgccaaaggcgaggggacacaaaaaggcagagaaggggcgccgcatggtacacaacggccaacgctgtggcgaaactggaagcctggggccgttgggagacgagacctttctcccaggcgggggagaagtgtgggggaacaccctcgagcaatttaaccgttggggaaaacaacgactgaggggcatatggtgggggagccccccagagacaacttgtcggggcgaacgaaggtatttgtcccccggacgtattttttagagtcagacacgccgcacgagaaggaacaatgacaaaagacaacgatgagtacagggacaaaagagctagcgagtatactcaccctaccaacagagagagcgatgcagagcaacaacgccagaactcatgcagaagacgacatcgaagataaagaacaagaacgagcgaacagcacacgagcaagacgaataacacggctgccagaagca

SEQ ID NO: 530198 - DNA, 225 bp, Homo sapiens
gtctgcctgcgctgtttcacgaggctgctgctgtccaatacgcaccgttatccaggcttcttgaccatgctatgctccaagctcatcgcgcgcaccatttggccattgacagctaccaggagtttgccgaaacctatagtccaaaggaccagaagtattcattcctgcatgattcccaaaactccttctgctactcagactctattccgcaaacctccaaaatgg

SEQ ID NO: 530199 - DNA, 238 bp, Homo sapiens
tccggaggtccaaattaaaaaccatttaacatttaaacatattagtcccgggagctttacttggggtacatccacacgaaaaaccaattatttattaaatttccctttcttagcaaaagccccaaaattggcaggccccccccaaactgttccaaaaagatctctttcgttctgaaaggcttcccccaaaaaaagccctcggccggaacaaaaagattttttcaaagcccaaattact

SEQ ID NO: 530200 - DNA, 507 bp, Homo sapiens
  misc_feature (1)..(1): n is a, c, g, or t
  misc_feature (17)..(17): n is a, c, g, or t
  misc_feature (99)..(99): n is a, c, g, or t
  misc_feature (128)..(128): n is a, c, g, or t
  misc_feature (134)..(134): n is a, c, g, or t
  misc_feature (163)..(163): n is a, c, g, or t
  misc_feature (181)..(181): n is a, c, g, or t
  misc_feature (194)..(194): n is a, c, g, or t
  misc_feature (208)..(208): n is a, c, g, or t
  misc_feature (234)..(234): n is a, c, g, or t
ngggctgatgaagcccngcctctggaggaagatgatctgttggtggcatgccactggcctctttagtttgcttttgtttgtcctgggaaagtgggcatntgcccccattggaccttggatctgcattncccacnggggaaccccttgctttagggggcccccntacccatgagggtcccanggatgaccacccngcgttagccccccngcaagtactcacacacacttcctccngagccagatcatttagtttaagggaagggctcatccactttcagagatgggtgttttagtgattagacatgcgacttctctggtagagggcatttattttttaaaaaagagaaagggtaatgaatcggacactatctgtcaaattctttgctaggagtggaaacctaagttttcccaagtccgtatttccctgagaagaaattgattttggtatgatccataaagccttgtacagtgaaataaactattggcagaaaagagacaaacacatat

SEQ ID NO: 530201 - DNA, 143 bp, Homo sapiens
gcgggacaggctgtgtgaacacgcctgatagaattcttccatgtcgcaaggcgtggtgaatacgggcgtggatgcattcattctgtccactccttcttaatcgagcaggttctactcccagctgaggtggtcttgcttgtcat

SEQ ID NO: 530202 - DNA, 261 bp, Homo sapiens
atctagagatcccgaagctgcacgaatcccgtcatacaggagagaagcctacaagtgcccctctgcccttatgcctgtggaatctgggcaacctcgaagcgtcatggtcgcatccacccatgtgacaaaccttctcggtgtagcctttggaactacagctgcaaccagagcatgaacctcaaaggtcacatgctgcggcacaacaggcgagaagcccttccgctgtgccaccttgggcctataccagggggcactgggaca

SEQ ID NO: 530203 - DNA, 521 bp, Homo sapiens
  misc_feature (371)..(371): n is a, c, g, or t
  misc_feature (501)..(501): n is a, c, g, or t
cgatcatggaagttactcacagaatagatcattcatatattccttgaaacacacaggacagtggatgccactgagactatgccgcaatatagtaagcagtgagcactctactcagaaaccttatgcagatctgatatttcaaattgcccacgtcactcacttcatcttagtaccataagtgggatgatttttgactttattaccgaatcaaatttcaatgaaagtgtgagctaggagaaatttgcctggtttaatattgttatcgcttggacagagctttaaccatggaggtaggtccctcctacatgcctctcgctatgatgcgcacaaacgtgaatgatggacgtctttttgcgatgtcagcgaaaggnagaaactttgacgtactccggtatgcataggccctgagaaacactcgaacctctgaagagtggcgtttagtgagccaagactgagcctatgaccttcaccaaggtgacatagtcgcgatgccgcttgaanattagaagcactgatactct

SEQ ID NO: 530204 - DNA, 561 bp, Homo sapiens
  misc_feature (107)..(107): n is a, c, g, or t
  misc_feature (117)..(117): n is a, c, g, or t
  misc_feature (128)..(128): n is a, c, g, or t
tctggacaaagtgtctagtaatatgtctcagcctggtgggctgagtcctttggtcattccatactagatgatagcttctactcctattctgccccaagcagcagganctacttctanacctttattancccaagtacctagtatcccacccttggtacagcctgttgccaatgtgcctgctgtacagcagacactaattcatagtcagactcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcag

SEQ ID NO: 530205 - DNA, 644 bp, Homo sapiens
  misc_feature (190)..(190): n is a, c, g, or t
  misc_feature (200)..(200): n is a, c, g, or t
  misc_feature (211)..(211): n is a, c, g, or t
atacttacctccgcccagaaggaagaggatatgtgcaaaagagaggcccttccatctgtcgcatctaccatttcctctccgtgagctgtacgcttagatctcagtttctcatccgggtgtgcctgcacccttggctcattccatcatctcatagtcttttcctctgtatacataccccaagcagcagganctacttctanacctttattancccaagtacctagtatcccacccttggtacagcctgttgccaatgtgcctgctgtacagcagacactaattcatagtcagactcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcag

SEQ ID NO: 530206 - DNA, 231 bp, Homo sapiens
attctctgaatggggtctcaagagagacggagtgtccccacccgatcctgactgctggctcatgctgctgggctgagcggcagaactgtgtgaccctgggccagtcacttgaagctttctgtcctctggcagagaaaggtggcctcctgcttgagtcacactgggactccaatggcaaaagaaaaacagggcagtctccaccctctatgatgtttctccttccactgggca

SEQ ID NO: 530207 - DNA, 292 bp, Homo sapiens
cacagcctcccccgccagccccaagttgggccaaggggcgtttgtgtatatctgcctcccctgtctgtaagaagcagcgggaacggaggttcgacccctcctcagtaaaaggtggtggggctcccgaatttgggctgtggggcccttgggccacgcttttaagaaagcccaggctcggaggaccctggaaaacagacgggtttgagactgaaattgttttaccagctcccagggtggacttcagtgtgtgtatttgtgtaaatgagtaaaacattttatttctttttaggta

SEQ ID NO: 530208 - DNA, 177 bp, Homo sapiens
cgcccgtcagctgcgtcggcgtagacttccactggacagttcttcacaattccgtgcatcatgttgtaaatatttttttgactgcctatgggctgtgatgtatatagaagtggtacattaaacataccctcatttttttcttttttttttttttttttttttttttttttttttttt

SEQ ID NO: 530209 - DNA, 440 bp, Homo sapiens
ctgagtgaaagttgggcagctttgcttgcagcccattataaaagatctgggttccttaaggtccatgttctcagcagtgacacaaactcactgcctgggcagtgtctttctggggcttcctgtttgtccctgtgggactggggatggagtgataagaaaaaccaacgtgaacctgaagcctgtgtaaatcttttgtgctatgagtatacatcttttgcctctcacctaggagtcttggtttcttctcttaggccactgaaaatatagcagtctaacttcttagcttgtgaagagagtaaaatctttgacctgctgtaattttagacaatggacccaatggatgtttttttttatttatagagaaatatttcacttcatttcctctttttacttaatagactaatatgttttcttaggagaaacttggaaagtatttaaag

SEQ ID NO: 530210 - DNA, 110 bp, Homo sapiens
gactagccgggttgtatttgagacgcggagttagtttttccgtgctgtgtaggggctaacaatggacacccagaagggacgttcaaccttcagagcagcaaccaattata

SEQ ID NO: 530211 - DNA, 198 bp, Homo sapiens
attcggcacgaggaacggtttcattcattctacaaatacatactgacagcacagtcatgaataagatgttcctgccctggtgagtcttatattttagcaaattaaaaaaactctttggacagggctgccaggtgaggttggccagtctgtacactgcacaaaggcacctgggacaagggggaacatgggggctgcaaa

SEQ ID NO: 530212 - DNA, 174 bp, Homo sapiens
cctggattggatgttaagtaaaagcttgttcagggccgggacatttacttaaatctgtttttatttttgtcatgtaaaaaaccaccgtggtcatcaaaaaggaatccaattctggacccttttttttttttttttactttgaagtctttaaataaaatgtataatcccccttta

SEQ ID NO: 530213 - DNA, 849 bp, Homo sapiens
  misc_feature (5)..(5): n is a, c, g, or t
  misc_feature (23)..(23): n is a, c, g, or t
  misc_feature (72)..(72): n is a, c, g, or t
  misc_feature (236)..(236): n is a, c, g, or t
  misc_feature (849)..(849): n is a, c, g, or t
cctangagtgacttacagctganctactagtcataacgagtttccagtgacccaaatagccaaaacagctgnggaggaaaaacaagctggaggacccacacttcctgattttgaaacttgctacaaagctatagtactcaacaaagattggtaatggcataaggatatatattaagaacagttatttcaacaaatagtgctgggacaatgggtgcccacatgcttttgtttaaagncgtccccttaccttaaaaaaataaaaaaaattttttttttggcctcaacggcggagctttacggccgttctcctttagccaggggtaatccatgatcctctctcattcactccaaagctcttggacgtattgatcccgtcaacagcatcacccttcttataggcaggcacgccggatatcactcatactcaaacgatcccccccccatcaccatgctgaccaactgcctagttaaaggccagaaacccgcttactggcctctccgccaccccctcacattcctgatccttccccccaccaccacgccgcataatacaatagtcacctatatataataaacatcgctctatccacgtcactatattacaataagttcaatcatctcactccactccactccttcattcgtcacacattcttcttatttcccacctcttcccaccattccattaacccactctctcttatatcactccacctacctcacatctactctcattcttactcttatcctcccgactctatcttacaaccatacctaaccgaatacaccgaataatatcatcacaagcgctctctccacttcacactcttattagtacgtcaacatgtn

SEQ ID NO: 530214 - DNA, 187 bp, Homo sapiens
cgtgtatgcgcggtcttatgggaacctccatgtgccatgggagcggcctagataaggcaaaaagacataaaaaaaaagaaagaaagaatgacagaaagaaagacagacagacagacagaaagaaagaaagaaagagcgagcaaggctttctctaggagacgggtgtcatttgactgagaccgctctt

SEQ ID NO: 530215 - DNA, 1292 bp, Homo sapiens
aagtacatactacaaaatatgcatccttcacaatgaatgcgcttctcacagataggttcactgacaatctgtactgctatcattcatcccagtccaacacccacatacttacctattatcctttcattctcacacacagctttcaccaacaccactaggaacacccaagccttacctatcatatgcatttgctgctcctctacccacctcttgcactgcagcatgggcaactaacctctctccctacgaatacaccttatcctctatgaaacacctaccttcacgtcgaacacctgcacacacacctacactttaccacactcttcgtacaccctactccttacactatcatcctccttttctcctacacaacacctactaacaaccagttccggtgccacttcctaccacctctcaggcacgcattgccccaaccttgacacttaaccacttacacctattaacagcccacccaaaaacaattaaccccttaggccacaatcttccggcgcacactatctcggacatctctcaactaacgttacaccaaacgacctacccattcccacctaacttgccaacaaacgccccttacataattataacaccacacacaacactttctccactatccggaccccacgtccccccacccacgcccccataattaaccaaccacaaacgacactacacaacaatggttcccacttggcccctaacaattccttggcacaaccctaattctactcctaccaaaataccccgttaattatttacctaggcgtccggctacccaccctatagcacttactcacggacagccatggcactagtccgctccccatgggcacaccctttaccctggccgcaccccttccccgcgcccacggctatcaccataaatatggggcacgcctactctcgcagactttcacaccacccatctactggtcaaacacacgcccttggcaacccgttcaagccaccaagccctacaaagtgtacgaccagcccaatactgaagcccaacccggctatggccgaggactaataataaaagcgctacactgaactaccaaccccgaagcgacccaatctcacggaccatgcctgtctcagcacgacatttctaggctcatccaactgggcacccgggacattatatccacattcaccagagcaactggcccacaccacttcccgcccgctgtgtcccttgcaccacacacaagaaatcatattcacttgtaagacaacaacgccccacgcacaacaaataccccccggtaaca

SEQ ID NO: 530216 - DNA, 734 bp, Homo sapiens
accgtgccaggcagacaggtctcgagtagcttgccacattgtggaacggacacccgggagcagactgcagtgaggggataatgaaagtgcagtccgggggctttttaaaaaaaaggttggagccgcgacgtgtgacatactggataagtaagggaccagtaataaggttctgtacatactcccgagacccagatagagaaaggtgctatcgttccacgtccaaacctgtgttcctagtattaaggactttgatatagccaccggccaaattattggtgacatggatgttaccgctccaaagatttatacaagattttaacctagttttctcccctattatcccctgctaatgtggatgtatgttccgaacaccctttagtattgatagcttacatatggcccaaggaataccgtttatagccaaacctgggtatgctgtagctaactttataaaagtgtatatgaaccatgtgagaaaattatatatctgggaggattttttggttgcctaaagtggctatagttactgattttttattatgtaagcccaacccataaaaatttaagtttttttaaccactaccctatttttcgctgtacagacactattccttaaatactaattgattgtttaaaaggaatataaatgtgaccagtggaccttatttatgttaatataccattatccaggccagtatgaagttattccatttaaatgccccctttctggtcca

SEQ ID NO: 530217 - DNA, 477 bp, Homo sapiens
  misc_feature (1)..(1): n is a, c, g, or t
  misc_feature (160)..(160): n is a, c, g, or t
  misc_feature (169)..(169): n is a, c, g, or t
  misc_feature (171)..(171): n is a, c, g, or t
  misc_feature (215)..(215): n is a, c, g, or t
  misc_feature (217)..(217): n is a, c, g, or t
  misc_feature (219)..(219): n is a, c, g, or t
  misc_feature (237)..(237): n is a, c, g, or t
  misc_feature (239)..(239): n is a, c, g, or t
  misc_feature (267)..(267): n is a, c, g, or t
  misc_feature (272)..(272): n is a, c, g, or t
  misc_feature (284)..(284): n is a, c, g, or t
  misc_feature (299)..(299): n is a, c, g, or t
  misc_feature (310)..(310): n is a, c, g, or t
  misc_feature (318)..(318): n is a, c, g, or t
  misc_feature (328)..(328): n is a, c, g, or t
  misc_feature (330)..(330): n is a, c, g, or t
  misc_feature (339)..(340): n is a, c, g, or t
  misc_feature (347)..(347): n is a, c, g, or t
  misc_feature (353)..(353): n is a, c, g, or t
  misc_feature (375)..(375): n is a, c, g, or t
  misc_feature (381)..(381): n is a, c, g, or t
  misc_feature (420)..(420): n is a, c, g, or t
  misc_feature (448)..(448): n is a, c, g, or t
  misc_feature (460)..(460): n is a, c, g, or t
nctttctgcagccatttacttacataccttttaaagagttactacaagatattttagaaaatttaaacagttaatacaagaaaaatatgaagtgaatagttcatgagcactaaactgaagctgttcatgacacaaagtatcttagaaaacaaatctcggntgggccagnantttgtgaggtcaaggccagcagatgacttgaggtcaggattttnanancagcctggccaacatggngnaaccacatctctactaaaaatacaaaanaattngccaggcatggnggctggtgcctgtcntcccagctacngggggggntggggcgggngnatcgcttgnncccaggnagtggnggttgccgtcaggtgagatcanaccacngcactccagcctgggcaacagagcaatattacatctcanaaacaaaaacaaaaaccctaggaattgncttcctttatgnctccagaaaacatatct

SEQ ID NO: 530218 - DNA, 202 bp, Homo sapiens
gagtcacagaatgtattaacgtcagttgatctgtgctattgggtagtgggtttgacttacggcattcatttaacttatttgagactcgaccccaaactctaaattgagattcacaaatacaatccgttgagaagcttacgcttctcaacggtacattttatatgtatagtaccaacaaaaaaaaaacataaagaaaactagt

SEQ ID NO: 530219 - DNA, 767 bp, Homo sapiens
  misc_feature (531)..(531): n is a, c, g, or t
tctggctaccgggaactaagatggaaggttttggggggtcgcggcccggatttggggcggggggtccggccccaggacattttataccgctttccgtcacattcccgatgccttcagtggaactccgggcgttcgtgcagttcatcagagaggtccctaattcagcggcgtgattcccaaatactccctatgtggtgtgccccgggcacctcagcatctcgtcgggcgtaaagtgtccgaggagcggagagtggtttgtttgctcgaagaaattgtcggggtaatccatagcgggcctccgtaggcgtcagcgaattctctcgcgcaccaaaaaaatatccttcgtgcgggcgtagtttagtgggcgggagtctcgacacagaagggtgactcactcgagtgggcggggggtgacccgtctgtggggggaaacatacacgacctgatgttctcccaaggtctatgtgtggacagccatagtttctgcggggccgaaatgtggtgacatgggtcgtgagagagagagctctntttcgggggagaaaaatggggtgccacgagctctatatagaaggtcctctaagagaagagggcttatgatttggcctagttatcccccaacggagttggggcagtggaaaaaccgcctgaagtgtgggggcgccccccataagttgttttttaccccgaatggcccagccgggggaagtggccattttccgaagaagaagtatattttgggaaactcccctctttgtggggggggg

SEQ ID NO: 530220 - DNA, 871 bp, Homo sapiens
ggtgcggccagtgcacggcctcacccggcatcgcgaccctgtgccccgccggccgagcatgtggcgcgctgcgcctcaggcgggcccctggcccgggcctgggctcctgctgctgctgctgctgctgctgctgctgctcgtggctgctggcccctgggctgcgcagtggggctgcggggcctgcgtgcggctgctggagcaagaacaagctacctgactgcacggatcaagcacctatctccgcagatgcgtccagcaagccatgttacggctgaaggaacaacgatgcgcagccgactcagcaagtatctatggccaaggctgaactgacgagactttgatgcagggaagtggactattcttcgatggacgaccacctgtggaaaagtcatggaaccagaaactctaaggcaatgtactagcgacattgaccgatctaccaaaaacatgtaaccagcaagtcacacgcgccagacactcggatagtaccagacagcaccagagcacgaagcagctcccatgcatgagtacaggcgtacagtcactccctgggcactacctgactatacttgtccacatagagcccatagggctacaaccatcatcacaacgtaccaagccaacgatggatagtaacgagaacgactaacaatacatggaactcagagacggagaacagaacctagatacaacacatagtactgacgatgtacactacatgaccacaaagatacacaacggacagaagccaggagcaaacgcgcgtgccagacgacagatgctcacgatggatagaccgtactactatcatcgaccaggagaccatggagcaatataacaggccgaagccaagaacccaagcggaacccca

SEQ ID NO: 530221 - DNA, 302 bp, Homo sapiens
gggaagacggaaactactaaagacctggacagacccctgggcaccatggtgtatgtcttcaactgctcagagcagatggactacaagtcctgtggaaacatctacaagggcctggcacagacgggagcctggggttgctttgatgagtttaaccggatctcggtggaggtcttgtatgtgattgctgtacaggtaaagtgtgtccaagatgcaattcgggccaagaaaaagaagtttaacttcctgggagagataataagccttgtccccaccgtgggcatctttatcaccatgaaccccgg

SEQ ID NO: 530222 - DNA, 129 bp, Homo sapiens
ccgcgtgttatgtctacgtctagatcggatttgttaaccactgcgccacgacgggaactccgcagctgcatcttagattcagctccctggcctggaaatttccacgtgctgtggcgcgcagcaactggg

SEQ ID NO: 530223 - DNA, 460 bp, Homo sapiens
  misc_feature (95)..(95): n is a, c, g, or t
ggattctccccatttcaaagagaagagcacagaagagggagaagtggctgctctgcgcctcacggccagatccaggaaacagtgacattcaaggnatgtggccatggactttcaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcaggtgagccagatagatgggagtcttcataaatgatagcccagcaggacaatgaagaaatacttttcagtgcttaagaaagtgcctgtgtgcccttatttttaaatttttttaaaattctaaagcatttaaaatatatacagaagtccagaaaataaaataacattcatgtatccatca

SEQ ID NO: 530224 - DNA, 822 bp, Homo sapiens
aaatgactgaccgtgcaggcgtgaaccacatcacgtgcagtgcactggttgcactgagaagctcctggcattgcgtcggatatcgcaaagttctaggcatggtgccattaccgaaatgagccgacgttttaacatccatgataaaggaaatgaggaagagatagtggaggtggagttgatggatttgaagctgaggggaagaaagagacaatcaaagatgtatgataactttgaaaaggtgtctgtaaatcttcagtgttaataaaacagatgcccatttgttggctgtttgtcattcataataagtgtctggattgaaaaatttatcaagatatgttagaaggatttcatggagatgaaccaaagttttgctatgatattaaaatgtgtacagtgtgaggtattattcgaatggaatagactcccaatacaaagaaaaggtgtttcgggctagggggaaacctggtaggtccgattttgtcccatgaatggatataaattttataggttgcatagttatctgacgcatatttgtggggtacttattatgagctaggggctggtctatatgagagtgcttcagggaaatgaattgccgggatgtgtggtctgtgtagctcgtggatttgggacatctaatgggacaaggtggggtgagaatagaacgggaagtgtaagtgacttgtgtaaaagatgggatcctcaccccttgctaggatttcaacggggcggttctgggtacggggaatgagcagtggtaactgttgttaggttgagacaaaaggatgtgccattcaggtccacggagtgggaaatgtggtg

SEQ ID NO: 530225 - DNA, 699 bp, Homo sapiens
tattgctgggcctgggcggtctttccggtggaccaagttggtttttggttggtctcccgttaaacatggggcatgatccctgtctccttggatgtctctcaagccgagaagaacccggcacccaccctccttcttctcgaagccataggttcactgcttccaaggatctggctggagcttcgcggaaaaatgctatatctttaaaccgtctttgtcttccggcgataatatactttgccagtttagcgcttaacacggtccttataagacacttgtagagattagggtcctttttcccgttcattcaccgttaggagcaaatgcctgttataggcataaccacacccctccaaccttttgggaaacaaagggaacttgtgcctttgaggacgacaaagcccttttggcctggagagttgctaaccccacagtggagcacaccacgctttgttgtccttctgcaaatagcccgagtgcaggcagaacgcagtcattctgtgtttatctgagaggagctttgggatataaatagtgttcaggccccgcctgcgctgtcattccagcccagcctcctgaattgagctgctttccgggcgggcttttttcttgttggcggtcaccatgctgtgttcaaatgggctttgtgacaggtttggatgttttttatcactgaataaaactttccactttggaacaata

SEQ ID NO: 530226 - DNA, 138 bp, Homo sapiens
gaatactttcaggagagcaagctagaccccgaaccagacgagctacctagaacagcataagagcacacccgctttttagcaaaatggtggagattttatggaagaggcgacaaacccatccgagccctgtaaatccgt

SEQ ID NO: 530227 - DNA, 715 bp, Homo sapiens
  misc_feature (214)..(214): n is a, c, g, or t
  misc_feature (223)..(223): n is a, c, g, or t
  misc_feature (232)..(232): n is a, c, g, or t
  misc_feature (240)..(240): n is a, c, g, or t
  misc_feature (284)..(284): n is a, c, g, or t
  misc_feature (288)..(288): n is a, c, g, or t
  misc_feature (293)..(293): n is a, c, g, or t
  misc_feature (301)..(301): n is a, c, g, or t
  misc_feature (377)..(377): n is a, c, g, or t
  misc_feature (385)..(385): n is a, c, g, or t
  misc_feature (427)..(427): n is a, c, g, or t
  misc_feature (431)..(431): n is a, c, g, or t
  misc_feature (455)..(455): n is a, c, g, or t
  misc_feature (460)..(460): n is a, c, g, or t
  misc_feature (468)..(469): n is a, c, g, or t
  misc_feature (474)..(475): n is a, c, g, or t
  misc_feature (497)..(497): n is a, c, g, or t
  misc_feature (501)..(501): n is a, c, g, or t
  misc_feature (552)..(552): n is a, c, g, or t
  misc_feature (595)..(595): n is a, c, g, or t
  misc_feature (639)..(639): n is a, c, g, or t
  misc_feature (649)..(649): n is a, c, g, or t
  misc_feature (675)..(675): n is a, c, g, or t
ctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctggaccccggcgccggnagggtgggngttcgcccngcgcgctnctggccttctgccgagcgccagatgcaaagatgtggggtgccangaanccggncggcttgnaagtgggaaatagagaccacaagtgtggcccaacaccaatgatccggctgctgggtgggtggctggcatggctcangccgggangggccccctgggccaggcccaattggagggcccccgcgcgtntaanttgcccccgcacgcgggaagccancgaancttcgggnnggggnngggcattgagttgcaggggatngggngggggggacaggagggggcctgggggctggggccccggaaaatatatattntgccctgcccccacacttttatataccgaataaaccgcagaangaggtgggagggggaagctttattttatagaaaatgaccaatangagggccacnggcggagggcccccccaagaagcaangattcaaaatctctttgctttcctttccttaaaaaaaaaa

SEQ ID NO: 530228 - DNA, 695 bp, Homo sapiens
gggcggtacggtccggaatgttgggataatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaaattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagtttattacaattacacatcagttttgacacagtcatagcaacattaatattttcccatgatgcagatcctttttgtaatgggctttgtctttgagatctctgtaaagaaccctgtgaactaggaaacataact

SEQ ID NO: 530229 - DNA, 622 bp, Homo sapiens
gggcggtacggtccggaatgttgggataatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaaattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttatc

SEQ ID NO: 530230 - DNA, 402 bp, Homo sapiens
cagcagggagcccttgatgcggtctaggacctgccaagtgtccacgtcgaagaagctctggtagtagccgaaggtccagaatccgggctgcggcttctcctgcaggagcgctgccttgtcgcccccctcctcctccgcctcctcctcttcctcggcgccgtagctgccgctcgagcccatggccactgccacgtgcccctggggggtcacttggtcactcttgctcgtggtggcggcatcgggggtctcggccaggagattggtggcttcctcgaactcgtggaaggccagctcgtcggccgctgccatggtcgccgggcgtcctcactgcatcccgctctgaggacggagctcccttcccggggcctgtgccccggctccaagcactgcgtagtgagctaa

SEQ ID NO: 530231 - DNA, 226 bp, Homo sapiens
ttcaccatcatccatattcagtcttcctgccctactgtcaatcacagggttgtgaaaatctaatgtgatactctagatgaagtcctttcaaaattcaagttgctgtggacaatctcttagcctctctgtggttaatggtctattctttgattcgatgcaatagtgggaaatgcataatctcacgcttattgggcctgtgaacgtattacggtactgtgctcgaatt

SEQ ID NO: 530232 - DNA, 161 bp, Homo sapiens
atatttacagattgtgtgagaactcaagcccgtctcattttgatctgtctacctccattctgaagagtggaggttatggtgtccgtggtcctctggaaatagaagatccatttgtctttgtgtagagcaagcacgttttccacctcattgtggcggaaggg

SEQ ID NO: 530233 - DNA, 192 bp, Homo sapiens
atggaggtcacgcacggtgctcacgtgtcgacggaactatgtaccgagaaggcatgcaccgacatggtgcatacacgtacaaccaggctccagtctataacgatataacggagagtcagacaaggtgctcacgtgtcgacggaacttgtccagggaggcatgcaacgcagtggtgaatacacgtcgagctgc

SEQ ID NO: 530234 - DNA, 664 bp, Homo sapiens
cactgtggggacctggagcatggctcacagcctccctcacctcctgtaagagaagctgcttgggaccaagcactccatcggctgacagcagcctctgctggtcctgggacaatgacgcatgctggccctccgatggagagggcagatgaccaccatgctgaacctggggccatgccactggatggttgcttggcttcagacgcaccttcagaacaatgtaatgtgtcatgcgtctgcccgcctcacatgcattcactatgcccttggtagcttgtggatgctactactagggagtgtccttgcctggtggcccttgcagggtgtgcatgctcatgagcccgcctgagcccccatggaacccctcactgccctctcacagcgcatctagatgcagcatcctctgcccacttgttttggtctacctcttacaatgggactttccagagacggctctcacagagagggctgcctgggaactcggaaccacaaatgggcaaactcccaagctggttggattatggggttgaccctggccgattcaccacgaggaacgggtccttcgtcctgcccaaccttccacaggtacatacccattgatcagggacaggacattggggaccgccggtcagaaaagctctgtggcacatgaccatggggccatggc

SEQ ID NO: 530235 - DNA, 188 bp, Homo sapiens
tttccgggggccgggggccccccgggccaaaaggggggcccccaggggggtgtttttttccctttccccgggggggggggggggggccccctggccctttttttgggggggcccccccccccctggggccccccgtgggggggggggccccctttttcccccgggggttttttccccccgttttccca

SEQ ID NO: 530236 - DNA, 181 bp, Homo sapiens
gcaccctgcgcaggccgtaagatgtcggcctccacgctcatgcgcagagcctgttccgtctcaacacttgtgttcggaagtcatctgcagccagacggagcgttgtcagatctgcgaggacaatcctggacgttctcaagttgtggcaccagagaatcttgtcccgcaggtcctgagatgg

SEQ ID NO: 530237 - DNA, 466 bp, Homo sapiens
ggtcactctagaggactccccaagtgtatgacactgatgaaggaaatagaattacatggtcagtgtacaccactacaaaaattgtgtcattgaggtcgatggtgactctgtaatttgtagttgagtatgtctactgattttcgaagccatatggtgagtcaatgtcattatgaaaaaagtgctacataaaacacttcttaaactttttttgttaaaaactgctccttgtggagcaggactaccccataggcagtgtgccatcacacctggctttacattttcctgtggggtcttactatattgcccaagccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgtgt

SEQ ID NO: 530238 - DNA, 353 bp, Homo sapiens
gggtggttagcgtccagctcagggagaagggggatagtgcccacccccactggtccctctcccggaggcccttggagagggccaggtccaaaaattttcttatggagctctcccacatcctcttccccaaattcgtttgcttctctcaacaacctcgtgtgcgttttccatttctatatgataccctctctatagcgctatatctctggaaatactttcccagcccggtttgtgtccaccccatcccctcttgtttttgaggaccattctccccccccaagttccaccttttatgtttagactccctccctggtctcttaatgcctttgcctggataaagagttggactctca

SEQ ID NO: 530239 - DNA, 1112 bp, Homo sapiens
tcatgtagcatgcctcactctctaggaatatgagtttctcggtcacactcgtcatatcctccctgagtatgcctagaagtgacatgatactatcgcagggcagttatgaccctgagtcgcagaagcctcccatagccaatccctcttagccgatatagctggctattgactgactagtctctggcgcagactggcagagctgtgaggtgggctctagaaccgtacctgagtcgtgcaattctccaatggcgcactatggtgctgagagctacctcacatggatgcataaaggctagcatcgcaagtgacgtagagaagcgtaagtgcgtaaccagagcaagtaaataagtgacgtagcaagagcacagtgaagtttccgaatgagggacgtagtgtgggagtcaaggagagaagcgaacgcgcagagagcataaattattcagcatcatcggcctgagtatgaagttaagccaaagtcaatcaacgagaccgtattttaggcatgttgccccactgcggggatgcctcgcggaccgtgtatgtactccccatcttatgaataagtatcctgacttcttaggcttttaccacatcttgaggagaaagcttggtgagcttatgggagtgaagagctatggaaggtagataaaaacctagtacggactgatatagtaaggtctcccgtagaaagtgttcttatgttattcacttttcggggtccctcctgaagtcaaccggactgagtatcttgtgtagggatgggcaagtttagttcccacttgtgtcctgattggccggagggttgcaactcgtcgacaggtctggatcgaagagccttctgttaccaggttctaagggcaaatgggttggttcccccaggtcaagggaagtttgtccatggcacaccgctaaggtccgaagtgtgcgtgataccatgtgtggcgcgaaattttcaggcgcgtgccccttgttgggtgtcaccacacttgagagaaacggtcggccacaagtgcagggtagggcacagagtaactgcgcacaaaggggtgaaaacactcccgcagaaacccgtagagatacaccgaggagattcagagcgactcagggcatcc

SEQ ID NO: 530240 - DNA, 120 bp, Homo sapiens
tcccaagcatgaggaaatgtgtgtaccagatcgatcctggatcactcatcactcattccttcactcatccagccaactaaaaacatatactgaccatgtactacgttgcagctccaattt

SEQ ID NO: 530241 - DNA, 510 bp, Homo sapiens
  misc_feature (9)..(9): n is a, c, g, or t
  misc_feature (27)..(27): n is a, c, g, or t
  misc_feature (30)..(30): n is a, c, g, or t
  misc_feature (34)..(35): n is a, c, g, or t
  misc_feature (63)..(63): n is a, c, g, or t
  misc_feature (67)..(67): n is a, c, g, or t
  misc_feature (89)..(89): n is a, c, g, or t
  misc_feature (94)..(94): n is a, c, g, or t
  misc_feature (107)..(107): n is a, c, g, or t
  misc_feature (113)..(113): n is a, c, g, or t
  misc_feature (122)..(122): n is a, c, g, or t
  misc_feature (128)..(128): n is a, c, g, or t
  misc_feature (135)..(135): n is a, c, g, or t
  misc_feature (143)..(143): n is a, c, g, or t
  misc_feature (149)..(150): n is a, c, g, or t
  misc_feature (168)..(168): n is a, c, g, or t
  misc_feature (172)..(172): n is a, c, g, or t
  misc_feature (183)..(184): n is a, c, g, or t
  misc_feature (196)..(196): n is a, c, g, or t
  misc_feature (199)..(199): n is a, c, g, or t
  misc_feature (201)..(202): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (214)..(214): n is a, c, g, or t
  misc_feature (222)..(222): n is a, c, g, or t
  misc_feature (226)..(226): n is a, c, g, or t
  misc_feature (228)..(228): n is a, c, g, or t
  misc_feature (244)..(244): n is a, c, g, or t
  misc_feature (249)..(249): n is a, c, g, or t
  misc_feature (251)..(251): n is a, c, g, or t
  misc_feature (259)..(259): n is a, c, g, or t
  misc_feature (261)..(261): n is a, c, g, or t
  misc_feature (272)..(272): n is a, c, g, or t
  misc_feature (296)..(296): n is a, c, g, or t
  misc_feature (308)..(308): n is a, c, g, or t
  misc_feature (315)..(315): n is a, c, g, or t
  misc_feature (320)..(320): n is a, c, g, or t
  misc_feature (327)..(327): n is a, c, g, or t
  misc_feature (332)..(333): n is a, c, g, or t
  misc_feature (338)..(338): n is a, c, g, or t
  misc_feature (342)..(342): n is a, c, g, or t
  misc_feature (346)..(346): n is a, c, g, or t
  misc_feature (361)..(361): n is a, c, g, or t
  misc_feature (363)..(363): n is a, c, g, or t
  misc_feature (375)..(375): n is a, c, g, or t
  misc_feature (385)..(385): n is a, c, g, or t
  misc_feature (408)..(408): n is a, c, g, or t
  misc_feature (420)..(420): n is a, c, g, or t
  misc_feature (427)..(427): n is a, c, g, or t
  misc_feature (431)..(431): n is a, c, g, or t
  misc_feature (433)..(433): n is a, c, g, or t
  misc_feature (444)..(444): n is a, c, g, or t
  misc_feature (446)..(446): n is a, c, g, or t
  misc_feature (450)..(450): n is a, c, g, or t
  misc_feature (507)..(507): n is a, c, g, or t
taaggttcncaggtctttttttccccnttnaaannccaggaattgacttatttaattaacccnccanccccccaaagcaaaaatttganaaaanaaatttattttcnggttcnttttttccntggggnagttagnggttgccnccccgnncccgggaagttgaaaaanaaanggggaaacccnncccccccccccnggnannaaaaanangncngggggggnaacncnggtcagcctgggaacnggggncncagtggananaagggggggcngtccccccccccccccccattatnccaacaggggcncagaaanaatcnggggccnttccnnaaagngaancccnagcgcgccttgaagncncaaagggggggngggaagaaanccccccccccaatcccccccaanaaacccgtttcnggctttncaancngtaaaaaaaanancaancccccgggccctttccccccccccccccgagggtcccccccccccttcccccccganccc

SEQ ID NO: 530242 - DNA, 117 bp, Homo sapiens
gtaaattggaaaaatagtaagtcaatatttaatactattggtaaactcaaggggactgtggtggccaggtgcaggggctcacacctctaaccccagcacttagggaggttgaagcag

SEQ ID NO: 530243 - DNA, 359 bp, Homo sapiens
atctacactgcccagtccaggcactaacctctttttgattggtttctattagtaacccctgagccaggctccctgtctcttactttatgtctcacatcattgcccacatgggctcatttacgttgcacatctgacagttttactcccagcaattaaaatactgcagtatcttgaaatcatatgcttctatcataaagttcaactacatcagcatggcaaaaacattccttctttgaacccggactcaacctgcagctcctgccatttcccactacgcactttctacataatgtcacactgaattttattctcccactacacctgttatcttgtgccatgagccactgctgacgtggatc

SEQ ID NO: 530244 - DNA, 95 bp, Homo sapiens
cattggggttttccccccccccttcccccccttttccctttttatatcccctttttaaatgggtttttttttttccaataaaactttggggccca

SEQ ID NO: 530245 - DNA, 80 bp, Homo sapiens
gcggccgcctactactactactactgctcgaattcaagcttctaacgatgtacggggacatggcgaaaccctgtctctac

SEQ ID NO: 530246 - DNA, 168 bp, Homo sapiens
gttcaccgctcttcttctctcatcctttattcagagtccatctcgccttccccatgggtggggcacctgtgtgtggttgtgtgcacatatcattttaaatcttttaagccagaaagtccttacctccgtgtaacacatcaataaagtcaaatcattgtgagccctttc

SEQ ID NO: 530247 - DNA, 759 bp, Homo sapiens
gaaggctggagcagggacgccgtcgctccgtgcgcctgctcccctcgggtccccgttgcgagcccacgcctggccccggtgcccgccctgcgagccctgccacgtggacacagtgataatggcccagcgcacaggcccccacgtggacagcatggaccgcggcacgctccctctggctgttgccctgcttgctggccatgctgcagcctcatgccccacaagtcttgcagaaacagtccattgtgaccttcagcctgtgggccccgagaggggctgaggtgacatataccacttagccaggtctcgaagggctgcgtggctcagggcccccaattgccatccgttgaagtccatgtccgtctttcctggatgttcccaactgggccccgtcacgagcctggaagcctgactctccaggcatccagtgcaaacttggcaccttgggccccgagaggtgcttctggtcctcagtgtaaacggcagtgtcttcctgcattctccaaggccctgggaactcccattgcactttgggcctacaaattcccagcctggtcaccttccaagtagcccccgggggctcaagcaccaccagagctgccatcctctcccaagacccaagatccttgagttgggcagctgaagaaggggccaatcagcctctggtgttgagctgatttgcccccaatagcaatctccgtccgatgtgggcataggcgcagggggtcactgtcgttctggctttcttggaaaccagccagg

SEQ ID NO: 530248 - DNA, 922 bp, Homo sapiens
gcggtggttactttctgcgagttgtgttgtgactcgcgtgatcagggaaccatgtcttcactggaaatgctgaacatattgggcaccctgctcccatgttcacacagccagcagctgtccatgcctaggatggtcatctttacatgatatcatgctgtactgatccacgaaggatagatatgtagtgttcttctattaacctctatgatttgcacctttgtgttgcccaccgaatatcatggcttgtcagtgataggtgcctgaacgaagatttaagaaagtcaattgactccaagtgatggatgcttctgtgaatactcacttctgtcatctagccatggcgtcaatacagctaagaagacaaggaggactgcgacccatgaacattcctttggtatcacgacccgaagctgcactctattgcatcaggattatggggtcttaagaggtctgagtgaaggcagtctcgttcaggggcctttgtatcattgatgataagggtattcttcgaggagatcactgtaaatgacctccctgtttgcgcgtctgttggatgagactttgagactagttcagtgcctaccagttcaatttgacaatcatgggtggaatgtgtgcccagtctggctggaaaacctggcatgtctataccatcaagtcctgatgtccaaaagagctaagagtatttctccagtgcagaagtgtagcgctgggctgtggtaagtggcaggctgcggagggcagcatgagaatcaaaatcttttctagtatcacagtgaccctgaattaggcatgagactccagattcagcctcaattggggtgtcttacaggggcatgcttttcctacaggtggtgttcaaaccaggctttcttccttgggaaagaatggcctgatttggcgtagtggccagcgaaatggt

SEQ ID NO: 530249 - DNA, 110 bp, Homo sapiens
tcccatggtcttgtctagtggggcagcgctggcggctggtgtagtgtaggtgctggcggtggtgcgtgtccagtggtctgccggcagattcggtcagtgatggtgccagc

SEQ ID NO: 530250 - DNA, 195 bp, Homo sapiens
gtaccctggctgttgagcaacagccagcagcacagcactggtgtgactattcattcacagaaatttatcctgcaagggcagtaagttgagagcagtaccctgcaggagaaagcataatcaaacaaaaaccctggaaatttagcacagctttacgtggctatgaggcacaggaatatgacattcccattaaatctc

SEQ ID NO: 530251 - DNA, 104 bp, Homo sapiens
gggtccatcttttcaacaacttggcatgcaaggcgtttcgtgttcttcgtttcagggcactctcacatcgcactgccggccagccaagctggcacggccgtcgt

SEQ ID NO: 530252 - DNA, 140 bp, Homo sapiens
gcaggtcctcccctctcttgtcagatgcccgagggaggggaagcttctgtctccagctttccgagtaaccagtgacacggctcggccaagcaggacaagttctttataacaggaacacacacatttacaactctcccccc

SEQ ID NO: 530253 - DNA, 302 bp, Homo sapiens
gaaaatgtcgcgtggtcagcatcgtggttaatgctgcgggcagtgcatccacatccaggctttactgtggcccgagtcatcagtgctttggaggtggtcgcctcattcgcgttatagccagacattggttctctaaggtcagagtccggcgcatgttcttgcattggcctcgtacccagtgatgctgtcgggcatcatcagcaaagggttctcgcattcagcatagtgtgcattagggcagcagatcattggggtggcagcatcgtggctcgtgagctctggttctcaggcatctccctctt

SEQ ID NO: 530254 - DNA, 363 bp, Homo sapiens
  misc_feature (77)..(77): n is a, c, g, or t
aggatcagtcttaaggacagtcgatttttacgttacttgcacacagctgtaatagtgagtggaacatgctggtgtanggaggaaacacacacaatgacacatctataaggcatggcgccaaatgcttctcttcagatttcatgggctatgacattggtaagttcccaaaaacattttctcttcaggcatcttttagcctatactataagcagcatttaaaagggactgaaaatatgggcagggcaaaatgatcaggccatttgaaagaggtcccaaatggtactttttatattcatttgactaatgttaccacatctggtaaaaattatttctacattaaattctttttgaaatcactcctgt

SEQ ID NO: 530255 - DNA, 104 bp, Homo sapiens
ccttccccaaaattaaaaaaaaaggaaataaaagatttctgtctatgtaaagttcccaaaatttgttttaaattaataaaactatctttgtgttcttttctgca

SEQ ID NO: 530256 - DNA, 117 bp, Homo sapiens
aaacctgaataacgcctgctgtggagtaacctaaacttgtataggcaacatagtgttaagatagctgggtggcaataaacttggaataagcgttatcactgatgtgtctatgggttc

SEQ ID NO: 530257 - DNA, 160 bp, Homo sapiens
tgaggcgatctagaggatcccgccagctctcagacccttccagcacaagccaggtaccttgtttgaaaaccagcccctcaccagagcgatcgctattgctgaaatacgcgcgcacgcccacgctggatcctgacacgatgcacgcgcgtaagggccagca

SEQ ID NO: 530258 - DNA, 1556 bp, Homo sapiens
gacctcatcatttgcgccggctgagataatgggggggatcatatcgatgaagatggtgcaagctaaatacgatggactgagagcaaacaaagcgggggcgttctgttttagtggccgtttgtaaaatagggcgacccccgccgggagaacgtagttcttagaaggataaaacaataggagatcgttttgggataattttcccccttgcgcgaagactaagttttggggcggctttattcaaaaggagaatcattcaccaatagacgatgagagataatttgtgaaagtgggtgaagattctctatttctatctgctctccgctcttgttcgttctcactttaccatctgccgccttttgtttgtgctcatgatgacaatacctcctccaaggagagtgttgtttgctccccactaggatagtttgcccccctcgaagagatatggtggaagttgggctggttgccccctcgttgttgctttgggtggccctgtgcgttgtcttgttgtagagcgtgggtttgcccccgcccggtgtgcccccccctctcgcctttgggggccccccgtcgtcgcgtcacgggcccactttgtggtgcaactgaagaccaccctcgtggcgccgccttcttgttgggttgtttggccacaagccggtggtgggcctctattaaagggggcccgaaagaccgccccaccggagtaggcccccaataggagcgcccccttggaatcgtcgttgcggctgtttgtgtctcgcgtcgccgccttcgtggaagtgtgtcctctggtgtgttctcttgttcgcgccacgggtttggccgcccacccaggtaggccttcttgtgcgactctccgtggtctgtcgtagagtctcagatgtcggtaatggtctctgttgtggcgccgtgtgttatcaccccgtgtggtaccacatatctctcgcgtcctcagagaggcgcccccctttgtgcgcttggccccaccctcgcacacaggtggacacggtatattccccgcccccccctggacacactctcacctgagtctcacccagagtcccgctgtcccgttgtgagagttttaatagggaccacgcgcacctgtactccccccgtgaactctgtggtaatgtttctgctctgtctggtgttctcgctgtgtgtgtgtgagtgtgtgtgtggtctgtgctgtggcgccagtctgtgagagacatggtaaagacgtcctcccggagacgccagagacacccttggtcttgtgtctggttctcatgagcgctataatctctcccagccacatctcagaacaccaggggcgcctggccacacaggagattaggtgcctccacaataattttagattgatatccatgatggaataaataaattgcgtgaaccattggttgagtgcttactcaccatggaccagttcattcatttccaccataatttaactccatgggcccagtggagctattaggccttctgggccaaatcccagctccctgcttgtttttatccaaaaccattttattggaaaaaagaaaataagaaaa

SEQ ID NO: 530259 - DNA, 387 bp, Homo sapiens
  misc_feature (123)..(123): n is a, c, g, or t
  misc_feature (155)..(155): n is a, c, g, or t
  misc_feature (272)..(272): n is a, c, g, or t
tgtgtgattaagactagtgactttgttggtgactttgtctgggactggtggggggagggggggtaatcaatagaaatagaagaataaaataaaatccctccctagtgcattaatctgagtganagagaatagtataaagaataagatagtaagtnattcgtgtgtaggtgggcttaagtactatggagaaaaatgaagcagaaagatgataagaagtttgtgtgtcagagggtggtggcattttaactacagtgtgcaggcagcactcactnagagggtgggcgtggtaaaagatttgataggagcgagagaaccgaccatgcaggtatcctggagggcattccaggcccagtgcagaggcctgaaggcaggagaatgttggcaagc

SEQ ID NO: 530260 - DNA, 192 bp, Homo sapiens
gttcgtgatatgagacagacgttgcggtgggtgtcatcaagcagtaggcaagaggctgctggagctggcaaggtcaccagtctgcccgaaagctctgaaggctaatgaatattatccctaatcctgccacccactcttatcagtggtggagacggtctcagactgtttgtttcattgccatttagtttgtgt

SEQ ID NO: 530261 - DNA, 1416 bp, Homo sapiens
  misc_feature (199)..(199): n is a, c, g, or t
  misc_feature (254)..(254): n is a, c, g, or t
tcttcttgcagctgttgagcgcacctagccagctggtcatgccccacaggcctgctctccgtcaccctgctctacctctccgatcgccagggaccacggactcagctttcgtcctctcgtcctacttgcccttcgcctcctaggttcgcctggctgtctctgatcgtacgaattgtatggacgtgttcctgccatttgnaggcatcgacgaacatgccacagttggcccacgttgagcgagtgtagcaatgggntgctggtgatgtacgtgtatggtgttgctggtgctgatgatgctcgcgccgcggcccattgtgccagaccaagacggagtcgaagagcaaacatgtgatgtcgtgcgtgcggtgattggagctgatgcttaaatcctctttcagatcatcatctctcactgcatagctccgatgacatcccattgagagagagccaagaggttgcaccacaaggcggcaatgtgcaaccagagaacatagatagacaagctggcacaaggagaaacacccagagacccccccatccatggacattagcatatgaagaccgagacaccccgaggcacacgggggagaacaaaaccccacacacataagagaccgaggagcgcgaacgcctggcttaggcatatagacgagttataagcacagagaaaagaccccatataacttaagcccagtggagggtggcaacccccaatgtggccaaaaaagagtcacactaacaaatagaaaagacgccagagacaccaagagctttaggtaacttacccctttggaacacgcggggaaccatcacacagggaaatgtccagacaaatagcgaagacacaggaggcacaaccatttggcccgattaggagcaagagctcctacacgaaaagaactctcctcaatttggagtggagacccccaaaggaggacaccattgagagaaacggcaaccattagacaaggaggagaacaccaccagggagagcagaaggaaatttggcccaactcacgggtgaacctttgatgtggagagccacaacgcaattgggagcatagcgaggatgacactgcagcgaaagtagggggtattcccacccacacctagtacatcggtaatagatcgacctaaagcacaacaccagtgaggaagtggcacccaagtatgtatatgtccgaccacaatgagaaatctcaccacgaggaggagagatatccataatgcggttaactcggatgacgatgaccccagacacgtatagatcatatcgggtattagtggtcgataatcgacagcagcaaaaatcagcgccatttacgacctctaaggaagttacactgagtgagcagagaaactttaggtattcgaaacagagatataacacgaggattaaaaaaaaacaccattatg

SEQ ID NO: 530262 - DNA, 338 bp, Homo sapiens
tgcgggtttgtgcaggatggagagtatagtggatggcgagtttgtgattgtatgctgattatgacggaactgggattatataccgtcactagtgctaagaccgtaagacctcaatagtaaaatcaacaagattgctcgccagagcactacgagcgacagataaacaattcagaggacctggcggtgcttcactatccctctagagtagcctgtcctgcatactcgataaaccccgtatcaccgctcaccacctctggctcatgccttatatcccgccatcttcacgcaaatcccgatgaagcgctaccaagctacgcgccagtacccacgctccagac

SEQ ID NO: 530263 - DNA, 699 bp, Homo sapiens
gctctttccttgcctaagcgcagtccatggctcgtggtcccaagaagtcatctgaagcggtgtggcagctccaaagtcattggatgctggataaattgaccggtgtgttgtgctcctcgttccatccatccggtccccacaaggttgacgagagtgtctccccctcatcattgtcctgacgtgaacggacttaacgtatgccctgacaggaagatgaagtacaccgaagattggcatgcagcggttcattagaatcgatggcaatggtccgaactgatatagcctaccctgctggattcatggatgtcatcagcattgacaagacgggagagaatttccgtctgatctatgaagaccgaagggtcgcgtttgctgtacatcgtattgacacctgaaggaggcccaaggtacaagttgtgacaaagtgagaaagatctttgtgggcgcaaaaggaatccctcatctggtgactcgatgattgcccggaccagtccgctaccccgatcccctcatcaacgtgaatgataccattcgagattgatttagagactgggaagattactgatttcatcaagttcgacactgggtaaccatgtgtatggtgactggaggtgctgacctaggcaagaattgggtgtgatcaccaacagagagaggcaccctggaatctttggaccgtggttcccgtgacagattgca

SEQ ID NO: 530264 - DNA, 164 bp, Homo sapiens
ttctcgctgatagtcattgttgccgtgcactaccctttgccatcgggtttgatcaccagacaggtcgcactcgatacgtccagcacgcgctctgcggatatgaccagatcagcaggctgtccagaatggccacgggacgctgatgcccatcagcaacagaccga

SEQ ID NO: 530265 - DNA, 879 bp, Homo sapiens
  misc_feature (35)..(35): n is a, c, g, or t
  misc_feature (110)..(110): n is a, c, g, or t
  misc_feature (172)..(172): n is a, c, g, or t
  misc_feature (240)..(240): n is a, c, g, or t
  misc_feature (258)..(258): n is a, c, g, or t
  misc_feature (261)..(261): n is a, c, g, or t
  misc_feature (270)..(270): n is a, c, g, or t
  misc_feature (273)..(273): n is a, c, g, or t
  misc_feature (290)..(290): n is a, c, g, or t
  misc_feature (297)..(297): n is a, c, g, or t
  misc_feature (317)..(318): n is a, c, g, or t
  misc_feature (344)..(344): n is a, c, g, or t
  misc_feature (349)..(349): n is a, c, g, or t
  misc_feature (421)..(421): n is a, c, g, or t
  misc_feature (423)..(423): n is a, c, g, or t
  misc_feature (482)..(482): n is a, c, g, or t
  misc_feature (492)..(492): n is a, c, g, or t
  misc_feature (505)..(506): n is a, c, g, or t
  misc_feature (514)..(514): n is a, c, g, or t
  misc_feature (525)..(525): n is a, c, g, or t
  misc_feature (542)..(542): n is a, c, g, or t
  misc_feature (877)..(877): n is a, c, g, or t
tttgtatggaaaatgatacggcaaataaattaganctatgttaaagcgaaggttagctaaatattgaaacttaaggatataatgggtaacgataaatagatttcacagtnttttttaatagagtatcttttaaacacaactttgctagaaactggtccaaagatcgacagcncgtgggaatgcttaacaggggtggtgattagggacacgttttttgggtgttgctttgatgatgttgtncagacggagaatgagctntgntggtttagntgnacttagaagaacctgtngctttanttgaaaactttctgttatanncaggatagccatattttcaatggtgngttcnctcatatccaatccagcagtggtattgcctttactgtgagcagccctgagctgtgccaccaggaaagataangnaatagaatgaattgttagctatgatggttggtaatattcttagtgtctttagcataagngtccattggnagaggttgtttgnntggtgttntattgggaagntgtgtgattagcatganctatcaacatcttagaatagcttcctccataaactgttctagagtcctttacagtttgcgcaagaacacaaagagcatcatgcaatgatctttctgcttcatctaaaatttgttgagtggcaccacgcaaaacaatggtacaagcctcaccaagggcaaccccagaaaagtgaatgagtttgtcttctccaatcatgacttcctcgataagtttgcaacttccaagcttcaccagttctgggtgatcaaaggtagaggcaatttcaccacctgtgacaagagctaggcgttccacacctgcaaaatctgcatgctcaatagccatgacaccagcngc

SEQ ID NO: 530266 - DNA, 161 bp, Homo sapiens
cactcgatgaggatcccggtggttggtgttaactacttttgacgttgggtgactgacggaatacgtgtacggagtatgggggtaattatggtgggccatatactagtatccttaatcatttgaatgcccaactacaatactacagtatggcccaccataat

SEQ ID NO: 530267 - DNA, 1036 bp, Homo sapiens
gccgaaaggcacgaaggccaagggaccggaaggtggctccggccccagctgtcgtgaagacagcaggaggctaagaaagtggtgaatcccctgtgtgagcacaggcctcagaatttcggcattggacaggacatccagcccaaaagagacctcaaccgagttttgtgcagatagtggagccgcgctatagtctggtttgcatgcggcacgagacgccatcctgctatagagcggctgaagagtgcctcctgcgattacacagttctacccacggccctgagagtcgcggaaccagtactccagctgcttacagctgggccacaagatacagaaccagagacaacaagcaagagacgaagcagagacatgtgggccgacggcgagaacgacaggctgctggccaaagagggacagtcgccacacacacgagacccacctgtgccttcgaagcacggagttagcaccgtcacgcacctatggatggagacacaagcacagctcacgctgtgtggtgattgcacaacgacgtggatcccaatcgacgctggttgtctatctatggcctgccctgtgtccgtaaacatgggaggtccctttacatgcataatccaaggggacaaggcaagactgggagacgtctagtccacagagacagaacttgcaaccactggtcgcctactcacacaggtgaaactcgcgcagaacaaaggcagcatagggtcaagacagggtgggacagctcacacaaggaaccaaagaacaacagcaccgattaacgatgacaatccgacggtccacggagagagacaaacagagctagaatcctagagacatgttggaccgcgatggcgaagcgtcgaaacaggcacaggctaacgaaccatggcaataacgcggggttacatgtacaatgtgacgtttactgacgataacaatactagaaataatacacaattatccttcaagacaagagagagacagcgcgggaaccatggaagatgtgggaacaaagggtagcaaaggacgagaaaaaaga

SEQ ID NO: 530268 - DNA, 169 bp, Homo sapiens
gcaccaaggacagaaaggagaagaaggaaggagcggaagaggcagaaaacggaagagacgccccagccaacgggaaagcagagaaagaggaaaacggggagcaggaggcagacaacgagggagacgaagaagaggaagaaggaggggaggaagaggaggaggaagaaga

SEQ ID NO: 530269 - DNA, 341 bp, Homo sapiens
  misc_feature (130)..(130): n is a, c, g, or t
  misc_feature (179)..(179): n is a, c, g, or t
  misc_feature (242)..(242): n is a, c, g, or t
cgcagatgaaataaggtgaaaaccatgagctaggctaggtaagaggcaatggtaacctgagttggagtggtaacagaggataagaagtctaagaatgcagcccttgggccaatgcactgtgtgctcacancgctgtaataacatgggctctgggatggctaaatgcaggagtgatcacnctgaatgccagtgagttttgagaccatgctggtgtcaacattatgtgagacctgtctccacanaaaaattaaaatatatcatgccatgcatgtgtgacacacactctgtatgtcccatgctatcttgtggggctcagtgtgggatggatccccttgagccca

SEQ ID NO: 530270 - DNA, 976 bp, Homo sapiens
  misc_feature (258)..(259): n is a, c, g, or t
  misc_feature (282)..(282): n is a, c, g, or t
  misc_feature (299)..(299): n is a, c, g, or t
  misc_feature (307)..(307): n is a, c, g, or t
  misc_feature (318)..(318): n is a, c, g, or t
gtggatccctcttgtgtgtagtccatgctattaaaagtgtgtcccacagaccaagagcctcaacatttcctacaagccttattagaaatgcagaatctgaagccccactctggacccaggacatttgatgagatccaaaggagtgtatgcacatgaaagtttgagaagcatcatcatagagaagtaaacatcacacccaacttccttatctttccagtggctaaaccacttaacctctctgggtgttacctgctcatnngtttaaaaaaaaaaaaaaaagtntcaccggctttcatgcngaggacangttcagatgtncaagcctataatatttaggcagttcctcaaatttatgaaaagtgttctcagaatggggagacagtcaaagggtacaaagcctcagttaggaggaataagtggtgatttttttttaaaggatcacttggcacagcatgctaaatatagggaataattggaatggtatatttccaatattggcgtaagcgagtaaattttctaagggtctctcattacaaaagtttaaaaatttggagaatcatagtgttacattacgggtaactcattccacctgtatattcaaaaattcataaaaccgctatggtaccctataaaaatatacaataattcgccacatactataatcaacacataacaaaacacaaacattactctctcccccaaaaaaacatctcagccggggaacagcatgtactctttccactctgaaagacaactgctggcgggaacgagctccactggagatgcgggcagggaggctggcgctcgagccagcccctgcgtcacgcagcgagggggagaacagcatcggtacactcctcttacattcccctctcactgatctggccctttcttccccaggctcctttcccatcggcttccccaaccctactccttcaacagctcctgctatgccctgacttccttaccggcccgc

SEQ ID NO: 530271 - DNA, 271 bp, Homo sapiens
  misc_feature (18)..(18): n is a, c, g, or t
tgtacaggaatggaatgnaatgcagtagaatgaacacgagtggaatggaatgctatggaatgaaacggaatggaatggaatggaatgcaatggaatcaatccgactagactggaatggaatggaatgcaatggaatggaatgaaatggagtcaaaccgactagaatggaatggaatggatggaatggaatggaatggagtggaatggactggaacgaaatggaatagaatggaatggaatgcaatggaatggattgaacagcggaccctaa

SEQ ID NO: 530272 - DNA, 80 bp, Homo sapiens
  misc_feature (69)..(69): n is a, c, g, or t
cctgtcattgcccttcctacttcatgcccttctggctcaaatgtcacctctagcctgttgtcacctctncaccatgaact

SEQ ID NO: 530273 - DNA, 112 bp, Homo sapiens
  misc_feature (89)..(89): n is a, c, g, or t
tggactcgattctgcatgagggaacagcattatcttgccagttctgcgtgttggaggtgacgacttctccacttcctgctctgggtctntgcgccccatctcctgggcctct

SEQ ID NO: 530274 - DNA, 145 bp, Homo sapiens
gtttggggtgggaggtgtcaggcaggatagtatatggtgggcctgacgctaccaccattcttctctgtccccctcccacaagctgggcctactatccagcccaaggggtgcagcagtttcccactggcgtggcccccggcccagt

SEQ ID NO: 530275 - DNA, 514 bp, Homo sapiens
tctagaggatcttctgctgctccctcttcactgccagaagctgctgaacttaacgccaaagtggacactctcacactggcgggggagagtaaatccacaaatttggaaaacaggcaaggagttacataaaagttaaataatatacccagcaaatcttcccagccactccattcctaaggtatcttacccaagaagaaatgaaagcacgtgcccatatgaagacttgcacgtgaatgttcacagcacctctatttgtaaaagccaagaactggaaacaactccatcaatatccatccacaggataaaaacactgtagtaaatccatacaatggaacattactcagcaatgaaaaagaaaaagctatggatatatgtaacaacttgaatgaccctaaaaatcatcatgctgactgaatgaagccagtcaaagaaggggtcctttactgcagtggtccctaaccttcttggcatcagggaccggtttcgtgaaagacaattttcccactgaagaggg

SEQ ID NO: 530276 - DNA, 350 bp, Homo sapiens
ataccccgggggaaggaatgatgacgttataaagctttcataaaaacccaagcggacagggttcagggagctttgggataactgaacacatcgaggttcctggagggtggtgcctgggggagggcttggaagccctgtgcccctcctcccacacctgaattgttttttctttttcccttcatgaaactcttccctgctccccgtataaacctccatagtcattataaaaatttatgataatttttacatgtctccccgctcctaagtaccttccacagtgtctagcatgtcatagggagtgattggtaaatagctgatagaaagcccccattaaactatcagccttgtaa

SEQ ID NO: 530277 - DNA, 1260 bp, Homo sapiens
  misc_feature (293)..(293): n is a, c, g, or t
  misc_feature (383)..(383): n is a, c, g, or t
caaggaggttactttgcctatcatgcaacaagcttattatgcacgcgtttcatggataaccgctctcataatcatgttcacacttatcatagcatatactagctccctgtcaatgcgccatttcaccttgagagcacctttcgaccagatgacaatacctatacctcaactaccttagatcaactcttcgagcagctgcgtacgaggggaacctaccatagaccagactgtaacatatacttggcacgcggtcgatccgagtgcgcctaagttacccgtacaatacggtcacntccgcctacttcgcacgtgacgggcacttcgcctattgactactcagaccaggatctcgaggtccaagaccaggagtacgcacattcccncttttacctagtccaacatttgagacttccgagaccgagctcgagatttggtgttaaacttggaacagcgcgtacctggatgttaagctagcaactggaggcttgatctggggattgctggcattcttaataacttccttgtggcgaaatgcctccctcctcaactagtgaatccttaacgcccgtcgcaattctcagtgttgccggtgagacagcgcatgggacaagcaccagtggccagcaggtccgcctctgtgactggctatcgcaggacaatgggaatgcttacgcgtgagatccactgtactataggaggcagcgcccaccaagtgtctggataagtacactaacaatttactgatcaccactgatggaaccggtccctctgtgatcttcccaattaggaaggctgaagttccggccgagacaattttgagaggggcttgtgaaaaggacactcctatggtattgtgcgaaagtcttaaccccctgtgtacccagtttctaaggaaaagcgcggaataatcgcaactcttcctgtggcaattccctgggcatggtaccgacctgcaatcctgagggggggggttatgaagctgaacctggggttccaacatttccgtcgtgcgtgtaggacggatattcctgtaggttggggggcatggggccatttaccccctaccggatgttcctttgcggatgtaggggcggcgcgatatagcgggttacctcttggccagggacaacttgtggaaaatattttcccgctcttttaaaagagaagtgtgtctttctcgtacaccacttccaggggaggtcgcgcgctctatgtctaaaagccccttggattaaaggcagaccccccccttcatgataa

SEQ ID NO: 530278 - DNA, 917 bp, Homo sapiens
taatactaactatcgatcaggctggaattgcctactcttcaatcagccacatagccctcgtagtaacagccattctcgatccaaaccccctgaagcttcacccggcgcaggcattctcataatcgcccacggcacttagatcctcattactattcttgactagccaaagtcaaactacgaacgcactcacagtcctggtcataatcctctctcaaggacttcaaactctactcccactaatagctttttagattgacttctagtcaagcctccctaacctcgccttaccccccaatattgaacctactgggagaactctctgtgctagtaaccacgttctcctgatcaaatatcactctcctacttacatggacgtcaacatactagtcacagccctatactccctctacatatttaccacaacacaatggggcgtcacatacaccccaccaaattaacaacataaaaccctcagtttcacacgagaaaaacagcctcatgttcatacacctatcccccattctcctcctagtccctcaaccccgacattcattaccgggtttggctcttaaaaatagagaaccgggaaacccctgaatacaagagcgcagcggggccggccagttctcgcccccgggacacaggggtccgcccgacgcaccttaatcacagggcaagcggacaccagatagcggccactacaaggaaaaaccaccacggacgccacattacccacaatcccaacgggaacaccacgcaccaagacgcaccgcagacggaaaccctacgcctctaagccgaacaccaacgggacaccggccaccggaaaaagcccgcggactagacccccggcatacgaccaccacagacaccccacacaacagccacccagacaaaatacccccacaaagaacaca

SEQ ID NO: 530279 - DNA, 213 bp, Homo sapiens
  misc_feature (50)..(50): n is a, c, g, or t
  misc_feature (77)..(77): n is a, c, g, or t
  misc_feature (83)..(83): n is a, c, g, or t
  misc_feature (209)..(209): n is a, c, g, or t
caggagtcagaggtgatgagccgggcaggtgggtggaaagccggcggcgntcagagaatggatgccaagcgagactnccaatnactcaggacgtcccagtggagtcacagcgtgagcccagcaccgaggttttcagagtcagatgactgcagagaagatgctgatggcactactggccaaaacgggcttcactggagctggggtgtgtncatt

SEQ ID NO: 530280 - DNA, 7118 bp, Homo sapiens
gcggaggcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgtttgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccggggtgccttgtggtggatcgggtgggggctggggcggcaggtgtcctcgtcatctcacttgggggcctgcatgtctcttggagggtccaggataagtcgtgagcaacacgggcgagggggtgcaccgggggcatgacgtggtgggctacgtattgttcacgtcagtaagggaattgtggccacgatgacgggatgtgaggagggcccacgtctgggtagaggtggtcggggcagcctcctagaagtgatatttaagctgaaacatgaaggagaatgggcctcctttgctgaaagtttgccgagaggcctggcaggcgtgacagcagatgcagaggacagaggcctgggtctccaggagaagctgagggcacagagggcagaggttgggcggggtggggacagtaggtcatgaggccaagttttgttcttggtgtggaagccactttaggtctgcattgtttttttgttttgttttgctttttttttttagacagggtctcacactgtcgccaggctggagtgcagtggtgcgatctcggctcactgcaacctccgcctcctgagttcacgcgattctcctgcctcagcctcccgagtagctgggattacaggcgcccgccacctgggattacgggcgcccgccaccatgcccagctactttttatattttttgtagagatggggtttctccttattgcccaggatggtctctatctcttgaccttgtgttctcccgcctcggcctcccaaagtgctgggattacaggcgtgagacatcgcgcccggctgaggtctgcattgttaatagcgccctgcagggacggtgcaggctggttgggttgcatattgtccacatcagtgagggaaatgtgggcatgcatggtgatgggatatggggagggccggcccccagctgggaggtgactgtggcttggcctcagggactattggtgaaggaccaggaccacttgcatgatgggtgtgggagagtcaggggtcttgctggtgagcctgtgccaggagctgtgagaaccagggccagccactgggcaacctgggtgtttggggatgggcgtagaggagttttcattggagcgccgcagcctgctgacgttttcttcagatgtgcaaggtcttctgtcttccagcttgccctgcctccagcaggaaatcttcagtcctctcttggtttttttcctccaactgctttgaagatttttcagtaccactggttttgagcagtctgatgaggatgtgctttggtgtattgaggtgtctgatgagggtgtgctttggtgtattgaggagtctgatgagaatgtgctttggtgtattgaggtgtctgatgaggatgtgctttggtgtattgagtctgatgaggatgtgctttggtgtattgagtctgatgaggatgtgctttggtgtattgaggtgtctgatgagaatgtgctttggtgtattgagtctgatgaggatgtgctttggtgtattgaggtgactgatgagaatgtgctttggtgtattgaggtgtctgatgagggtgtgctttggtgtattgaggtgtctgatgaggatgtgctttggtgtattgaggagtctgatgaggatgtgctttggtgtattgagtccgatgaggatgtgctttggtgtattgaggtgtctgatgagaatgtgctttggtgtattgagtctgatgagaatgtgctttggtgtattgagtctgatgaggatgtgctttggtgtattgaggtgtctgatgagaatgtgctttggtgtattgagtctgatgaggatgtgctttggtgtattgaggagtctgatgaggatgtgctttggtgtattgagtctgatgaggatgtgctttggagtattgaggtgtctgatgagaatgtgctttggtgtattaagtctgatgagaatgtgctttggtgtattgagtctgatgaggatgtgctttggtgtattgaggtgtctgatgagaatgtgctttggtgtattgagtctgatgaggatgtgctttggtgtattgaggagtctgatgaggatgtgctttggtgtattgagtctgatgaggatgtgctttggagtattgaggtgtctgatgagaatgtgctttggtgtattgagtctgatgagaatgtgctttggtgtattgagtctgatgaggatgtgctttggtgtattgaggtgtctgatgagaatgtgctttggtgtattgaggagtctgatgaggatgtgctttggtgtattgatgaggatgtgctttggtgtattgaggtgtctgatgaggatgtgctttggtgtattgagtctgatgagaatgtgctttggtgtattgagtctgatgagaatgtgctttggtgtattgagtctgatgaggatgtgctttggtgtattgaggtgtctgatgagggtgtgctttggtgtattgaggagtctgatgaggatgtgctttggtgtattgagtctgatgaggatgtgctttggtgtattgaggtgtctgatgaggatgtgctttggtgtattgagtctgacgaggatgtgctttggtgtattgagtctgaagaggatgtgctgtggtgtattgaggtgtctgatgaggatgtactttggtgtattgaggtgtctgatgaggatgtgctttggtgtattgaggagtctgatgaggatgtgctttggtgtattgagtctgatgaggatgtgctttggtgtattgaggtgtctgatgagaatgtgctttggtgtattgaggagtctgatgaggatgtgctttggtgtattgaggagtctgatgaggatgtgctttggtgtattgagtctgatgaggatgtgctttggtgtattgaggagtctgatgaggatgtgctttggtgtattgagtctgatgaggatgtgctttggtgtattgaggtgtctgatgagaatgtgctttggtgtattgaggtgtctgatgagggtgtgctttggtgtattgagtctgatgaggatgtgctgtggtgtattgaggtgtctgatgaggatgtgctttagtgtattgatgaggctgtgctttagtgtattgagtctgatgagtatgtgctttggtgtaatgagtctgatgaggatgtgctttggtgtactgaggtgtctgatgaggatgtactttggtgtattgaggtgtctgatgaggatgtgctttggtgtattgaggagtctgatgaggatgtgctttggtgtattgaggagtctgatgaggatgtgctttggtgtattgagtctgatgaggatgtgctttggtgtattgagtctgatgaggatgtgctttggtgtattgatgaggatgtgctttggtgtattgaggtgtctgatgaggatgtgctttggtgtacacgtacagtatgtagcctttgagattggcttctttcatattcactgaaggcttcgccatgtcttttcgtggcttgatggctcatttcttttcagcgctggatgatactccatcctgggcgtgtgctgcagcttgtttatctacgtacctattgaaggacatcttagcttccaagcttcggcagttacgcgtaaagacatcttagcagcttccaagctttggcagttacacataaagacatcttagcagcttccaagcttcagcagttactcataaagctgctgtaaacgcccatgtgcaggtttttgttttgacacaacttttcagcccatttggatgaataaagaaacctgattgccggaccgtgtgatgagaccgtgtttaatgagaagctgccatttcactcccaccagcaatgagtaagcgctcctgaggcccatgtcctccccagtgtttggtggtgtcagtattttgtgtttggccattcgaataggtgtgtagtgggatcttgttttccatagcctttgaagatgtgtacattttcgtacctttctggcgctcttaagttcttcattcagactccgtgttgccaagagggataattttctttgagtctgaagtgccgtatttaatatatattgccttgtagttcctctgcagtgacattctgcctaggcttagctcttacgtggatcaaaaggccctaattcctcctcctcttttgaagtgcatttttacaggatatacggttctaagtggactgtgtttttctctgcgcatgttaaggtggttctattcatgctgttttctactgttctgatgaggaattttctcattctgttttccttactgtgaaatctcttacttctgactatatacatgattttcttttatttttggactttggccgtttgtgatgcacctgggtctagctttctaaactgagctacttcgacctgagggtgggtgcattttaacagattttgaagtcttgactgtt

SEQ ID NO: 530281 - DNA, 312 bp, Homo sapiens
  misc_feature (33)..(33): n is a, c, g, or t
  misc_feature (112)..(112): n is a, c, g, or t
  misc_feature (123)..(123): n is a, c, g, or t
  misc_feature (142)..(142): n is a, c, g, or t
gataacccatttgcccagtgactttttttttantattaataaagtatttgttattgccagatgtggtagctcgcacctgtagtcctagcactttgggaggccaaggtggganaattgcttgancccaggagtttgagtccancctgggcaacaaaattagaccccgtgtctcaaaaaaaaaaaaaaaaaaagccagacatgatggcatgtgtgcctatagcccccgctactcaggaggctgaggtgaaaggattccttgagtccaggagtccaaggttgcagtgagctgtgatcctcccagtgcactccagc

SEQ ID NO: 530282 - DNA, 214 bp, Homo sapiens
agaatgagccggtaccgcgctagcggcattagtgaacgcagtatgtaggagtccaagccaggatcaaacctgagccactacagtgacaccagatccttaactcactgcaccacaagggaactccatgattgttcttaatggcatcttaaatggtgaattctttcaagaagttttgcaatttacttttccagacgttcacttaatgccgctagcg

SEQ ID NO: 530283 - DNA, 367 bp, Homo sapiens
  misc_feature (89)..(89): n is a, c, g, or t
  misc_feature (94)..(94): n is a, c, g, or t
  misc_feature (134)..(134): n is a, c, g, or t
  misc_feature (137)..(137): n is a, c, g, or t
  misc_feature (145)..(145): n is a, c, g, or t
  misc_feature (160)..(160): n is a, c, g, or t
ttctttccttccttccttctttctttctttctcttctttcttttctttctttctttctttcgagatggagtcgctctctcactcaggcnggagngcagtggcgccatctaggctcactgcaacctccacctccnggnttcaagtnattctcctgcctcancctcccgagtagctgggattacaggtgcttgccaccatgcctggctaattttggtatttttttttttagcagagttgggctttcaccctgttggccaggctggtctcaaacccctgacctcaagtgatctgcccgccttggcctccttcattctctgtgaacatgtaactcaggaccccttttccctcttgcggtctgtggccagct

SEQ ID NO: 530284 - DNA, 905 bp, Homo sapiens
  misc_feature (905)..(905): n is a, c, g, or t
ggagaaataggacacactattatgaacttactgtgtgaccttcgaaatcaccagtataccttgcataatatagatcactgtggatcatatggaactgggaaacaagctgcataaaaatacctcggaacacgtacagtgctgtactgacccgtacctaaattcttccaatgagcatgtcattagcatgggagcaagtttcagtacagcagcagattctcatctagtctgtatacagactgatggactttcaatgaaacacaggccaaccagtgccactgccatcctaagaacacgtgacaggtgcacagtttgggtatccaatggagctctaaaaaccatcttcaggatttcttgctaagtccagcatagtggaagatggttactggttacaaataatccagagaccatgaatggttgggctagttaacgagaaccagaaagactttaacaattacatgtgggacagtttgatgcagtagacctgagagaataaggggatatctgtggtagatgctgagaaaaaaaaaaaaaaaaacaaaaactttgtggggggcggggacgaaaagatttaaacaccaatgttgggcggcgagccccaagacgacatggaacccgtggacaaaccgctggtcccaagaggaacctccggggcccaggcaagtgtgcggggtccaccaaaaaaaaaaaacgcgcgcgagacccagtcttcaacccacacccacaaacgggagtaagagggccaaggggctcaacagggggccacggaagcagatataccgcgcgagtggggagaacaagcagcaccacaaaagcagacacaaccaaagcagacagagccgacacaatagagtcaaaacaaagcaagaacaaaagaagacaaaagcaccgacacaagagaagcgagn

SEQ ID NO: 530285 - DNA, 101 bp, Homo sapiens
atgcacgttatgatatagaggaaagcactataccagggatactgagaagaaatccatcataccattacctacatcctgtgaggctgaagacattgaataac

SEQ ID NO: 530286 - DNA, 425 bp, Homo sapiens
tgccctctggatttgtgcactgtcctgtgtgcacagtttgcatgaaaattgcgtagactcagtggtgggaaaattaggtgctgaactgctgattctttgttgaggaggatggtctcaacatcattatggagaggccaggtgtggtggctcatgcctgtaatcccaacactttgggaagctaatgcaggaggatcccttgaggctgggagtttgagaccagcctgggcaacactggagacttcgtctctacaaaaaaaaaaatgtttttaactagccagtcatgttgagcacatactgtgtagtcctagctactcaggagactgaggtgagaggattgcttgagcttaggagttcgaggttgcagttgagctatgatcatgccactacattccagccttggtgacagagtgagatcttgtctctta

SEQ ID NO: 530287 - DNA, 384 bp, Homo sapiens
tgtggcgttctcgaggattccgacggcgggttgtactgctgggattataggcgtgagccacgtgcgcctagccaatttttatttttgagacaggtcttactctgtcagccaggcgggagtgcagtggtaccatttcagctcactgcaactgatagggaaggggaaagggaagtactgggaagggaagagcatgatccctttaaatgatatggaaggagggaagagtgtggtccctggctaggcctctacccccgggcctatgcccatggacctgggtgaggacaggcattttggttttcctgcccaaatgttgcatttcccaagaccacccgggcctgccataccaccatcctgtgcctataaaaaccccgagacgctagcagg

SEQ ID NO: 530288 - DNA, 102 bp, Homo sapiens
  misc_feature (69)..(69): n is a, c, g, or t
cgctgtttagaggatccgttcaggtgtgttgagaatgaggagtggtgtgtgggtgctggagtcccgggncggcaggcgtgcaggaagggccgctacaatttg

SEQ ID NO: 530289 - DNA, 171 bp, Homo sapiens
caggacctgaagcactggggatgattacagttcttcctaaaatatggatggctgctctttttctaaagagtgttaacactacaaactgtaaagtctgcaaaatagttgcattagactgttttggtaaacacatcctgcaacatacagcaccagcacagttgtcccccgtgc

SEQ ID NO: 530290 - DNA, 103 bp, Homo sapiens
tcttctcccctgacatctacttttttagagatagagtttctgtcacaggctggcagtgcagtggttgtgatcatagctcatatgtagcctttgcaactccatg

SEQ ID NO: 530291 - DNA, 327 bp, Homo sapiens
cagccctgatggcaggtcacgaagactccaatggctgcatcaactacgaagcttctgtcaagcaccatcatgtctctctcgaatggagctctcacagaacaagcatagtataggaagactggctggcaacttattataatcacacccatgacaaactctccaggtctgtttaccatcattcaggaccacaaagcaatctggacggctcacgactgagcaactccctgcatttttatacatctacagataatctactgacattgaattcataccacacaaacaaagtgtcttgctgctcacgatgagacgaataaacttattgaccac

SEQ ID NO: 530292 - DNA, 564 bp, Homo sapiens
  misc_feature (90)..(90): n is a, c, g, or t
cattttttatggtgagcatcaaaagccgggaaggttgatgttgaacagcacacttaagcaagttattccatggagctgactctcatcgantatgatatggcgcattatcatccttgtaaggtagcagcggccgcttcctgtttgtctcagagggttctaggccaaggaaaatggaacttaaagcagcagtgtgccacgggatacacagagaatgaagttttccaattcctgcagcacatggccaagaatgtggtgaaagtaaatgaaaagttaactccattcttcgccttcaagaataagaaggcaagcagcaaactcctgaagatgggcatgatccctcagctgaactcaaaagcggtgaaagaccttgcctccccattgatagtaaggtcttaggttgccgtggcccctggggaagtgtgcttccttgtgcccttttttttatgggtttggaactccccatttggcacatagtcctcgggtttatttcatgaaacttcttctcagaccagttttttaaacaaaaattgaggaaaaataaagcgattggtttttcttaaggta

SEQ ID NO: 530293 - DNA, 142 bp, Homo sapiens
aaggcagttaatacatgactcagcagatgctgtagcattcgctgcatgggtaaattgagaatagaaattggcccctaggaaaggcagacacctctatgcgtagcctcacgaaaagtgggaataagccttcggaaaagaaatt

SEQ ID NO: 530294 - DNA, 1586 bp, Homo sapiens
  misc_feature (29)..(29): n is a, c, g, or t
  misc_feature (317)..(318): n is a, c, g, or t
  misc_feature (320)..(320): n is a, c, g, or t
  misc_feature (322)..(322): n is a, c, g, or t
  misc_feature (328)..(331): n is a, c, g, or t
  misc_feature (333)..(334): n is a, c, g, or t
  misc_feature (341)..(341): n is a, c, g, or t
  misc_feature (1151)..(1151): n is a, c, g, or t
  misc_feature (1210)..(1210): n is a, c, g, or t
  misc_feature (1229)..(1229): n is a, c, g, or t
  misc_feature (1353)..(1353): n is a, c, g, or t
  misc_feature (1439)..(1439): n is a, c, g, or t
  misc_feature (1441)..(1441): n is a, c, g, or t
  misc_feature (1448)..(1448): n is a, c, g, or t
  misc_feature (1459)..(1459): n is a, c, g, or t
aatggacacagaaattggcccgtggtatnactgagactgcaatagaaagattttctgacctgtcatcggggaccaccattatgacacacggacactttgctcaagaacccactgattggaccacatcgaataccgagatgtgcgaggtggggcaggtgtgtcaggagacgctgctgctcctagatgtagaactcacatcaaccctggtggggacaaaaggctgcagcactgttggggctcaaaattcccagaagaccaccatccactcagcccctcctggggtgcttgtggcctcctatacccacttctgctcctcnnancngtgcannnntnncagcagnagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcagccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatccaaagcctgcccttcattggtctggttcacgtctccaaaccagcttggatggtagcanagacttcagggtgctccagccaaacatatttgggcatcaccatgacctgggaggggaanatgcactgagacgtatgancttccagcctagcagccagggccctagcacaaacaggaggctcgccccatctgagcaactgcaggagaggttagtacagtcatgcattgcttaacgacagggacgtgtcgttagaaatgtgtcnttaggtgattttatgaccataggaacattgtagcgtgcacttacaccaacccagatggtacagcccaatacacacccaggatggangntagagtngactgctcctnggctacaagcctgcagtgcatgttatggtgtgaatactgcaggcaatcttaacaccacggcaagtatttggcatctacacacatctaaacatagaaaaggtacagcataaatacactattgtcatct

SEQ ID NO: 530295 - DNA, 1004 bp, Homo sapiens
  misc_feature (29)..(29): n is a, c, g, or t
  misc_feature (317)..(318): n is a, c, g, or t
  misc_feature (320)..(320): n is a, c, g, or t
  misc_feature (322)..(322): n is a, c, g, or t
  misc_feature (328)..(331): n is a, c, g, or t
  misc_feature (333)..(334): n is a, c, g, or t
  misc_feature (341)..(341): n is a, c, g, or t
aatggacacagaaattggcccgtggtatnactgagactgcaatagaaagattttctgacctgtcatcggggaccaccattatgacacacggacactttgctcaagaacccactgattggaccacatcgaataccgagatgtgcgaggtggggcaggtgtgtcaggagacgctgctgctcctagatgtagaactcacatcaaccctggtggggacaaaaggctgcagcactgttggggctcaaaattcccagaagaccaccatccactcagcccctcctggggtgcttgtggcctcctatacccacttctgctcctcnnancngtgcannnntnncagcagnagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcagccggacttgccctatgggagaggggacgctggaggagtggctgcatgtatctgataatacagaccctgtcctttctccca

SEQ ID NO: 530296 - DNA, 1286 bp, Homo sapiens
agcggcacagctgatggtctggcagctgtgcacatgctgaggtctggcagctgtgcagcgaggtcggcagctggctgcgctgcttgtgctcttcctgcgagactctgaatcgatggctgaaccactgtgctcagcgtatggcagaccgtcgtgggctctgtgctgctggaaaagctggttgctcaaagagggaagacatgactaaagttggaattcgagaccaggcgaggaggtggatgtgacccccactgttcgacaccatggtgcctgctgggatgtgaccatgctgctggggcaatctacgctttacgtgttatttgaaaaaagccagtacatggcaaatcccatgacaagcgtgacgcaagtcaaaggcaaggatcatcaaaggggagagatgtcatcggcagcatgatctcaagtcccggtgcatacatgtgaacaaaacaagtgccaccattacgagtacttcatcgaagattcgcttcccatgttgtatcgtggggactacttacaagcggttccgatgcaaaacttcaaacgcctgtttgactactttgggataccccaaaaagaagaagtgggatgttgcatgatccaagagagggggcctggatatgaatcatacgagtgaactaacattgaatgttgtccaggtgccatggcctgcattgggatggcaccaatgttggcggaggaccattccaggaaagctggatatacgggaacagacattgtagcgcgcgaggcagctccagtggacggtgtatgtggatactgataacgacgacaaataaccttaaggagcacggttcttatcgaaaagtggtgggtagaggagatgaaagcttgattgaacgtgttgactacgatgtttccacagagccaggatttgatagatgtttccagggtacatgtcccttcgatcaacaagggtggtgtctcacacagtgacacgacctgtcccacgggagaacttctgtgacgaattacccaaccaagattccagacacagacccaacacgccaatgcggggtgacaccggagtaaatgatttggatagagacaaaagacacaaattggtggggccgaaaagaaaaaaagatgaataaaacacaggtgtagccaaaaaaggaggtaaacacaagggagattttagacaccaagtgtgggtggtgtgaaagatgagaccagactattcgtgatgagacagagaagatagatagagtgagagaagaactcaagacatggaagaagatctgtcctaaataacgtatatgcagcaacat

SEQ ID NO: 530297 - DNA, 317 bp, Homo sapiens
ttgttccacttatcgcagtttatgttgacttagagctagttggttacatacatatttgattatccccacgatcattgaaattcatttaaaaatctatcttatatattgacaaattgtagttgtagatacatgtggcaaacaaagtgttgttaggatttttttaatataatgtggaatgattaagttatttaaaatgtatgtcacgtcaaatatgtaactgtcatggtggtgagaacattagaaatgtgatctcttagcagtactgaaatgtacagtactcagttatttttattcagcatgctgcactatgcatttca

SEQ ID NO: 530298 - DNA, 270 bp, Homo sapiens
agagcagagtactagctggtgtataccatgatggagagcaagcaattaagtttaaacagcaagaataaaacctttaaaactatgtagggacaaatttaactctgctgtctttcatagttcccaagattatttctattttgtaaacaagctctatctttgagttttatattgatactcatatgaataatttattgagtgctttctatttaccggacactgtactaggtgtcttctgtacattcccattcaatataccacggtgctataacg

SEQ ID NO: 530299 - DNA, 589 bp, Homo sapiens
tcataggccgtactagggatagagagtggagctcgggctgtcactaggtgacgggaaacccgatgctaaaggactagcaagcggggagggatggtggataccagtgaactcacaggtcgacctctttgccatagcctgggtgggtttcatccatggagcattaaaggatctctggcgctagataccctgggttcccacacaactctggggagagaggaccaagattgaggggatgccaccagcccctctagggcccttagcactggatctctgctggagcctcttcaacgctgcccaggaataacagtgttcccatcttccttctgtctgccttctgccaagtctcctgctgaggcattatccctgcgcaaaaggatggatcaccatttggctcttggtggccttcctaggaaaacctgggttatggattgattccaaggtccttgattccaccttgccattggaaggtgaaaatcaggataagcaaagaaaactctccctggaggaaagaaatcgatcggcgaggaacaattcggggttgttgccgactgcgtgcatgcgaggaggacctcctagaggattcacaagc

SEQ ID NO: 530300 - DNA, 436 bp, Homo sapiens
  misc_feature (10)..(10): n is a, c, g, or t
  misc_feature (12)..(12): n is a, c, g, or t
  misc_feature (21)..(21): n is a, c, g, or t
  misc_feature (419)..(419): n is a, c, g, or t
gcctcgcganangggagaggngacagttggcaaagatctgagagtagcctctaggagctgtgagtgatccttggctgacatccaacaaaaagatggagacctcaggcctacaaccacagggaaatgaattctaccaatgacctgaataagatgaaagagcaccccaagcctcagatgagagcatagtccctgccaacacctggcttgtagcctggccagactctgaacagagagccttgcaatgccatgctagattcctgacccataggaactatacttctcccctgggaccttgttcccagggtccgtgtggaagctggaacactccgcatgatctccctggccaccataggcaagctattgaagtttctttacacatgcaggttggcaggacattacagttttgtttccttttttgnaggcacctacggtagga

SEQ ID NO: 530301 - DNA, 640 bp, Homo sapiens
atctggcccaatgtccatactatattaacatgtaaaggtgcttatgaaacagtattgtggagtgtgattcacctgtgttgcttcttaaggaagtacgactctacattaaaaaatattgaagggaaacaaaataccaaaatgcgatcgcctggattcctaatgtccatcctgcttccgcctttgggctgatggtgtataagcagtggccaactccacagctttacattttctcagtgatcctatgctctaagacatttgtgaggtgacttgtcttcacaaacagatcgtttctatgtaccgtgtctactctctttcgtggattacaaataacatccattcctgatgtttctggcacaatactttcaccgctgtatcctacaactaccatccatctctactttgaccaagactacctttgacaccagcggcacagacacccagtctcacacaccagcatctcttggcaacacccacaacaaccaaacatctaattcaataacagctctgcccccgccaccgtgcctgtcacactcactttcccaccccccgcacccggcctgcagcgcctaacccaccatgaccattcacttgccacccaagagttcacgcacacacggtcgctctgagacccactccacca

SEQ ID NO: 530302 - DNA, 515 bp, Homo sapiens
tagacttgggcgtgagctaggtcagagttaaacaacctgccattgatgaaacccctctctgctgaaatacaaaattagcttgcattgtgacgtgtcctcagccttccaagtagctgggttacagtgcccaccaccatgcccagcgaatattttgtatttttttttttagtagagatggagttcaccatgtgggccaggctggtctcgaactcctgaccttgtgatttgcccacttcggcctcccaaagtgttgggactacaggtgtgatccatcacacccggccaacttttctttttttttttttttaggagacagggtcttgctctgttttccaggttggtctcaattcctgggcccaagcagttctcccacctgggcctgccaaggtgctagtattataggcgtgagccactgcgcccagccctttatagtttttttcttttttttgagatgaagtttccctctgtcaccattgcactccaacctgggtgacagagagagactccgtttaatt

SEQ ID NO: 530303 - DNA, 454 bp, Homo sapiens
tagaaggatacactctgcacaaacgccaaggttggagagtatgtagttaactttaataacaagaagtgccgcaaccagactaatagaatgaaactacacccacatgatgtagtgctatgtagcatcaagacaattcggagttaaaccaatgatgaatttcaacaggagatggactttgaatagaagtactgagaataaaaagaggtttcccgaatacataaaacacatgttgaattacatttatatccacttacatacattctcttgctggtacccgaagataaagactcatcgcataaatacttatgtgatcacataaacacactggtgctggtatggagcatgagtctggaacagcgaaggccagtgaggaggctgctgtggtcttcctggtgagcaaagcaaggtagaggattggatatgagggaagactcaaaataggatgctgaaaaaa

SEQ ID NO: 530304 - DNA, 524 bp, Homo sapiens
  misc_feature (481)..(481): n is a, c, g, or t
caggtccctctttcctggacctccaaagcattttttttgagacacggcttcactctgtcacccaggcaggagtgcagtggtataatcacagctcaccgcagacttcacctcccagggctctggttatcctcccacctcagcctcctgagtagctgggaccacagcggggcaccaccatgcctgatatttgtttttttttttttttttttggaaagggagtctggctcggtcacccggggggtcgtgatctcagctcattacaagctcggcctccggggttcacgccattctccggcctcagcctccgcgattagcggggactacgggcgccagccaattcaccgggctaatttttggtattttaagtagagagggggttcctcggtgtaagccgggagggtctggatctcttgacctcatgatcggccggcctgggcctcccaaggtgcggtgattacggacatgagccacctctttgggnccggggaacctattaatcagatgttggactttttgaacccatc

SEQ ID NO: 530305 - DNA, 654 bp, Homo sapiens
  misc_feature (424)..(424): n is a, c, g, or t
  misc_feature (606)..(606): n is a, c, g, or t
atctccaccttcctggcggccatataatataatcagccttaccagtaattaaaccaatcgaaactggaccgaatgaattagaatcagctgaatgttcagtattatcaccttccacccagcagtgtccctgaggaactttaacatactcatttttataaccttttgtacgaattatatcactttcaagtcctacaattcgtttaacgatagtcacatcaggatccatgggagaaattaatgtgacaatatctccttttgaaatactgtaaaaatttgttgaccatctatttaaataaataaaatcggatgattctcaatgtgggttaaattcatgttgcattgatattccttcaactcttgcaatacttgccacattatcaaggaatgtgactcctacaggtaccgctaatgatataaatttggnggacatcaccacactacctatttttacgattaatttaaaccgattaagcttttcaagtaaaatcatcactctgttcattatggcacataaatttcatttatactcataccgaattcagcactagactagaatcctttcaaagtgtttacatatcaaaacctatatacttagataataactangataagaatcattttttaaatagatactgataagagaccacataatat

SEQ ID NO: 530306 - DNA, 162 bp, Homo sapiens
actctcaggatcccctgatatgcttgctttttgtaatttctggtgctttgaaaatctttttggaggtataaaaatctcaaccaaagttatgctcatccaaacaagctgacctttaatttaatttcaccacaactaattcttcagtgcctcatgactgaaacc

SEQ ID NO: 530307 - DNA, 161 bp, Homo sapiens
caaccctgggctcatgcaatcctcccgctttcagcctcccaaagtgctggtggttacagccagtgtgacaccgtgtctggcccttttctttatcataggagaagggttgttagactcccaggaaacgtcacctggaaccaagaatgtgaactcaagtgacc

SEQ ID NO: 530308 - DNA, 159 bp, Homo sapiens
tgggtggatcacctgggttcaggagttggagaccggctgacagacatggtggggcccatctctactaaaaatacaaaattgcgcgggcgtggttggtgcatgcctgtagtcccagctactcaggaggctgacacacaagaattgcttgaacctgggagg

SEQ ID NO: 530309 - DNA, 222 bp, Homo sapiens
tgggttgggagaaaatgaatgttctatacatttccatagagttcacatcctgcatgttaaaatggcagtgagtgctcatgcccgtggccccacatgctccagtgccatccctctacgtggcatgcccacatgtgcccccattttcttctagccagaatctttttctgaacatgcccgggcaaaggaaaactgtgattcacattgcttgatttttgttcactg

SEQ ID NO: 530310 - DNA, 315 bp, Homo sapiens
  misc_feature (293)..(293): n is a, c, g, or t
ctgttgattgatgtttggaaacattatctcagtgaccctgctctctcctctacacatgcgcacgctaacacacacacacacacacacacacaatgacacatggtggtctggtctaatatagtgtgtctgaattcagagggcagacattaacagccaagttttgttttttttcgagagagagtctcactctgagtgcccagtgctggagtgccgtggcaccaatcttggctctagtgcaactctctgccatccgtggattcaacgcaattcactctgcctcagccctcctgagnatcaaatattcaacgccgtcag

SEQ ID NO: 530311 - DNA, 351 bp, Homo sapiens
  misc_feature (95)..(95): n is a, c, g, or t
  misc_feature (143)..(143): n is a, c, g, or t
  misc_feature (191)..(191): n is a, c, g, or t
  misc_feature (194)..(194): n is a, c, g, or t
  misc_feature (209)..(209): n is a, c, g, or t
  misc_feature (256)..(256): n is a, c, g, or t
  misc_feature (259)..(259): n is a, c, g, or t
  misc_feature (261)..(261): n is a, c, g, or t
tccttcagctggtgaaagaataaacaaactacggtacatatataatgaaatactatacgacaataaagaggaacagacaactgatatatgtagcnaaatgcatgaatctcaaatgcattatgctaggtgaaggaaggcaaccnaaaaaactatatactacatgattccatttgtgtgataatctgaaaaangcnaaactgtagtacagnaaacgaccgtgctgccgggactggagtcgaggagtatctgactacanaangnaggaggagatttcggaggttgatggactgtctatatcttgattgcaatggtttacatagttataggcattcgccaaacctctgagggttg

SEQ ID NO: 530312 - DNA, 203 bp, Homo sapiens
agcaagtcatctttctccttgtcttgcaggcataatacatgacactactgtatgtgtcctcagatcaatttaatgatactatctttccaaacttagttcgatattaaatgtattattgacctgagaccttaatgacaaatcactgctattagacaattgaagtgttccatttcacttcgtaattccaaataatcatcagttat

SEQ ID NO: 530313 - DNA, 340 bp, Homo sapiens
aacaacctcatcaaaactactttctggtcaagagagaagcaataattattattaacattattgacggtcaataaacttgattgcattatgggccagcactattaagggagccttatcagttgtgagtgaggaccagtcgttgtttgagtgttcctacggacgccacactggctaagacagagatgaccgcgtcctcctccagcgacttttggcagacttccaagatgagccacgcgtcctagcaggattggctgtttcaccccagccaggtcacatcaaatggatgtaacctggccaggtgatggctagggactttctgatgatgcagttggccaagggg

SEQ ID NO: 530314 - DNA, 692 bp, Homo sapiens
  misc_feature (291)..(291): n is a, c, g, or t
  misc_feature (332)..(332): n is a, c, g, or t
  misc_feature (365)..(365): n is a, c, g, or t
  misc_feature (398)..(398): n is a, c, g, or t
  misc_feature (408)..(409): n is a, c, g, or t
  misc_feature (412)..(412): n is a, c, g, or t
  misc_feature (418)..(419): n is a, c, g, or t
  misc_feature (426)..(426): n is a, c, g, or t
  misc_feature (444)..(444): n is a, c, g, or t
  misc_feature (449)..(449): n is a, c, g, or t
  misc_feature (471)..(471): n is a, c, g, or t
  misc_feature (517)..(517): n is a, c, g, or t
  misc_feature (525)..(525): n is a, c, g, or t
  misc_feature (551)..(551): n is a, c, g, or t
  misc_feature (584)..(585): n is a, c, g, or t
  misc_feature (604)..(604): n is a, c, g, or t
  misc_feature (619)..(620): n is a, c, g, or t
  misc_feature (632)..(632): n is a, c, g, or t
  misc_feature (635)..(635): n is a, c, g, or t
  misc_feature (666)..(666): n is a, c, g, or t
  misc_feature (672)..(672): n is a, c, g, or t
tatatacatacacatatatgtatacatatatacacatatatgtatacatatatacacatatatgtatacatatatatatattctacagtaaaacgtagacgtcctcgtccttggcattttcactgttctgtacaaggctgcttgtttttttattgccaaagtcaaataaacgggagactgtcatgctcatgcatgaatagaatttagtcaaataaaaaatttggtcattggtactgactttctctctctctctctctctcttttttttttggacagagtctcgcactggtngcctggggctggaatgcagtggtgcgatctcggctcactgnaacctccgcctcccgggttcaagtgattctccngcctcagcctcccaagtaggtgggattacaggncgcccgccanncangcccanntaatttnggtattttagtagagatnggggnttcactatgtgggccaggcggntctcgaactcctgacctcgtgatgggcccacctcagctcccaaagngcggtatnacagatgtgagccaccgacccagccngagtttctcttctctcttttaaactttattttnngaaaaacccggtagacttntggggggagcatttnngtggataatttncantgatctaagctgagtgatttttaaaagaatngaatgnggttctcaccagtatatgtc

SEQ ID NO: 530315 - DNA, 1010 bp, Homo sapiens
  misc_feature (1010)..(1010): n is a, c, g, or t
ggcttcagctgtggagagaggacctgctggaaggagacgactgatgacatgcccagagtggaatgtggaatgtggaaacatgtccatgcgggtgagccagtgggtgcacgccatggaatgggacagggtgggtggagctggggtggacagtggtgaactgtggggtcctggatggacgccccaggcctcttggccagtggcctccctgatcatgctcccgtggccactacccctggcctcctcggcctcaccttgctcttcgtgggccctcacttccctgttcctctggtactgctaccggctgtggctcccaagacatgcatgtgccctaggggctgggagcctgagctagggcggtgttctgtggtgtggcctgtgggatgctcgtgagtgcctggtctgggccaagcccatggtgtggtcctggggatcccggggaaggacctaggacggaatggcctaagtgagccggcggcttcgggcctactgcaaggcgctactcctgtggctgggatggggtacgagtgagtgccggtcacgctcaagtggtggttggcaccagtgccctgggacgacggtccagagagtcctaaggtatacaaacgcccaggcatgcgtatctacacttacccgagaacctggcttttcaagtccaccatttagagagaccggcgggtaacggcacctagaggaagtcgacgttgcaatgtaccgtggacgaggcaggattatcccatgacaattattgcagggaaactacgaggagtgtgacgcctgggacattctccaggggaactacctccatacagccatcaagtgggattggacagcaccagcatgggtccgtccacgagatgcaaaaaaaagctccttgctagaaactaagcaatgcctaggtgaaacccaagctaaagtagacgacgtgagcatggaggagccatataggggaacctagacgggggagatcagacgattatagacgtagacagaagcatggaagataggaagcn

SEQ ID NO: 530316 - DNA, 141 bp, Homo sapiens
  misc_feature (111)..(111): n is a, c, g, or t
  misc_feature (134)..(134): n is a, c, g, or t
ttcgacgacaggtgtgggaggccactcactgccaagtatggcacaggctggagcagccaggagatggctaaaatgtctggatccttggtcctagtgttatgttccagtctngccacctgtgctcaggatgcagncctggga

SEQ ID NO: 530317 - DNA, 138 bp, Homo sapiens
cccctcacccacagaggttttgtcttagttgttttgaaaaatcataaacgtctctgctcctctcacctgaaccactcttactatctacatccctaatgtggatagtattacacatattaaatgtgtacctcgtcccat

SEQ ID NO: 530318 - DNA, 248 bp, Homo sapiens
ctgaggattccaacgcttacgaggtcaggagattgggatcatcctggctaacacggtgaaaccctgtctctactaaaaatacaaaaaattagctgggtgtggtggcatgtgcctgtagtcccagctactcaggaggccgagttgggaaaatctcttgagcctgcaagatacgggttgcagtgagctgtgatcacgccactgcactctggccttctggcctcggtgacagagcaagaccctctcttcct

SEQ ID NO: 530319 - DNA, 414 bp, Homo sapiens
  misc_feature (187)..(187): n is a, c, g, or t
  misc_feature (241)..(241): n is a, c, g, or t
  misc_feature (311)..(311): n is a, c, g, or t
gtcgacggcctacgcgccccaggcaaattccaagcaggcaatcttaggggaacagagacgaggagaagatgtgaagacttccaagaattgggttgttggcaagaacaaccacaattctataaccaggaacacggcaaagctgggacgggaagacagaggaagctgcaaccatgacaggtgaccctgnaggtgggcaggtgatcagcaaggtcggcagagcaaggggcttacgcagaagganctggcacgaaaatcatgagaagcacaggtgatcgcggactatgagagcggacgggccatacccaaataancaggtgcttggcacaatccgagcggggcatttgggctcaagctccggggcaaaggacatttggaaagcccatcgaggaagggggctacggggggaaatgaaca

SEQ ID NO: 530320 - DNA, 403 bp, Homo sapiens
  misc_feature (23)..(23): n is a, c, g, or t
  misc_feature (30)..(30): n is a, c, g, or t
  misc_feature (398)..(398): n is a, c, g, or t
atttattcccccctgggacagancccagancttaactttattagtaaactgtaacttttttagaagtaaagaaaaaaaaggttacctacatcctagttaaattcacttccgattggttgaaacacaagggaggggctgggccgggtggctcacaccctgtaatcggagcactttgggaggccaaggcaggtggatcacttgaggcccaggagttcgagaccagcctggccaacatggtgaaaccttgtctctactaaaatacagaaattagctgggcatggtggcacatgcttgtaatcccagctacttgggaggctgaggcaggagaatcgtttgaacccgggaggcagaggtttcagtgagctgagattatgccactgcacttcagcctgggcaancaaag

SEQ ID NO: 530321 - DNA, 352 bp, Homo sapiens
ccccctccccgggtaaaagcaattcgcgtgcctcaacctcccgagtagctgggattacaggcatgcaccactatgccccgttaatttttgtatttttagaagagacggggtttcaccatgttggccaggctggtcttgaactcctggcctcaagcaatccgcctgcctgggcctcccaaagtactgggattacaggcatgagccactgtgcccggctgccaatttactttttatatgacacttaaaaactgggagactaaactgggtgtggtgggtgtacctctaaccccagatccttggaaggctgtggtggaaggatcacttgagcccaggagtttgagaccaacctggg

SEQ ID NO: 530322 - DNA, 1037 bp, Homo sapiens
ggcttgcgaaggcacagattccccgatccactagactcacgacgcagtatgcaccagcaggcagtccgacatcgaggacgtcctccgggcactcccacgaccaggagttaaactttgggatgtgcccggtgcatgttggtaccacaaggacttgagaggccgaagatccaccccttgaaaaatgagagaacagacaaatcgcaggaaaatctgggaaatccatcaaaaaatgaggataacgtgcaaaagcgcgcctccacagttcccggctctcccggtgccgagcggcggcgttctgttctttcatcgtttactctgccttttcgtggcgtccgtcgtctcattcgtcatcccgtgtccagaccggccggcgtccacagcgaatgtggccggctagactacagtgccgctgctcactctatgacttcctggctgtgcgcctgactactacccggggacacggatccaagatgtcctttcccctttataaaaacaccaacagcagcaacaatttccagccgatcctgtgtggacgcaaggctcaatcctctccctgcacctatagcagctgcctgtgtcagggggacaaccggcagcacgctcctgcggagagacctgtggcccaagacggtggccctcgtgcagctgtgctgagccaccagcaaagaggcagagacgcacatactgcatgcatcatgccgcgcacacccagcacctcccatcgacacaccttgcccacaccgcgacccctgctcgaccaacgcagcctctctccaccggcactgcctcaacccgcacccccacgcagccgcgcccgctgcgtgcccgccacgcacccccaaccggccggcctcaaacccaggacccgccagacagccaaccgcccacccaaccgaagaacgaacaccacaggcccaacagcaccaccccgcaccacaacggcccccaccaaggaaggaggacaaccacaacccgcccaacccaccggcacaccgcacacacgcacccaagaccaaacccaagacacacacacacga

SEQ ID NO: 530323 - DNA, 274 bp, Homo sapiens
  misc_feature (22)..(22): n is a, c, g, or t
  misc_feature (51)..(51): n is a, c, g, or t
  misc_feature (113)..(113): n is a, c, g, or t
  misc_feature (164)..(164): n is a, c, g, or t
  misc_feature (173)..(173): n is a, c, g, or t
  misc_feature (191)..(191): n is a, c, g, or t
  misc_feature (194)..(194): n is a, c, g, or t
  misc_feature (216)..(216): n is a, c, g, or t
  misc_feature (235)..(235): n is a, c, g, or t
  misc_feature (246)..(246): n is a, c, g, or t
  misc_feature (259)..(259): n is a, c, g, or t
  misc_feature (272)..(272): n is a, c, g, or t
cattcacgtcataagtttattnacaaacatatctagtatggcatatgagtnctagtttgacccacttccagaggctgcacctcttaaaatgctcttcatatctgttaaatggnggaactgaaacatccttatgttttaagcagttggtgtcttacgagtttttnttttttttntttttttttttttttaanttnttcaacactgacattttatttnctgaagttttatcattttnacaaaacaaancaaaatgaacccncgggccgtgactncc

SEQ ID NO: 530324 - DNA, 1098 bp, Homo sapiens
ctcctcctgctcctcctcctccatccatccaaaccatcctcctccttcatcactcctcctcccggtctgagggcgaggagacatccgagtcaatgaccctgggtgctccgaggctcttcttagcagccgcgcagcagccgcggcgacgtcactgtcctctcggcctggcacacagcgctccggccgccgaatgcccgtggacgcgcatctcttcccagagttcctgcttcctgggccagaccaaagccgcgaggagaacgcctcagggatcttgacctgctgtgagtgccttgaagaggtgagccgtgggcacgatcaaagagacacctaggctcaaggaccaatcaaggagtatggctgcccctcccaaaagctacccaaccgtgtcaggaacccgaccaccaagagcaggagccctacactgggaaggagaaccaacatgcagcagaccacgaaaaacccacatctgacaacaggagcccccgaggacaggaggaggcatcccaagggggagcatccagacatggcctatagggcccagagggccacatgacccaatagcccagcctgcacacatgatacaccccaggctagaccataggcagaccaagcaaacacgtagcgcaacatacacataacataggcggcatccgccaaacaaacggagcccactagcaccgctgggcccaagcattcattgcgtcgagacaccctggatgcgcatccaaggaccctagctgcccgacccagatgaacgccacttaactacctcgcagcccgacacagagctccctgcggcccacagctcccggcgcgcccacccagcaaaccccctaggagaatggagccaggcacccgaccacgcaggccaggcgagccagcaacgccgcacaaggcgcgatgacgatgcgacggcagcggagacgaaagcaacgccatgacccacgaaaccacgaggcgggaacgaccatgaggcgacacacgagccggcaatagggcgccaagcagggaggccagccaccccgcaagcgcccaacaaaggcgagcggtgcccacagtacgcccaaccacacgacccccacccggataccacaagcc

SEQ ID NO: 530325 - DNA, 110 bp, Homo sapiens
actaagagtaggacgccgcgcggatttcttccggcaagcgccgggggcacgacaggccccgcccgccagatcgcctgccgcaagctggattccttcattgacacctcttg

SEQ ID NO: 530326 - DNA, 128 bp, Homo sapiens
  misc_feature (40)..(40): n is a, c, g, or t
ggggggggcccccccccccaaaaaatcccccggggggaantttcgccccccccccccccccccccaaaaaattttggggtggggggggcccaaaaaaatggttcccctttaaaagggggttcccccca

SEQ ID NO: 530327 - DNA, 308 bp, Homo sapiens
gccgtgccctgtccctgaccaagacccccgccatcgtgtgcgccccgtggccccctcatgcatgcccgcctctctgcatggtctcttgggagaagagagataacgtccccctccccgccccagccccttttttctgttggtttagcacaaatacgtacccccactccaccccccgcacctccagacttcacccacagtcgatgtaattgttttataactgtttaatcctattcgatggaaaccatgcttctgtcgttttatactttgctaggtagactttattatccccctactatgccctcattttt

SEQ ID NO: 530328 - DNA, 327 bp, Homo sapiens
cacctcttatcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtgtggagcttcggcgtgtgcatgcacacgccgagggtccagactctactaaaaatacaaaaattagcaggttgtggtgagccgagatagcgtcattgcactgcagcctgtgtgacaaaagtgaaactc

SEQ ID NO: 530329 - DNA, 1232 bp, Homo sapiens
  misc_feature (254)..(254): n is a, c, g, or t
  misc_feature (558)..(558): n is a, c, g, or t
  misc_feature (982)..(982): n is a, c, g, or t
ggagagaactagtctgagttttttgtatggttattttttttgtgggaataaaaaaaaatttattgggggccctaagaatatatttttttttctcttgcaaagtttgggttcccgggaaaactgtcacagtcgggggggcaggcattggaagacccatctttgggggccagaccggggggacattcttctggggagatggtgtgggaggggcttgccagattgtggctggtgtgggttgcgccatctctccacanaaagggtatggctcacaaagggattacgatgggccaacacccgcgtaaactcctgtggggcacagaaatgttcccctctctttggggctcttatatatattgtgggtggtgtaaccgccgcgggcacaagctcttaacaaaaatgggtgtcttggtccatatatcgcggacgcaactctccgagagggccacacaaacacaacacacaaggtctctctgcgtgggcgcgtgagagagagagagaataaagctctctctctgtgagagagccccgagagagggggggcaaggtcttacacacacncgggggtctctcctctagggggccctcacagggagcggtggggcggagagagaaacacaccggggggggcgacatatcgagtatcccccttgtgagtagtgccccgtgggggcacagagtttgtgtgacaccagaaggaggggtctctcccagaggaggcttatttcatctctctctcacagagaggcgagagcaacagaagagagagtggtgttccccctctcagaggggctgttgtgtgtgtcgccccaccacagaggggggagaggcaccacattgtgtggcccccaagagtggtgttgagaagacactgtgtggcggcccctatcattctgtgttgagccgggcagaataatatcaacccacacaacagcaggtgtggtgcccccccgtgttgtgttgaacaatagtcgcccccctctcngggggggggggggcaaagtgagacacacagagccctccggggcgcgacgggagtattcttaaaaaaaacgcgcgagaaataacgaggagacaccccacggcgagaaaagagaaccccacccctttggggccaagaaagggggagcagccaccccaagagtggggccccccggggaggacacccagcggggagcaacagaaagagttggtcccccctgtagaacagagaaagtcgcccccctttttaggag

SEQ ID NO: 530330 - DNA, 128 bp, Homo sapiens
gagagacaagcctgcacagtgcccatcactgaaccctgcgaattacgaaagctactacatccatgactgccccgaccccccttgagacaggggcggcatgcagaagcatcccaactgactagagagca

SEQ ID NO: 530331 - DNA, 471 bp, Homo sapiens
aagaacggataggatgatatcgcatcaaatacaggaagattccacatcatttaccaatatgctaatacaccgagagaatatttagacaaattcattcttcctcaggttcatgacaggagagattgtaactacgtttattatctaatttttcagccaaatatttaagaatcaaatgaaattcaacctcatgaaggtgtaagagacgtacacctcatgaaggtgtaagagacgtacacctcatgaaggtgtaagagacgtacacctcatgaaggtgtaagagacgtacacctcatgaaggtgtaagagacgtacacctcatgaaggtgtaagagacgtacacctcatgaaggtgtaagagacgtacacctcatgaaggtgtaagagaactagaaatgttgaaccacacacacagaattggtcctcgataccgcaccaccagccttccctacactccccgcagcactcgagaac

SEQ ID NO: 530332 - DNA, 463 bp, Homo sapiens
  misc_feature (125)..(125): n is a, c, g, or t
  misc_feature (231)..(231): n is a, c, g, or t
  misc_feature (251)..(251): n is a, c, g, or t
ctctcacatccagggtggcggtggttcgcggaccatccgagcgcatcgtcgacgcgatcgatgccgagtgtcggctccggggcggcccaccttcgcccgaaccaccgacacctgctgcgcgcttnctgtccgcggctccgacgacatcacattcgttgcgcgcctgctggattcgttaccccgatcgacgtgcgccggcctcagcgcccgcctgcacatcaccgattctcncgcagcgctccgacaagccntcgctcgctgcgcggctgccggatcccacgatcgcatcgtcgaattcaccggatcgatgttgttggcctccgaaccggtgcaggagtcgttgccgccatggccgcggtgaccatcgccgtgctggccgagtacgaccgcgtccacaccgccgatctggtggcgtcacttcgggccttcctcgaggccaacgggcactgggagaccgcggccc

SEQ ID NO: 530333 - DNA, 288 bp, Homo sapiens
  misc_feature (75)..(75): n is a, c, g, or t
  misc_feature (143)..(143): n is a, c, g, or t
  misc_feature (153)..(153): n is a, c, g, or t
tgagcctgtggtcctagctgctcgggaggctgaggcaggagaatagcctgaacctgggaatcggaggttgcggancaagatcgccccactgcactccagcctggcaatagaccgagactccgtctccaaaaaaaaaaaaaaantacaattttnatttcttttactttttttagtaagttaaatgtatataaaaatggcttcggacaaaaatatctctgagttcttgtgtattttcagtcaaaacttttaaacctgtagaatcaatttaaagtgtttggaaaaaatttt

SEQ ID NO: 530334 - DNA, 417 bp, Homo sapiens
aataacagaaaccaggagtgaagagtccagggagcatgtgtggtaagagaactcgggagcccaccaacatttaagggttaggcacaccaggtgtgatggctcatgcctgtaatcccagcactttgggaggccgaggcgggcgaatcgcttgagcccaggagtttgagaccctcctaggcaacatggtggaaccccgtctctacaaaaaatacagaaattaggccgggcgcggtggcttatgcctgtaatcccagcactttgggatgccgaggcgggcggatcgcgaggtcgggcgatcgagaccattctggctaacacagtgaaaccccgtctctactaaacatacaaaaaattatccgggcgtggtggcacgcgcctgtagtcccagctactcaggaggctgaggtgggaggatcg

SEQ ID NO: 530335 - DNA, 388 bp, Homo sapiens
  misc_feature (334)..(334): n is a, c, g, or t
  misc_feature (338)..(338): n is a, c, g, or t
  misc_feature (358)..(358): n is a, c, g, or t
cgtttcttcgtcaattccggcgaggtgtcccgcaacgagttcgacggtttcgccaaaccgctgttgttgcatgcccgtgcttatgcctgggcaccacggatatttcgcacgcagcgcagcctgtttgaacaggacatttctcgccagcgtggcattcccttcagtatccgcgaactgaatacctccggtgaattggcgccagcggccgagcgcgatgaatacgtaccggtgctgtacagccagacgcagagtttgctgggctcgccgctgggctttgatttgctggccagccctgcgccgtgcagcgctggagcgtgcacaacaaagcggccanttgncggtgtcacagcccatgcanttgtatctgagtatcgacggtaccggctga

SEQ ID NO: 530336 - DNA, 102 bp, Homo sapiens
gtgttgtcgtgtggcgctgttgctggtgtggcggcttgtgttgggctgtcctttgccctgagctcagagccgtcacagatatctgatcctcactgaatcgtc

SEQ ID NO: 530337 - DNA, 278 bp, Homo sapiens
tagatggtgagagcctcaaagtggactgtccactgccttaggctgtgggctcacgtcatacatttcccttcccaaagtctacagaattccccgcattccactttgtaatgtaacccagtgagtgtcattccagttgtggttacaggcccttggaaaacccactctgctcctgctgtgaggtacaggcagccatgtggcatcaactctaaacactctaaatgtatcttctcctgggacatcaaactgctgattaagtaaaactcttttggaaagataaa

SEQ ID NO: 530338 - DNA, 382 bp, Homo sapiens
  misc_feature (4)..(4): n is a, c, g, or t
  misc_feature (24)..(24): n is a, c, g, or t
  misc_feature (68)..(68): n is a, c, g, or t
cacnaaaggaacttaccctatgtnagaaaaaaccacctgtaccccccaaagcctattgaaatacaaancaaaaaattttaaaaaacaatagtgtaactacacaaattaaattacatggattgggctgggtgcagtggcccacgcgtgtaatcccagcactttgggaggctgacatgagcgtatcatgaggtcagcagtttgagactagcctgaccaatatggtgaaaccctgtctctactaaaaatgcaaaaattggctgggcatggtggcacacgcctgtagttccagctactcaggaggctgaggcgggagaattgcttgaacccaggaggcaaagtttgcagtgagccaagattgccccactgcactccagcctgggtg

SEQ ID NO: 530339 - DNA, 684 bp, Homo sapiens
agattaccattagaacatacccacagatagaaactaagatctcaactttttctccaaaagaaaatatggcatttttatctccctgaagtaaacacgaaggaaggggttaaaatcaccagaacagagtttagagaaggtacccatgcaggcccctttctgatgagagtaactagatgaggcccttagatgcacaaaacctggcggtccttgaagatctatatatctttcacataccggtgaccaattagagacctctgctttcagccacacaaagtgtgatgcacttaccaaggcattatccaaaatgtaagacagtgttctctgtatcacctgtaagaaagcgctctctaaatcagctgtgagaagctcccagaaatttgaagccacataagcccgtgagtttcatatacgaaggcttcaacatttgatttgtcttttaccgacgcgtgtacccagaaaattctcaaagtctagggagtgtttcgagaacctcaattttgtttcaccggaccaagggcaaaaattccggcttgaacaaaaagtttactttaagggcaatgcctgaaaggattttgccgccaacaccgcgaaggttaagggcaacccgccaaatggaacaattcccccgacctaagccgggtttggaacacatcctttccccccattgcggtggagtctctctgg

SEQ ID NO: 530340 - DNA, 176 bp, Homo sapiens
aagggggtaggagagtgtggtcaccttcctcatgatcttccggtcgtaaaacatcacttggtctctcttccggaaccggtactgaggagtgggcgtgcttgtcgaacatgtctaagccttcgtgaacatgaaaaggatgaggtcttgctatgttgcccagactagtctcaaactcc

SEQ ID NO: 530341 - DNA, 84 bp, Homo sapiens
ggatttgctggtgcagtacaactaggcttaatagggaaatttttaaattaaaaagtgtttcactggaaaaaaaaacgttagaag

SEQ ID NO: 530342 - DNA, 1108 bp, Homo sapiens
gcaactttgctcccagtgggtctgtgaagcttggcactgtatcgggctacatgtgctcacgtgcttgcgtgaatccgtgagtggacccgagaaggaagagccagattggacagaggatgcgtgctggaggtcggcatcaatcagctttccttgccttttgacatattcgttgcgtgactcgtcacttacgagttgatctgtttcgtgctgggagcgagtttgccgaagtcttcgtagggataagctcctcgcctctggtcgttgcccgttgcgctcgtgagcgtagggttgcgcgttcgtgcgtcctttaaagggggcttgtcccagtggccatccgagtggtcttgcttcgcttcaagtagtgatgagctggggctcagtttcccctctgccgatctcgtccttggccgatgccctggctagcgtcctcgtggttgtctcggtggcctttggagaggtcttggtcataataccatacacatgtgaagtcggtctcactgccgagaattaccttgtatcgtggatatagcatgagcaggggtggtagttaagccacgtcggacatgggcgcggaccgtgtaggccagcggaggagtggatcacaaaatttacccacttatccttaagcaggtcatctagctccaaacaattaaggtcccagggcaacccttgagtgggcaggtggtacctccttccaataccttttcataccctttttccgaggcaacatgtttgcgactaccttaatctgcctggacactcacgtgagtgcctctgtcgcagacctctctgcccacttgggtcccgtcccatctgtgtttgcccctcagctcctctcgggaaagtccattgcagccgtccgcccttttggccctcttggttcctccccatagggggatatgcaaagagttagtcatctctcaatggcaattgaaggtcggtcgccttctgtctcgcgcccgggatatgcgcccaagggtgtgtcgtctggaagcaggcggctcttttaggggccccttggagggagtccccttaagctctatcctatagggtcatctgggggccctacggtgagaagcgcccaccctcccttggttacctctcggcc

SEQ ID NO: 530343 - DNA, 139 bp, Homo sapiens
gaatctctctctttcgcaactcattatcaccagcacaatcaagtgttttaacgaggcacctgcatttcggtccccccggtagatggctacgtgatggttttacagccctgaggagcccaatgatcagcctgatgtggcg

SEQ ID NO: 530344 - DNA, 178 bp, Homo sapiens
ctggatttcatcttgattattggttagagaaaactttgtgccttaagcttaattgtcacactcattacattatgtaatgtttctctccaatctgtattacaatatgtgtagtaagtcctgaacactctctttaatgctttgccacattcgcttacattctgctgagtgtcttctctcc

SEQ ID NO: 530345 - DNA, 296 bp, Homo sapiens
tgatatatcattaaccccatttgaaatggtcgaggttgtctggtattggggtagttattcctggtatcatcgcgaacacaattcaacaacaaggtgttgtaataacattatcatctactatgttattaacatgtattacatatgtcatcttgttcttatacagttttattaattaatcaagaacaaggagcgcgtaattacaatgaaaaagaaaaaacgattaacaccaagcgaatggttgctcaaacaatctaaacgtcataaacgtagaaacactttatacacaagccgcttca

SEQ ID NO: 530346 - DNA, 399 bp, Homo sapiens
ttcttgcgtgcgatatcatgagagctgggtgtgtaggagcacacatggtgatagcccctgcactctggcactcagcacctgactctggcgagggacgggtgggaggcggggatacggtcacctctgtgttgccccagggccatcctgccccttggtggagtggggcataaaagggcagtgctgtgctggcgggagtcggccaggctctccaggggcagggcaggtggccaccttgctgagtccttgcttgccctatgtgctgatgatgaggccaggggtatgagtggtcagatagtccctgctgaggcctttcacagttcacagggagatgagtcgtgactggttacggggtgtcaccacggaaatgagtccctatgttcacgagcccagtggggatat

SEQ ID NO: 530347 - DNA, 110 bp, Homo sapiens
aagatttccgagctctgatggacatgcagtcatacatactagcatttattctctatcagtgctggatttctattcaagaggctatctgattccctaccctattattactt

SEQ ID NO: 530348 - DNA, 101 bp, Homo sapiens
caagatgtcatgccaagtatgcgaggtcaggccatgagtgcagatgcctgcaagaggtgacctctggctcagaccgatggatccgcaagagttggaagtga

SEQ ID NO: 530349 - DNA, 145 bp, Homo sapiens
  misc_feature (120)..(120): n is a, c, g, or t
tgaggtgattagaggatccgtctagcctgccagtgcggtgctgttgaggcgcgtaagagccaaaactaccacctccaccagaagcaacgaggagccccactcccaggtgtcagcgaaggncaagtggaacctgaacttctacctc

SEQ ID NO: 530350 - DNA, 118 bp, Homo sapiens
atccctgaggacactgtggagcagaaggcagaaagcgtgtgcacgaattatagtctcacacggagagccgggatcatgaacatggcggcagggacgctggcgacagctagaaccacgc

SEQ ID NO: 530351 - DNA, 174 bp, Homo sapiens
ggtcgtctcactgcctgctcgcgcggcgccgtgtgctggctctctgccaccttcggctttgtgttgccagctgccattgtgtgtttgcagctgcttgtgtgtttgcgctgccttgtgtgttgccgctgcttgtgtgtagccgctgccttgtgtgtttgccgccgccttgtgtgt

SEQ ID NO: 530352 - DNA, 735 bp, Homo sapiens
gagcggtaccaccactcctatagatcagtgcttttccgcccgtgtccccgcctcccccgagcgccgctccggctgacaccgccgctcgctccgagttttcaggctcgtgctaagctagcgccgtcgtcgtctcccttcagttcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcgaagattacatgacatccatcaaagggaaacttgaagaacagagaccagaaagagtaaaaccttttatgacaggggctggcagaacaaatcaagcacatccttgctaatttcaaaaactaccagttctttattggtgaaaacatgaatccagatggcatggttgctctattggactaccgtgaggatggtgtgaccccatatattgattttctttaaggatggtttagaaatggacaaatgttacaaatgtggcaattatttggatctatcacctgcatctaacggctctgcttgtcatcccacacccag

SEQ ID NO: 530353 - DNA, 369 bp, Homo sapiens
tgtgcgagtctgctgatgtgctgatctgtatgtgaggtagttctctctcttcctaatgggatgtcttcttagctgcctttcctctaactatggacatcaacgatcgagacccatgaacatatgcacagtgcccagccactgcatggggccgatgggtgtggcgaccaggaacacagaggccaatatagtgacaaactttcgagtagtaatgatgatggagcgcgtagtcgaccaccctacatgaccggcatgatgatgaccctctgaccctgggcactggatcagcccaaagagccggatgtcatagatgatggccgtgtacctttgagcaaagttcatgaagtcccagagctccccggtgaacgggat

SEQ ID NO: 530354 - DNA, 217 bp, Homo sapiens
tatgtgcgtgtgtgtggtatgtatgacgtgatagctatgtgtggtatgtgtggtatcgtgtggtgtgtgtggtgtgtgtgtctgtgtgtgttgtgtgggtgtggtgtgccctatgcgtagtatgtgtggtgtgtgtgtggtatgtctgcgtggcgtgtgtacatgtgtgttgtgtgttatgtgcgtgtgtgtgctatgtgctgcatatagctatttg

SEQ ID NO: 530355 - DNA, 648 bp, Homo sapiens
cctgaccacgttgtatcactgaggaagtggtccgggtccatagctgtgagtcgtccaggctcaggcgcgcatgtcgccttcttggtcagctgccagcgtgggcctgggggaacaggctatagaacaataagccgcgctccagcgccttctccagcgtgcggcaatggatcagcgcgtggcacatcatggcgaaagtgccgcgtttgctcggcccttcggcaaaccccaggtattcgtcatccaaccccagccagagcatttgcagcaagcgggcaaattgctctggagcgatgcgggcgcggggttcggtcagcagttccggggtgatgcccacctgctgcaacacccccgagtagtcgaaaccggctcggcgcgcaccgccgagggccgctcgggcgtaatggctggcgatggtacgttcacgcatgcaagggcctcatccatggagtggcggatggtagccatcacccagtggggcgacaaggcggatatccgccaaattgtaggacgagacaggatgagtgggcggaaatccgccactgtgttgcactctccggagtcgcccgtgaaccccaagccctgatgtctaaaggccttcagcgcgtttaagcaaagtggcacgctgtttgcgaataacattcggtgctc

SEQ ID NO: 530356 - DNA, 556 bp, Homo sapiens
caagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgagtatgagggtattagaatacacagaaaattcgtgtcaaatgatttttaaaaatgtgacaagatgatgtgaaaagtttaattccttctctttgctattgatgagcatacatgcatttattggtgtttacatcaacacaaatttgattctaggtgtagaatttttttttggaagtagcagcatccctgttttaaaggatggtgacccatccattggacagggcacatattatcccttccgtccatcctattttgggttacatataaaggtgagaaagttgctccagccaacaagaattgggtaacaccctgcatatcctcccccagctgaatgaaatttgtatactgggaatcctgttgaattccccaggttccaactgtgaat

SEQ ID NO: 530357 - DNA, 945 bp, Homo sapiens
agcggggtcttgctgagcgcgaggcggtggaggctgaggcctgaggcctggggcggggtggcggcctgggctggctgttggcctcgtcgccttcccctgctgggcgccgcgggctccgcgggcggtatcggagtgtcgtgcggcgtcgtggccgacgctgagcacgcgctcttgtcggacgtgacagggccctgtcggaacgagtgatggtgcgtggctcatgggcgcagggagagccctcgggatgtcgggcccgtgacctcatgcagccagctccgtgcgcgtggtcccgggtacgggtaacaggtccatgaaggcgcgaacgggacgtagtaggaacgtcgatctcagcaggacaattgttgcgatactatagctccagtatctagtgcggagtgatgctttgagagccgtatcttgggggcgtagtccatgaccacaagtcgcccaggagtagacttacacaagaggcaacgattgctcatcacgaattaatcccctgggccctgggtgtacgcccacaacttgtgagagaaagcactttgtgactcaaacggaaaggtgatcttctactaggacaatgggaaaccatagatatacacaagcctaggatacacgtagaggaatttgaacaccacagggggaagcagagggaacaacgcagatatttaaaagccattttctacagtagaggcacggcctagtactacataggaaccaaagagcgtcccccaaaaggacaacgtgggatgtcgcgaagtatgacttactatttggagtcctacagtggcgacaccttagggggagagttcactccatgacatactcattggaggcccactatagacagggatcacaatttgggacaaattggcacagagagtacaagcatgattggaacaatgacgaccaacaagagtggaactttcaaaggtgacacccttg

SEQ ID NO: 530358 - DNA, 286 bp, Homo sapiens
caagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatcttgtccttgccaattcctggcaaggaggaccttgctaagcgcattcacaagtcatccaacttcatagtcaagtctgatgtatgcg

SEQ ID NO: 530359 - DNA, 371 bp, Homo sapiens
  misc_feature (30)..(30): n is a, c, g, or t
aaaaaggaggagttttttaaacatttggcncccctaaagggggagttttcccaattggggtttcccaaaatgacaggggggggggcctccaagttttttaaaatccgatttgtccggaaatcccttgcccgggtttttccagtttttaacccaatttaaaaaaaaaccctcgggaattttttcaagggcaaaaagtacaagcccctggcccttgggcctaaaaaaacacgttccatgcccccccggttccacaagcccgaggagaaccttaagaccaaaaaacaccaggggaaggagggggtgtcccccctggggaagtacggggtcaaggccttaggggggctttttcaataaagcccaggggggtgaga

SEQ ID NO: 530360 - DNA, 468 bp, Homo sapiens
  misc_feature (387)..(387): n is a, c, g, or t
  misc_feature (448)..(448): n is a, c, g, or t
  misc_feature (467)..(467): n is a, c, g, or t
tttttaatataactattaaaatataattcaggtaccgtatgatttgcccatttaaagtgaacaaatcaatggtttcagtgcattcacagagctcggcaaccaccatcatgatcaattttaaaacattttcatcaccccaaaaagaaaccctgtatccatgagcaggttcctgccatttcctcctcccactaagccctgacaatctacttttttttgagatagagtatctgtcacaggctggagtgcagtggcgcaatctcggctcactgcaacctccgcctcccgggttcaagcaattctcctgcctccagagtagctggggattacaggggatgtgccaccacacccatctaaattttgtatttttagtaggagggcagggttttntctctttcataggatttgcgtgttctgggacatttcatattaaatggacatcttaggatangtgaccttttgtgactggng

SEQ ID NO: 530361 - DNA, 246 bp, Homo sapiens
aggtcagaaagctgagctcaagtgatccgcccaccttagcctcccaaagtgtggggagccactgtcccggcatattattacttttggagacgaggtcttgctttgttttccaggctggagtacagtggctcaatcatagctcactgcagcctcaaactcctggccttaagcagtcctcctacttcagcctcccagagtgctgagattataggtatgagccactgcacctggcctctctattctcta

SEQ ID NO: 530362 - DNA, 568 bp, Homo sapiens
ctgtatactgcttaaatattgtaatagtctcctgatttcgtagagtcttgttaattcatcgttgctccccagacgtgcctcaattgttgtgtactcgaagtccttgagcacgtgttcttgatcagctacattaattcaatcagtgctcactgatatacttgctggagacctcagaatacacaagtgcctctctccacggtgcattctcgagacttccttgatctccagtggtccctagacatttgaccctattatgatctgacaagcatgtcttcagcaatgtgtaccgaactcgaatacgtaatcgtgtacatatctgtttgcctgatgacacatgtatacctcgacaaaaatgatactattccattaaccctttctatacacagataggcccaagatataattttcctaaaaatatggtgcttatgcatccgtcatctacctcggcataaaaccttcaacttgggatatgatacctgtaaataaggataaacagtacaaaatgctgtggtctaggctccactaccgtcattggtttttgtctacttatctggtattatctaaccac

SEQ ID NO: 530363 - DNA, 662 bp, Homo sapiens
gtgcatggtgactcatacttgttttcccagcactatgagaggccgaggtgggcagatcacctgaggtcaggagtttgagaccagcctggccaacatggtgaaaccccgtctctactaaagatataaaaattagctgcgagtggtggtggctgcctgcaatcccagctactcaagaggctgaggcaggagaattgcttgaacccaggaggcagaggttgcagtgagccgagactgcaccattgcactccagcatgagtgccaacggcgaaaagtctgtcccacaaacacccagcaacagcttttgtgcaatgatctaccattactacacctcccttcccttcattttcgctaagcctttgcaatctggggcatattccatacttagaagcatgtcttaatttggactagtcacattccaagtgctcagtcgctccacccggctcgtggtcactgctctactcgcatagcactagtatgtccaacaatatctgctgcgcctccgcaccaggggctacaaccataaccccagcatcttgccagcttgccccctgaccccttcacgctcctccgactattcctacttcccctctcctcaggtcgcctcacaccgacacccccctcttcacctccccccacccccctgaccgccccctccccccccc

SEQ ID NO: 530364 - DNA, 216 bp, Homo sapiens
ggactataggcacataccaccacacccagctaatttttaaaaacatttttagtagagacggcgtttcaccgtattggccaggctggtctcgaacttctgacctcaggtgatccacccgtctcgcctcccaaagtgctgggattacaggcgtgagacactgcacctgggctcttcttggagattttcttgacattctcttttagggtactggctgtg

SEQ ID NO: 530365 - DNA, 227 bp, Homo sapiens
gtatgtcttcagtaagccgtgattttcattctgggcttgtctgtagattttagaccctatgctgcttgaggcaactcatcttaggtggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaa

SEQ ID NO: 530366 - DNA, 355 bp, Homo sapiens
  misc_feature (22)..(22): n is a, c, g, or t
  misc_feature (322)..(322): n is a, c, g, or t
  misc_feature (333)..(333): n is a, c, g, or t
  misc_feature (347)..(347): n is a, c, g, or t
agaactgctaaggtctaagaangcctaactgaaagattggattcacctgctgggtgactcggatgaaggtagttctcctgctaaactctttgagcttagctgctccccacataggtacacgtagagtggatccctcctaggatgtcttggatggtatgttccacatctcctttaaaagaacttccactgcttccctctgagctctgtactcagccacgcccccagcatacttcttcatgccatttcagaactcatccatagaagagcttgactcttccatccctcttgatgagctcaccacctgactcactgtcccagccancatccacccancatcacgaagtcanctcctccc

SEQ ID NO: 530367 - DNA, 199 bp, Homo sapiens
  misc_feature (30)..(30): n is a, c, g, or t
gtccaggaagggtcaaaggcacaccccctncaaaaggaagttgggtgcagctggggctggcatggacttttctttcaaaaattcggtttttaaaaaaaggcaagcccaatgggttcttttttttttccaatgatttgtaaaaaacattttatgactggaaacttttttggacaacactccaataaacattttgatttta

SEQ ID NO: 530368 - DNA, 335 bp, Homo sapiens
aggataagggagacgtgtgttcatcttcactaatgaggatataataaaggccaggcgcgactggcttatgcctataacctccgtgctatgggaggctaaagtgggacgacgagcttgagcctgggggttcaagatcagcctgggcaacaaagcaagacctcatctctataacaaaaaattaaaaattacccaggtgtagtgatgtgagcctatagttctattaacagctactcgggaggctgaggtgggaggattgcttgagcccaggagctagaggcaacagtgagctatgatcgtttacctgcactccagcctgggtaaacagagtaagactc

SEQ ID NO: 530369 - DNA, 123 bp, Homo sapiens
atccatgctatgacatggatgaaccttgcaaacattatgcttagtgaaaaaagccagtctcaaaataccacgtattccatgatcacagtggtgaaatgtcaatggtacacttgaaggatggtg

SEQ ID NO: 530370 - DNA, 891 bp, Homo sapiens
tgtcggcgcggcaagcgatgtgatggcgggaaccaagaggaaccgggtgatggctttgcagtttcagggctgaaggaagtccatgaaagaagcgaaatagatgcggagccgccagattaaaagctgggacgcgaaagcaacccggaggtggctggaagaaggagcggaaccgggattcccaggcccctgtactttgcaatcgtaatcagcgggaacagctctcaaggacacggcactcccttcttttctgccacgagcactgaaacttctttcagaaaccaagacaactttacgtgccagagcactttggcgcacactgttgatgccttcatttctaagagccagtatactaacacagtggcatcggcacggaaataaggcatattccgggtagaatacacgcggacgggtattggcttgacacctggccggaaccggtggtacaatacacagtgccattcataatttggggggaagggggctcaagcaccaacacacacaggggattcctcctcaatacttgttggggttcttcacacattttcaaccctacaacggtgcaccccatccgtggcataaaaatttctcccttttgttccaacacaatatttccataccccttcgcctgacagcttgaaggatgaccttggcaacaccggtggtttgtgaaccgggttcctcgggcccctattgtggttctattagggacccgtgcttttggactgaatcacccaccatttattgccttggttcaaacgacagctcttcagtttcagaatcttaaagtaccaccacgggtattcatcccaaaaaggcaacatttgttggacccccgttgtcactttcccaattgggattacaaggatatggttccggaccttacgatctaga

SEQ ID NO: 530371 - DNA, 157 bp, Homo sapiens
tgatccacataacttgacacggaacaagttacctagggataacaggcaatcctattctagagtcatatcaacaatagggttaacgacctcgatgttggatccaggacattccgatggtgcagccgcttattaaaggttcgtttgttcaacgattaaa

SEQ ID NO: 530372 - DNA, 1095 bp, Homo sapiens
cccccttttttgtcgttgttccccccccctgggccacctcttctatttgtgtggggggcccccccgttttttccagcactttagatttcccccctttccgcaccaaattggggaagaaccctctttttctccctggatattttctaagggggatttcctcctcttgtggctcctctctgtccgcccccttctcaccacggttttgttgtgtcccttttctacatcttattatttggccccccttcctattttgtttgcgcctcccctctttggcacgtcacctgtccccccccccttcgttttttgtgcctcccgaataacagggggtggtatccctcaatatccccccctctggggggttgccccccccccccttttttcgttgtttaatattctccctcttttccccccccctctgtttatctcaccacactcttctatataacgccctcctctgcgcgcgtagatttttttgttttcgactctgtttctctcctctttaggagaccctcttagcacacacttgttttttctccccgcgcctctcctctttgggggcccccacgccctcacttttttatccccctcgttgcaccacccacctctctttaaccccccctctctcccaccacctcctcgggccccccctatatattttctctttttttgtcccacacacccacttttttctcgactcctcttctcccttcgccccctattgtggagggcctccctttcgccctttttgtttttctccctccctctcttcttttccacactatatctcccacttctctctcacacacatatatctcccaccccccacatagcacaaaatatttttcgtcccccctataacgcccactctctcctttttttatacctctcttttcgcccacaaaccctctctctctcttttttccccgtgatcggggggccacccccggtggagacccctttttcccctccttgtgtgcgccagtgtgcgcgctcccggtgctgtattatctttctcccccccttctctttttctctttattatcccccgtttttctccctttattgttacacaccaaaattccaatgggcccttta

SEQ ID NO: 530373 - DNA, 487 bp, Homo sapiens
  misc_feature (241)..(241): n is a, c, g, or t
  misc_feature (286)..(286): n is a, c, g, or t
  misc_feature (322)..(322): n is a, c, g, or t
  misc_feature (342)..(342): n is a, c, g, or t
  misc_feature (373)..(373): n is a, c, g, or t
  misc_feature (375)..(375): n is a, c, g, or t
  misc_feature (380)..(381): n is a, c, g, or t
agtatttagcaactttccatgttttcaatcaggtgggggtgggactagagttaaactgccatttattgatttctgacacaggcacagaatgacctgttttctccaagaggctcaatcttgttttcaagaatcctctctaccatataagatcctgcagacaaataacatctagtctgttgttctaaatgtctgagactagtgaacttttattcagttcaagtttctgttgaggcccaacagncaaagctctgttctagtgactctgaggggaacttggtgatagtanccagtacctgctctgagggcttcaagaggagtctantcctaatagaacctgtgctntctataagtgacagcatcaagagcagggggngncctgnngtggtcactcctgtaatctcagcactttgggaggctgaggcgggcagaggacgaggtcagcagtttgagactagcctgggcaacatggagaaaccccgtctctact

SEQ ID NO: 530374 - DNA, 187 bp, Homo sapiens
tattattaatacttaagtgagcagtggcttaaaattgcagatataagagaacccatacttttacaattctggcataagccgttcatctgtgtaaaaagtagcttcagatgtcactagaattattaaaaagcccaatttaaaaactgcaatataaattgaagtggaatgttttccacacatgtaaact

SEQ ID NO: 530375 - DNA, 797 bp, Homo sapiens
ccatgccattgtggctcggctgggtggggggctctgcgagacacctcacagagatctcgcgtcccgagcgtctcacctagcataatgcgtgctgccacaccgatggaagattcgatggacatggacattgatgccccctgaggccccagaacatatcttttcggattgtgaactaaaggccgacaaacgattatcactttaaggctggataatgatgaaaatgagcaccagttagtcttaagaacggtcagtttaggggctgtgcaaaggatgcgtggcacatgtggaagcttgaggcacatgacacttacgaaggcaggtccaattaaagtagcactggcaacttttgaaacatgtctgtacagccaacggttatccctctgccggcggcttgggaaataacaccaccagtggtcttaaggttgaagtgtggttcagggccagtgcatataagtggacagcaccttagtagctgtggaggaagatgcagagtcagaagattgacgaggaggaggatgtgaaacttcttaagtatatctggaaaaagcggtctgccccttgggagggtggtagcaagggttccacagaaaaaaagtaaaactttgtgctgatgaagatgatgaccgatgatgatgaacgaggatgatgatgaagatgatgatgatgatgatttgatgatgaggaagtggaggaaaaaggggcggtgaagaaatttatagaagaaatccagcaagaatggcaaagtcaattcagagtggaaagtcaaaccttttaaccagataaaggagaacttagaa

SEQ ID NO: 530376 - DNA, 367 bp, Homo sapiens
  misc_feature (357)..(357): n is a, c, g, or t
agcccaggtgcactgctcacacccccacctgcattttgaagtcatattattttttgttttgttttttaagacggtctggctctgtcgcctaagctggagtgtggtggcacgatcacagctcactgcagcctctatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttngagtcatgtt

SEQ ID NO: 530377 - DNA, 109 bp, Homo sapiens
ccttggcacgtggcagcctatacccttaactgaaattgtctttggtccagcctgcagctccctttgcagggtttcccttcttgtagaagggtgaggagggtagagtttg

SEQ ID NO: 530378 - DNA, 82 bp, Homo sapiens
ggtccgactctagaggatccccccaattaaccctcactaaagcactagttcactcccccccccccgctgctggaaatgctga

SEQ ID NO: 530379 - DNA, 1443 bp, Homo sapiens
gtcgttgttgcagataatccgtggcaatcgagctgatgggacttgctgagaccgctcagactcaccgggaacgtttgggaagatctttccagacatctcggagatcagagagacatcagacgtcaggcagatgaggaggactatgaagtacgactggatcgaggagagggcctacagtattgacgaaagattgcagccgactcgccgcagggcgttattaccctgcgatcgacgatgcattgatcgcagaagtgactcacgaggggcgcagtttgtctctgtatcgacgcgtatcgcggtcgtggtgattgctaagtggcgcctacagtgcacgtgatttcccccacaggaaaagagtgccaagtacatctgcatggactcaacagaatagcacttgacagataagctaatgaagaggtcacccaagatgaacctcgtcgatgggttcgcatacgattgaggctgggcaaggcctgagtggctagcgtatctgccttgggttggccctcaatgagttctacagaagaccacatgcaagtaaaggattggctaggagctagccaagcgaaatagaccctctttgtcgagcccgggcgtgactatcggggtaatacggtgggccctacacgactgtgttggtcaatctatgacccgccaagggggtagctatgcatgggggcacttgggcgcctgtaacggggtacgcgcgccccaaatccacacaacatttcctatggctgtgcagcaagacgcgaaagtccttggaaaggtcagtccgtcaccaaaagttggacatggctccgaagcaacgtatattccagtagtacggggtaatggtttacgggttgggaacaccgtgagacatatggggccaaggagggcggctggagaaggccttagagagcctagacaagggacaggccttcgtggtaggggctagcggctttgggggtgacccatactcaacattggttttcggcttgttggctttcccgcaccgtcctttcttcgtggccacgttgggacctttattcgatacttcatctagtgcgccacgcgtcgcgcatggggacaggctcttcccccctttgacccccaagacgtggggggggacattcccgcgccggtcactttcaagcgaggcataattgcccgcgccattcgggcgcaaccccccggcaaagacgccccaacgtcgtgttaccaaaagggaaaggcctatcaaggagggtagggtgggatacccaactaaaatgctctggacgccagcactgggcgactgggctactcgagcaagagaggggagcccccgccgagaaccaccactctgccacgcgacttaggggcccacacaccatgcgaagaagaccacaccgggggacacacatgtgaacgcagagcgcgacacaaagcacgagcgccacacggcagggcacagacgcc

SEQ ID NO: 530380 - DNA, 841 bp, Homo sapiens
cgcccttttttttttgtggtgggtcaattctggggtaaatcagattctggtattcatacaaaaacttggtttttctctgacaaactggacacataaaaacaaatttccaaatgtggacaggaacttaaatttgtggtggagatgccccagggtctgggtgagaactttaaaaaaaagaaaaagatcccagcttttgagtcttcacaaaacacacagtgggattgggggcaagtgaggggtggacagggacagggcccagccaggcgggttagcgtggcagcagttcttctttcatctcttggaaagaccttcatgtggaggggtttccggggatttcaggggtgcccaagaaaaagagtttcaggggctttacaacgtgggtgcaggcttctccattttgtggtatctcctctggggtgagttccaacaagaaagttctctgtacactagcgtgctccaaaagagaggccttcgaggggatacctcgaggtctcccagccttctttagcgcgaaccccttatcacacaaacccgcgggataaagcttccttcgaccttcgggcgggggccaaaaagttctcagtgtttatacttccgcttcataccccaagttatagcgtgggcacttcgggggtccccttcgaagaaaaggggggtgcccaactgtgccgtggaaggggccccccgacaaaaggggtcccaactctcatggggggtcatccaacacaggggacgctctacgcgaacaaagagaagctgagaaccgccaagaattggggggcactcttcttgaagacagggtctctgggccccactcggggcctatagggccaccacgggg

SEQ ID NO: 530381 - DNA, 1865 bp, Homo sapiens
aaaaacatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctatcagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctgaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaaggagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcagaagacagagaatggattccagaccatagcttaagtgaatatgctgataatgcaattgtcttgggtgttctgcagggtgctcagagtccatcatcaagtagaaaacagcaaaagatgggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttc

SEQ ID NO: 530382 - DNA, 812 bp, Homo sapiens
  misc_feature (470)..(471): n is a, c, g, or t
gttaaggagctgggagaataagacagaaaataactacattagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaanngcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttcaaaaatttgcaataaaagaaaaaaagaggaccaaaaaaaa

SEQ ID NO: 530383 - DNA, 249 bp, Homo sapiens
ttcagaggttcccatacaaaaattagctgggtgtggtggcattgtgcctgccgtctcaactactcaggaggctgaggtgggaggatcacttgagcccaggaggttgaggctacaatgagctgtgatcacgccactgcattccagcctgagtgacaaagtgataccctgtctcaaaaaaaaaaaatcgggatggcgatcaacatgcttagggagaaatactaaccatgggtaaggacaccggaaataagg

SEQ ID NO: 530384 - DNA, 799 bp, Homo sapiens
gccacattggcttatattgtctatgcgttcttctggtgtgtggtgttctttaccggtgggtttccgtttgtgcccgcccgtgtttacccccgcttttaacttataggcatgtgccccccccgcgtttttacctaattggtcgaatccaggccttaccggaatctccaggtccaatcgtaaagaagcccccgtcctttatctctaacctcatccagaagccaacggcccaatcatattcagaccggcttcgaaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttc

SEQ ID NO: 530385 - DNA, 2210 bp, Homo sapiens
  misc_feature (1868)..(1869): n is a, c, g, or t
aaaaacatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctatcagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctgaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaaggagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgttgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcagaagacagagaatggattccagaccatagcttaagtgaatatgctgataatgcaattgtcttgggtgttctgcagggtgctcagagtccatcatcaagtagaaaacagcaaaagatgggtcagaaatcacagagaccttcaacagcaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattataagttcaanngcttattcttccaatgatatattatatgtcaaccactaatctatattgcagattatgttagtaaaatatggtgaatttgaagaaataactgttacaactgtgtctataaaacctactatagggcagaacatgattatacttaaagaaatatttcatcgtccaattatattttaaataattatgtcatcaacaagagtgtgcatttgacagccaagtcacactagttagtatcatcaattgaacctataattacactgtttattttctggtttttaacatttatagaagttctggtatcttcaaaaatttgcaataaaagaaaaaaagaggaccaaaaaaaa

SEQ ID NO: 530386 - DNA, 214 bp, Homo sapiens
ggcccgaggacgtatggtttccccaaagccgagttgtgtcacgtggcaggtttacgtcaatagtccctttctttgttcctccatttgcaagtgtttttttggggcagactcccctccacctcatgtacttgctatattgaggatgaagttttttatggtgggcccctcaatatagtgccctgtagtgaatgtaaataaaaacaaaaaatttgga

SEQ ID NO: 530387 - DNA, 101 bp, Homo sapiens
tgtcgcccctctctgctgctccgcccctctctgctgctccgcccctctctgcaatctccgcctcctgggttaaagcgattctcctgcctccgcctcctgag

SEQ ID NO: 530388 - DNA, 399 bp, Homo sapiens
gctccgaccccttataatgtgtgcccagtggcgagaatattataaaagtaatattcataattcttttttattttttttgagacagagtctcactctgtcaccaggctggagtgcggtggcatgatctcaactcactgcaacatctgccttccgggttcaagcaattctcctgcctcagcctcccgagtagctgggactgcagatacacaccaccatgcccaggtaatttttgtattttcagtagagacagggtttcaacatgttggccaggatggtctcaatctcttgacctcgtgatctgcccgccttggcctcccaaggtgctgggattacaggcatgagctaccatgcctggccttctcatgtgttttctgattaaggctcttgacttccaaggct

SEQ ID NO: 530389 - DNA, 242 bp, Homo sapiens
  misc_feature (125)..(125): n is a, c, g, or t
  misc_feature (154)..(154): n is a, c, g, or t
  misc_feature (161)..(161): n is a, c, g, or t
gatcgtagatgttaaccaaatctacaaaatccactactcccccgttatcaacgggatacgttccaagacccccagtggatgcctgaaactggctaatgctgaaccctacatatactatgtttttnctgtacatatatatgataaagtttaaatnataaatnaggtacagtaacaacaataacagtaaaacaacagttataacaatatactgtaataaaagtcatgtgaatgtggtgtttctc

SEQ ID NO: 530390 - DNA, 466 bp, Homo sapiens
  misc_feature (27)..(27): n is a, c, g, or t
  misc_feature (117)..(117): n is a, c, g, or t
  misc_feature (155)..(155): n is a, c, g, or t
  misc_feature (167)..(167): n is a, c, g, or t
  misc_feature (178)..(178): n is a, c, g, or t
  misc_feature (201)..(201): n is a, c, g, or t
  misc_feature (270)..(270): n is a, c, g, or t
  misc_feature (278)..(278): n is a, c, g, or t
  misc_feature (321)..(321): n is a, c, g, or t
  misc_feature (323)..(323): n is a, c, g, or t
  misc_feature (335)..(335): n is a, c, g, or t
  misc_feature (367)..(367): n is a, c, g, or t
  misc_feature (369)..(369): n is a, c, g, or t
  misc_feature (458)..(458): n is a, c, g, or t
aagtatgtgggaaataagggaggaggnggaggtaaaagaggggagaggggagggagcagatggaagaataattaagtataataggagatgaataaggtataaggtaatggagaaggnggtgaggaaggaagaggaagatttgaagaggtgtgttntaggtaagtggnttaaaagaatnaagttggattaattggaatgggnaaaatggggaataaaatggcaaaaaatataatgaaaaatggatataaaattattatttatgatgtgttnaatgatgnatgaaaagagtttaaagatgaaggtgaaaaggtagtatattananagaagatgttgntgaaaaagatgaaagaattattaaaatgatgnanaaaagtataaatgaaatagaagattattaaggagaaaatgggattataaaaaaagtgaagaagggataattattaatagattaaagaantattgata

SEQ ID NO: 530391 - DNA, 255 bp, Homo sapiens
  misc_feature (191)..(191): n is a, c, g, or t
  misc_feature (217)..(217): n is a, c, g, or t
gtgatctagaggatccgtatgatctgtgctcacaaaaaaaaggggttcacaacaggcacaatatggcacaacagcacaataatgaatggcaaatgacaccgggcctctccaggctgggggacagggaccactaggaggagccaggagttcaaaatcagaaagcttgtgcccacttgttcatcaactccagngcaatcttaaccacataaatccaggntttccagaaccatcgtgacttttcaagaagacggccag

SEQ ID NO: 530392 - DNA, 190 bp, Homo sapiens
tagctggtaccggctaaaaagaatctgggctgggagtagtggttcactgtaatcctagcattttgggaggccgaggcgggtggatcacctgaggttgggaattcgagtctagcttggccaatatcatgaaacccggtctctactgaaaatacaaaaattagccaggcgtggtggcatgcacctgtaatcc

SEQ ID NO: 530393 - DNA, 716 bp, Homo sapiens
agcggatggttggatgaacacacatgtgaggggatctgaaccatctacaatcaatccatatgtgaccaatggaggagaagcaggcccaaaagacgaaggaaccctcataagaagatgagcctcagcagaaggagatgcgcgaagcccagtttgtccttaggaggcatgagtcgagagggcagaggctactgactccagttctggttgagaagacagacagtggacaatgccaatgagaaatcagaataacccccagaaagaccaaaagaagctctctgacaaagatagcaggtatgacaccaaagatcaaaggcctggtggcaggggtcacccctgtgtgcgtcgtggcactgtggcacgcagccctcgagtgcctgcatcattcagtgactgggtggctggctgagtactggtccagaggattctagagagaatgaggcagtgcacgggcatcagcctaagagggcccgttcgtcccggcaagggaagtgcggcagcagtcagcactggctagtacccaggcccgaaatgtgacacacttgcgcagaacgcgtattagccaagtgtgctcaagtgcatgttcggcatcactccgaggcattacctgggaggatgcctgttcctgtgcgttacacaggtgcagtcaatcaaagggacacagtacagaagtcaccaagccacaccaagctggctagtcatccatgaagagagaatct

SEQ ID NO: 530394 - DNA, 270 bp, Homo sapiens
  misc_feature (247)..(247): n is a, c, g, or t
ctcgggtcgatctagagatccccttaaatgggccagaattattctgtatacaccataatagtgaatacattcattgtacatttgtccaaacccacagcatgtacaacaccaagagagaaccctagtgtaaactatggactttagcgtatgatgtgtcaatttcggctcatcaactgtgacaaacataccactctggtgggggatgctgatgacaagggaggctgtgcctgtgtgggggaaatacatnggacatttctgtgcccatttcaa

SEQ ID NO: 530395 - DNA, 224 bp, Homo sapiens
ctccaagtcccaacaacgtgtacggactcagctgctgtccagctcacagcggccctggcaggaccacaaatatcctaagacaagctccccaggcccaagtcaggcctcggggtggcctatccaggctcagcacctgctactacgatgacatctgcaggcccccggcccagccgggggactgctatcggcccagctcgggcctagcggcggactctgcaggcccc

SEQ ID NO: 530396 - DNA, 437 bp, Homo sapiens
atgtagtcccaatgcactgtgaacagcctcacctctcgtgaccgttcagcagctgatacaggtggcactggggctgtgaaggtacgctcagcgcactgctcgtggagtggacaggtatggatacggtgtagttgagcacggctggtggtgtaggtgcctcggtcgatctcagacatgcagggctttcagagtctgagtgccagtcgtgatgcagtacttggtactctagctacagcacatggcccatgaagctgaagtggcgatagatgatggctcgactggtcttcgctcacggacaggcctcgttcagcatgactcgattagtcctcatcaggtaagcatgacatctggaggctggtctcgtaatacgtgactgacagtgagccagccaccatcagtcagcattcgcgatggagtatatcaagtcaatgtgctcg

SEQ ID NO: 530397 - DNA, 103 bp, Homo sapiens
gtccgtgtcacgtaaccatcacaggaagatgtctccaggtggttcccacaaccacctccttcagctccacgatgttcggatgacgcaggcggcgcagcagcgt

SEQ ID NO: 530398 - DNA, 158 bp, Homo sapiens
tcgagccggtaccgaattcgacaagtggtgcactgtggaaatcattgtgtccgggctgggaactgcttcagcgccctttacagagcctgacgtaacaagccggggagctgattccctagggcttcatctgatccataagctggcaactggtcgagatt

SEQ ID NO: 530399 - DNA, 233 bp, Homo sapiens
ttaggtactcaagatcgtctactcgcagtgggggtaggtggagtgtcgtgttgttgttccacctgcaggatgatgaagtcctcttctatgagatgactgagctcgctcagccatcttgtcctcttcacctgtaggagcttcttggctgcccccatcttcccaacatgtgtactattctgcgtagatgctagaccaaacagcttcccaggtttcgtcacttgtcgaggctagga

SEQ ID NO: 530400 - DNA, 153 bp, Homo sapiens
attcttatctaattctcagatcaggttttgaaagctttgggggtctttttagattttaatccctcctttctttatgggccaaatatgtccaaaaaaaaaaggtcttatatttttttacccaaatttataaataaattttgaaccccttctgta

SEQ ID NO: 530401 - DNA, 1078 bp, Homo sapiens
  misc_feature (890)..(890): n is a, c, g, or t
caacgtattcgaggaatcacaatataccaggagctacagatatgtgccttcatagacgtggacaattctaacttgacacagatcagtggaccgtgttgacccgatgaggtcaggagacgttgatgatgatttggggctgaaatgctcctagtatataggctgcatggtgtgaagcgattcacgtcgatcctgttatcgtacacaaatggaataagctccagtcaggctatgagactctgtcaaacgtgggcgagatggcgagaggatcggtgggaacactcttgattcaattgactaggtagtgcccacacacatgtgccgtgctacccgttcctgtcctgaattgataggagatatagcattgtctcgatctcgcaggggagaaacgcaattacccacatggacatagcccccagtcagccagtcatccaacagttcagcagttcttggatgagactgacagcgtcagatctggagcatgcctgtgttgatcagtaatgaagagtttttgccacctgttggatatggtacttcacccaatacagattggtggatcatctagtgggagaccatcacgtcagtctctcgactctcagggaattgagagcaaggtgtgattccaagagtcgtgattgaccagccttcgctggatacctgattcttgaagtgcctgtgaggtgccatcgctccacatgtgcccttggagcggtacggagacgggatccgtatgacagtaaaatacttagggttaccccgcagggggtaagcggccatggtccatgcagttaggcgtgagcaaaatgccacacgtattgtgggcgcacttgggaactcactctatgttgcagcgcttcttaagaatggttgcagcatgggtggagatccttaanatattggggagaaaatttggcaaatggcttacgcccttaaatgggaaacgaactcttggtgcccattatggtggggggttgaactgttcgatgcccggactaggatttgcacatttgtccattttagaaacggcaaaccgacaccaaaagtgtgagatccaagaagggtgaaaaagctcaacggaatg

SEQ ID NO: 530402 - DNA, 395 bp, Homo sapiens
cgtcctaggtttgaagcgacgtctaggtgggaggatctcttgagcctgggaggcagaggttgcagtgagctgagatcacgccactgcactccagcctgggtgacagaagactgaaaccctgtctcaaaaaaaaaaaaaaaccacaggcggggtgcgcgggctcttacctttattctcagcatttaaggaggggtgggaggtggttcatttgaggccaggagtttcaaaaccagcctacccaactttggtgaacccccattctctactaaaattacaaaataaaaattagctaggtgggcgctgtgtaatcccagcatatgtgggaggctgaggcttgagattcgcttgaacccaagaggaggagttcacagtgagcgagatcaagccactgcact

SEQ ID NO: 530403 - DNA, 249 bp, Homo sapiens
  misc_feature (219)..(219): n is a, c, g, or t
ttcgatgtgtgtcagagagggtgaataacttgcccacggtcacccagtcacctcatgatagggtatagcgcggtgtggcgtcgcgaggctgcctctccactgcgctgtgccactggactgcgccctccatgccttcagagtctcatgcttctgtcctgggccctcctgggtttacctttgtggccgtgagcaccacgtggtcatccctggtagcagggncggggcccagggactggagttcgagtatcc

SEQ ID NO: 530404 - DNA, 256 bp, Homo sapiens
  misc_feature (49)..(52): n is a, c, g, or t
  misc_feature (55)..(55): n is a, c, g, or t
  misc_feature (60)..(61): n is a, c, g, or t
  misc_feature (66)..(66): n is a, c, g, or t
  misc_feature (69)..(70): n is a, c, g, or t
  misc_feature (72)..(72): n is a, c, g, or t
  misc_feature (81)..(81): n is a, c, g, or t
  misc_feature (87)..(87): n is a, c, g, or t
  misc_feature (89)..(89): n is a, c, g, or t
  misc_feature (95)..(95): n is a, c, g, or t
  misc_feature (115)..(115): n is a, c, g, or t
  misc_feature (128)..(129): n is a, c, g, or t
  misc_feature (217)..(217): n is a, c, g, or t
tgggtgtgagatgagagctatgagcgcagcacagggaggaggtttctannnnaancagtnnactgnaanngnacaacactncccagnanggaaangggaactgtgtttacctaantctctgaaaaganntgtgtctacatgacaacaagcttggaagtttggcttgatccagcagtctataatatctatgtgtacgattttctgtctttgagtgttntttgacatttattattaacaataaaagctgagtgaaatg

SEQ ID NO: 530405 - DNA, 104 bp, Homo sapiens
tgacctactttccacaggtgattgcattgccactttggctgcctgttataatacagcaggtgttcaaatggggcagtgaagattcttgaaagtgcaagcagtga

SEQ ID NO: 530406 - DNA, 443 bp, Homo sapiens
tacaggaccccgcgcggctgcgcacgggatgacaagaagggccccctggaggaatggggatgggacaaagagcaataacaggggtgcgcttcctgcgatgcccagcagccatgaccgtcatgcatcttgccgagtttctccgcctacaagcatggatgtgcccagcccagtacaacgctggaggttctgtaccaggcacgagccactgaaggcactactacaccctcatggacttcgcctacgtctacccctggcggcggaacgggcctctccccctccagtaccgtgtccagcctgcctgcaagccgctcaccctagtcctcggcgcccaccccctccgagggcatccacaccagcggggcgtccgagtgtgagtcagtccgccacgaggctcccagccctgccaccctgcctgccacctcctcctccctgcccatcccagc

SEQ ID NO: 530407 - DNA, 275 bp, Homo sapiens
cttcttctcgtctcccaccccagcttcccggcattggaagaagggaccctcctctttcctgtctttggccacccaaatcctggaattcgaaagggtttgaaccgacccgaagttttcagcagcgcacggggtccccagctaatcgacgccgtaagtagcaattactagacacgcattccgccgccgctttctctatagcggcaattccccagatttctcgagctgctactacgaggcattactaccacagaacctctaagaacttcttctgagta

SEQ ID NO: 530408 - DNA, 154 bp, Homo sapiens
gaaaacaccccgcccccccgggggttttttttttttcccccgggggggttttaatttttttttttaaaggggtttttttaaaacccccctttttaaaggggggggggttttaccccctttccccccccagggggaagttccccaaatgtgccca

SEQ ID NO: 530409 - DNA, 100 bp, Homo sapiens
ttattgcgataacgtcaagctacctggcttgttctgaccgcaaacgcaagactatgcaaccgtcgagaggtgcgctcggacgctagggaatagctggatt

SEQ ID NO: 530410 - DNA, 371 bp, Homo sapiens
cctagtcgcaagctcattcctgtcactttggtgtacatgactcgataattcctgtttatgaccacaactaaaccaatattagaaggaagtgcttgcacttgtattctccgatacttttgctctgcaaggtgaacaggcaagaacagcaaggagtgtatatttaaaagaaaagagcaccttaactacgtaccaaaacacaattcttttgatctaatgattaatttgtgtgtgtcagaatatttaccaaccagaaagaccacataaggccgggcacggtggctcgcgcctgtaatcccaccatgttacccaggctggagtacagaagtgcgatcacagctcactgcagcttggatctcctaggctcaagctgc

SEQ ID NO: 530411 - DNA, 233 bp, Homo sapiens
tgttagttcagtgttttaatctgacgcaggcttatgcggaggcagcaatgtttcatgttcacttcatactacacattagttcttctcatagggtgcatagattggtccaattgggtgtgaggcagtcagttatatgtttgggatttttcaggtcagtgggtgttgagcttgcaacgctttcttaattggtggctgcttttaggcctactatgggtgcgcaatgagagatttgt

SEQ ID NO: 530412 - DNA, 101 bp, Homo sapiens
aatagaccagatgttattgaatccattgattcacaggtctttacagggaagcacgtcctccattagtatcccgcagacgatgagatatatagcacaagtta

SEQ ID NO: 530413 - DNA, 122 bp, Homo sapiens
tctcgacgtagatatagatgagatgatgtcattggatcgggggtgctaaatgcaatgaccaatatccttataagaagaggagacgtggccgggcgcggtggctgacacctgtaatcccagca

SEQ ID NO: 530414 - DNA, 1324 bp, Homo sapiens
agcctctggtgatcgcaattggcggcggtcattgctgtgtcctgccaccttgtttgtaccccgtgtgtttcgtttacgctgtcacaagcgcaatgccgccctttttttgatggggggctctcgtggaggcttctttcgtgcgctccgtgtgggctaacaccacgccgggggcccccccagctgtgcccactggtttttattcttaaagagggcccccttattgggccgtccctatgttgtatgggccctctttcgttgtgaaagatgatacacggtgtgatcccagacccgctttggatggttgtggacccctcgctggggaaccagagggtgaaatttattggagagagaccgcacccctcccccagaattcccgcgtcttaatttcaagggttcagcaagacccctttctgtttgtgcccctggaagaaaatacttgtgttgggggaaaagaattccccccacggagagtcctaaattggaaggcattgaaacctctggtggtcccccaataatattttgaaggaaaaagcttgggagacactcaattaattggggattttctttcgcgtctctaagattgtagtggggagatccccacggtcccacactggcggttctccccaataagaaggttttatatgccgcttttgtgacaccccgttttgggtaacacacaagagatggccacgccctccacggaaaggcttggttataaccctcgtaatataataagttcactgggaaattttcgtgttctggggaaaacccacaatatttggtggtcttcgcactttctcacagttggccacacccaatataggctctcttttgtgggggcctcctatattccctcataagaagtgtaaacccccaaggagaccacgaatgttcttgtagaaggaatttaggcacacaagtgaacacacgagaggggttcttacccacgagacgtccactctttataacaccacccccaccccggattgacccacagagaaaaaaaccacgaggctctttgctctttcttgagaatatgagagattcacccacaacacagcctggcccacggtataaaagtgtctcgtttgtaacgcacacccttggcccaatactggggaccacgaaagaggattttatgagaaaggcactttatgtcagctttgggaaactggagacgagtgaagaagtttaaagattattgcgttcacattcacttttgatgagcgacgatggtgctgtcaaggctaatggaaagaaaatgaatggccaagacttggagggagaaaatattgaaattgtttttgcccagccccccgatcca

SEQ ID NO: 530415 - DNA, 126 bp, Homo sapiens
cctaaggcgatttatcagctttaaaagactttcaactgaaatcaattacatttaagatagacatattatatagaaattacctatagctctttaaaaatcctatgacattaacatggtggtataggt

SEQ ID NO: 530416 - DNA, 807 bp, Homo sapiens
  misc_feature (21)..(21): n is a, c, g, or t
  misc_feature (23)..(23): n is a, c, g, or t
gaggtttgtggcattttctananaaaaaccgtttttctccggtcggcgccagcggggagtggggtgattaggtgtgacagtaaagctgaagcggggctgcatcgtcggacgtgggatgatatttcatatgttctctccggaacacatgagcaaggaacagagccagggaccctactgtagcaaactgaagacaagaactttttccccaagaaaaagtgtacagacagttggcagaggagcctgctttatttaacaggggcctggaatgtgaacagccactggggtacaggctccggagaccaacattcacaggctaacaccccttgacgtcacacacggaagcttgatattttttgtatgggggtagaaattatatccaggccaatattagagactatgctgtggtacctgctggatctatgatatgggagggtgtaggacactgatttgaaggggaattgctaattgtagggctgaaggatgatgatctgtgttggcattagagaggcgttaggagtctgcttgtggaggaagggaatgtaactttcagtggtcgggagagtctgttcgtgtgtgggccgcatagccggcccattcaccgagggttaatactatagcttagttcctcaaccgtgtcgcgatttttccgcggcgtatgcggtagatccacggaacaagaataccccgattaccccgcacccacggtagaaaagcgccgagattacgatatagcgcgcaggagcgattaggtggtgggtttcgcgtggggttgatcgtccgcttttttaaggatgtatagccgcgccg

SEQ ID NO: 530417 - DNA, 306 bp, Homo sapiens
  misc_feature (298)..(298): n is a, c, g, or t
tgctgggattacaggtgtgagccgctgtgcctggctacctgggtaatatttgtatttttagtagagatggggtttcatcatgttggccaggctggtctcgaactcctgccctcaggtgatccacccgcctcagcctcacagagtgctgggattacaggcatgagccactgcgcccagccagagtctgtggtatttttatacacctcattgcattttctaatttcccttgtgatttattctttgacacattgggtacttaagagtatgttaatttccacatagttcagcgtctgacggngatcctct

SEQ ID NO: 530418 - DNA, 924 bp, Homo sapiens
  misc_feature (6)..(6): n is a, c, g, or t
cgcgcntcgaggtggcgatgtctgcggtggggtctggtggtaacccgcgggtttaattagcgctctgttaccctccggtgtgcccaagggcctctctgtttgttccggttccctcgcgctccagaagactcccggggttcatatggggcccctcatcaactggccaagcctgcattctatcccgggcccttcatattccaggccccttccctttctatgcaccctggcgcccctttttttctcgcgcattcctcaggaggttgcctctcccccccctcttggggagttgtgcgcatctctcccctctggtgcaagcggactctggaagcactgtggccccctacaacccttgggtccgaaattatgttctcctgcccccctggtgcggtctcactcaaactccccaaatcacatccgcccccaatgttctttggcaattccctggacattgctctcctctggtctaaaaaagaataacatgtgctattctattaagaaccccacttgcaattctcaattttatgataagtctctagagagtctttcttcttcttgtaaaaacgcaacgctaatatgagttagcttctcaccgacccccccgtcatgtctctaatactatcaccctcgcccccccccccttggaaataggatttactatcctccacacaatatccctgggggggcttccaccttcttcatgtattgatgtacgagtgacaattgctctacctagttagtgagtaactttggccgaggagggaacatacacttggtcctcttggtatgagggcgaatcaactctcctggcgttattttacccccccaactaaggatgagaatataaacatagggggcgtcaaaaagaaggatgttttaaaaaaaaaggagttactcatataaaataaacaaacagcccacataaca

SEQ ID NO: 530419 - DNA, 526 bp, Homo sapiens
  misc_feature (252)..(252): n is a, c, g, or t
  misc_feature (479)..(479): n is a, c, g, or t
  misc_feature (507)..(507): n is a, c, g, or t
ataaagggtctgtgcgtgacccacctgtgatgagccctttctaaggagaagggtttccaagagatcaccccaccaggggtaggaatgagcaagttgggaatattatactgtcactgcacatggacctgtgcgaagacgtctggcgcgagctaggctcactgtacctacatacggatcttgatggctcacctgtccctgtggaggttccactgggaaggcaagatgcccaacaacaggactgctctgtcattngccaatgttacctacattatcatgtgagattttattggactctgtgccatagtgggcaacgtgctggacatctgcgaggtcaagctgaaccccagcctgcagaccaccaccttctatttcattgtctctctagacctggctgacaatgctgttggggtgctggtcatgccttatgccttgtgtcagcctgtgcatcacccacttctacagctggccttttatggctngcctactgcttatctttacccacagctncttcatgttctggtgggcg

SEQ ID NO: 530420 - DNA, 293 bp, Homo sapiens
cgtcgaccgcggggccctcgctctctctctctctatgggctctcgctctctctactctgtgcttgctctttctctgtgctcgttctctttctgtgctcgctctctctctgtgctctctatctctttctgctctctcgctctctctctcagggctctctcagggctctccctcccttggggcgctcgttctccctccctcggggcgctcgctctctctccctctcggggtgctcactctctctcctttcccggggcactctctctctcctttcgtcgacgcggccgcgaattta

SEQ ID NO: 530421 - DNA, 1395 bp, Homo sapiens
  misc_feature (675)..(676): n is a, c, g, or t
agcctggtgcgcatgcgccactgtaaaggccgttaggtctgtccctggcgcccgattagaatatttaattccagttggagcgtttttcctcaccttactgtattttatttcggtaaatacccacacattttaatttctgagaggcacaaattcctctcagactcattcaaattgaccgagtagtcttataaggtgccttttgtctcattgtaaatcctcagtaaagtttgcagtttaggatgataacgtgatttttgcgtaaaaataacaactcatttcacctgaaaaggaccacgacaggagcagggactcgagtttctttttattcgggcacttcagtagttacctcttgcttgggggtggtgccgcgtgtggacccgatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttgaggcgggtagctgcctggggctgaggagaaagcggcggcggtctgggagcggggggctcagggcacgtgggaacaggcgggaagnngcggccgccggcgccagcggaggctccggggtctgcgagggcgtcctggagcggagcagacttcggagcgcaagttgggttcactgggtgccggcgtcaagtcccgcggggatgtggcgagcggcggcttggagacatagaaggcagaggctctgaggacgacccaggcgagggtttcctgaggcacctgtcgcggggcagcgcgactgtcacatcgctaggctgaatccttccctctcggctccttccagaagaacgtttttttctctcgctgcagctcagggacccagcctcctggtttttatgcgctagcccccgcatctgagattggtccccccgttaagtgtatcaggagggtccactttctggccttgggaaacccctgaaaacggggccgggcgcggtggctcacgcctctaatacgagccctttggggaggccgagcggggaggatcgcttgagcccgggagttcaaggaccaacctgggcaacatggggagaccctgctctacgaaaagtaaaattaaacaattagccgggcgtgatggtgcgtgcctgcgggccagctgctcgggaggctgaagcaggaggatccgcttgggccccgggagttcagctgcagtgagccgtgatcgcatcatgtccttaccgtgggcgaagaacgatgctgttcaaacagaacgggggacccttatgggagttttctccccacaaagtcc

SEQ ID NO: 530422 - DNA, 540 bp, Homo sapiens
agcgggggcgaggcgctagaggcggggtgcgccgtggaggccgcgggctttgcatcctgggagatctcggccttggccggctggacctgaccctagggcggattgcgcagcgtgtcgggacgtgacatgcgtacagccgcgtcagggaaggtgcgttcccagactgtgcaccaagttcagggtgccctagactgacccactttggagacgtgatagagcgaaacatggggcagggatttgaatgaagtgacaggcacgaacagacaagatggtggtgtacatggcgtatcgagaacgttcacgtgtgaaatccagaggatgcgacacgcgagtaaccagtcacagtccggagatggcaagttggaagtccgtagagacacctggacgatgataaccaaccaggggcagaatgaagaggaagaaatgtatcgaagaaggcacaagaccacagtgtagagcacttatcgagtgaccgccgatcgatagcgaattcaagagcggagagtaggacagcatcatgaggagtatatacacagcttg

SEQ ID NO: 530423 - DNA, 175 bp, Homo sapiens
  misc_feature (81)..(81): n is a, c, g, or t
cagatctttcctggtcagtctggagagcagtggactctacacgcgtatgccagtgactttgccctgtggaaggcggcaaancccaggaggtgttctgggcctctccctgtgggaccctgggatggctgggctggcacatctgagtgctctgccatcgctagtatggtattttggc

SEQ ID NO: 530424 - DNA, 1844 bp, Homo sapiens
agcctggtgcgcatgcgccactgtaaaggccgttaggtctgtccctggcgcccgattagaatatttaattccagttggagcgtttttcctcaccttactgtattttatttcggtaaatacccacacattttaatttctgagaggcacaaattcctctcagactcattcaaattgaccgagtagtcttataaggtgccttttgtctcattgtaaatcctcagtaaagtttgcagtttaggatgataacgtgatttttgcgtaaaaataacaactcatttcacctgaaaaggaccacgacaggagcagggactcgagtttctttttattcgggcacttcagtagttacctcttgcttgggggtggtgccgcgtgtggacccgatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcacatggtaatggctaacaacgtgtacaaaatctgggagcaaaatgcaagacccataaccttgagccaacggacgtcttgaagacccaggaaacaggagaaagcaaaacatatcacataaagcctggaccaaggaagatacttaaggctgaggcgaaaaagcagactaataagcagagacagaaattg

SEQ ID NO: 530425 - DNA, 1695 bp, Homo sapiens
agcctggtgcgcatgcgccactgtaaaggccgttaggtctgtccctggcgcccgattagaatatttaattccagttggagcgtttttcctcaccttactgtattttatttcggtaaatacccacacattttaatttctgagaggcacaaattcctctcagactcattcaaattgaccgagtagtcttataaggtgccttttgtctcattgtaaatcctcagtaaagtttgcagtttaggatgataacgtgatttttgcgtaaaaataacaactcatttcacctgaaaaggaccacgacaggagcagggactcgagtttctttttattcgggcacttcagtagttacctcttgcttgggggtggtgccgcgtgtggacccgatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtaagaaagaggttccattaggccagcacttcccctctgttagaataatctgggggctggccggacgtggtggctcaccct

SEQ ID NO: 530426 - DNA, 245 bp, Homo sapiens
attcggatccaacgatcgcttgaggccaagagtttgggaccagcctgggcaacagagcaagaccccgactctacaaaaaaaatttaaaaaattagccaggaatgatggtgcacacatgtagtcctagctactcaggaggctggggtagaaggattgcctgagcccaggagtccaagggtatagtgagctttgattacacgagtaccctctagcctgggtgacagaacaagatcatgtgttaaaaa

SEQ ID NO: 530427 - DNA, 1347 bp, Homo sapiens
agcctggtgcgcatgcgccactgtaaaggccgttaggtctgtccctggcgcccgattagaatatttaattccagttggagcgtttttcctcaccttactgtattttatttcggtaaatacccacacattttaatttctgagaggcacaaattcctctcagactcattcaaattgaccgagtagtcttataaggtgccttttgtctcattgtaaatcctcagtaaagtttgcagtttaggatgataacgtgatttttgcgtaaaaataacaactcatttcacctgaaaaggaccacgacaggagcagggactcgagtttctttttattcgggcacttcagtagttacctcttgcttgggggtggtgccgcgtgtggacccgatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctggtgagagccacaaagttaattcagtgttcttgaggccctttgcttgtctggaagtctgatgtatctgaagtagcaaaaagaaaaatgagatgctttgctgttggtgctgcagccagtctctgggatgtgttagtcttttatactgaatggtcccaaatgtaatcatgtaatcatctctgttggagacctgt

SEQ ID NO: 530428 - DNA, 536 bp, Homo sapiens
gcttatgggaaagtacctaaaaatggttgaagaacaagactgagaggctagaatatgaaagcttaaattctgattctgccccttcctagttagcatattcctgagacaaatatttgtcaacatggtattatctaagaacgtgtgccacaggcacccaggcgcattagacgtgactcacaagtagtatctcagcaatatggtaccaatttgacacacaacaaacacaatagaaactacaacatactgtacagacatacacgtagaactactacgtgaagtagttcattctattcaaacataagaattgcactactactccttactgataaatttcatcatttttagtgagactagggttttccaggccatctagataaaaaatcaagtactatatggacaccaacatggagcagaaaatgagggcagcagtgtccaatctcattccaggtgagaagtagcacagtgtccaataggtgcatacatctccttagtaagtagttgtgatatacaatgaaatagaaatgaaaaatatatta

SEQ ID NO: 530429 - DNA, 292 bp, Homo sapiens
gcatgcgaagatgccaaatcatccgagacatgatggcacggaaaagactttggtaatatcctctcacaccactaagaagcagtagcctttgtccaggtctaaatacaactcgtttcaagattacagaacattgggcattttacaaagttaattgtcagaggaagtaccacttctgtggtcttgcagtaggcgagcccaaacaaaaataagccaagggactaatagtttcgcgtttcttaaattcttgcaaaactagttaagtacacgttaggggttaaggatcctctcttac

SEQ ID NO: 530430 - DNA, 1732 bp, Homo sapiens
agcctggtgcgcatgcgccactgtaaaggccgttaggtctgtccctggcgcccgattagaatatttaattccagttggagcgtttttcctcaccttactgtattttatttcggtaaatacccacacattttaatttctgagaggcacaaattcctctcagactcattcaaattgaccgagtagtcttataaggtgccttttgtctcattgtaaatcctcagtaaagtttgcagtttaggatgataacgtgatttttgcgtaaaaataacaactcatttcacctgaaaaggaccacgacaggagcagggactcgagtttctttttattcgggcacttcagtagttacctcttgcttgggggtggtgccgcgtgtggacccgatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaagcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcacatggtaatggctaacaacgtgtacaaaatctgggagcaaaatgcaagacccataaccttgagccaacggacgtcttgaagacccaggaaacaggagaaagcaaaacatatcacataaagcctggaccaaggaagatacttaaggctgaggcgaaaaagcagactaataagcagagacagaaattg

SEQ ID NO: 530431 - DNA, 977 bp, Homo sapiens
ggcgccatgacccagccggtgccccggctctccgtgcccgccgcgctggccctgggctcagccgcactgtggcgccgccttcgtcactggcctcttcctggggaggcggtgccccccatggcgaggccggtgagagcagtgccatgcattctcccccagaggacagctctgcgctgtgtgcaggtatcattcgtgaagccgcatccgatgctgggagcacccggctgctgcagtaagccttgaggcatgctgacccatggagcagctcgcagggggattctatcgatgcacctgctgtagcatagccctaggctcttgggcaaccatgtgcgctggcatcagtcctagggtccacagaagggtcggctggagcctgggcaaccgttcacgggctacgtccgtcccttggccctggccctggccgctgtcccgcggacgggtcgcgtggtgacctgcgaggtggacgtcgcagcccccggagctgggactggccctgtggaggccaggccgaggacgggagcacaagatcgacctccggctgaagcccgtccttgtgagacctctgtgacgagctagctgtgccggcgggtcgaggccggcgaccttcgacgtggccgtgcgtggatgcggacaagggagaactgctccgtctactacgagcgctgcctgcagctgcttggacccggaggcatcctcgccgtcctcagagtccttgtggcgcgggaaggtgctgaacctccgaaacggggacgttgcggccgagtgtgtgcgaaagctaaacgaacgcatcggcgggacgtcagggtctacatcaggctcctgcccctgtggcgatggactcacgtttgcccttcaagatctagggctggcccctaagtgagtggctcgagggaaaggttgcctgggaaccccaggaattgaccctgagtttaaattcgacaataaaagcggcgctggacaccgaaaaaagaacaaat

SEQ ID NO: 530432 - DNA, 1209 bp, Homo sapiens
  misc_feature (675)..(676): n is a, c, g, or t
  misc_feature (1206)..(1206): n is a, c, g, or t
agcctggtgcgcatgcgccactgtaaaggccgttaggtctgtccctggcgcccgattagaatatttaattccagttggagcgtttttcctcaccttactgtattttatttcggtaaatacccacacattttaatttctgagaggcacaaattcctctcagactcattcaaattgaccgagtagtcttataaggtgccttttgtctcattgtaaatcctcagtaaagtttgcagtttaggatgataacgtgatttttgcgtaaaaataacaactcatttcacctgaaaaggaccacgacaggagcagggactcgagtttctttttattcgggcacttcagtagttacctcttgcttgggggtggtgccgcgtgtggacccgatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttgaggcgggtagctgcctggggctgaggagaaagcggcggcggtctgggagcggggggctcagggcacgtgggaacaggcgggaagnngcggccgccggcgccagcggaggctccggggtctgcgagggcgtcctggagcggagcagacttcggagcgcaagttgggttcactgggtgccggcgtcaagtcccgcggggatgtggcgagcggcggcttggagacatagaaggcagaggctctgaggacgacccaggcgagggtttcctgaggcacctgtcgcggggcagcgcgactgtcacatcgctaggctgaatccttccctctcggctccttccagaagaacgtttttttctctcgctgcagctcagggacccagcctcctggtttttatgcgctagcccccgcatctgagattggtccccccgttaagtgtatcaggagggtccactttctggccttgggaaacccctgaaaacggggccgggcgcggtggctcacgcctctaatacctcccaaagtttaaggattacaggcgtgaaccatcgcttctggcctcttttgtgttatttgaatgcacccagcgtggtctttactctgggcccctggacttgttgtnctt

SEQ ID NO: 530433 - DNA, 128 bp, Homo sapiens
ttcagcaagcggcttatcgaaccgagccggttagtcaagaagaacactccagaggagtagaggtgaaaacagcattgcccggggtgaggcgcaggaggaggaagggtccacgtataggagtggatagg

SEQ ID NO: 530434 - DNA, 486 bp, Homo sapiens
aagagtgccatggaaaggctgaagcgcggcataattcacgctaaaggactgattcaggagtgcttggcagaaacggaacggaatgccacatcctacctgccttgttggttttgaaggatgcccatctttttacaagaagagaagttacagttcatctcccctgttcagatgaaacccttgttttcaaaatggttacagttgcgtttttcctcccatggttcaccttgggtcttgaacctacagtccttcaaagaattggataaaaaagaattttgcacccttaatttagggaatttggcacgtttttaaaggtagctttagggaaaacctcagcccccaagaatttcttttatcaggctctatctctcaaaaacagattggacttctaaaaaaataaggataatccaaccgcggacaagggtttaattttttaatacaaaacaaaaaacctggggggttttttgccccccccccaagaaaacaacc

SEQ ID NO: 530435 - DNA, 146 bp, Homo sapiens
  misc_feature (112)..(112): n is a, c, g, or t
ttcagagccctctgacacatcatcttcatcatcttcatcttcatcatcatcttcttcctcttctctctcaagtactcgctcttctccacctctcttgctgcgagacgggcgngcgctggcggccggcggccgcgtccgggcctgtc

SEQ ID NO: 530436 - DNA, 150 bp, Homo sapiens
cattaccttacctccagatcaccctccctgagaggtgataagaaggagtgacccgggcagttctgccattagagacccagcatgtaagagatccccagagtccgcaagattcagatggtatttagattacaagaaaatcaacagagagac

SEQ ID NO: 530437 - DNA, 220 bp, Homo sapiens
atcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgct

SEQ ID NO: 530438 - DNA, 252 bp, Homo sapiens
taacgggcagtgaatcgagctcgtgtacccacggcattgtcagaggcgtatgaaccagagcgactccatcttgaataggggctgggtcaaatggatctgagacctgctgggctgcattcccaggaggttaggcattcttagccacaggatgagataagaggtcagcacaagatacaggtcataaaggccttactgctaaaacaggttgtggtacagaagccggccaaaacccaccaaaaccaagcaacccct

SEQ ID NO: 530439 - DNA, 239 bp, Homo sapiens
gaaacacttcgtccatactgacctttaactcatgtgtgtggactttcggcgtgtgcacacacgccgagtgtccatcctgcacacgccgaggatccacacacttacttgaggtcagatcactactggacgaagttagttgcgcaactaacttcgtccattcatgacttgtagtcaccacaggggatctaggttcattcggctgtgtgccagggtacctgagctcgcacattcgtaatcca

SEQ ID NO: 530440 - DNA, 866 bp, Homo sapiens
gtttcttttagcagtttcataatttgaggtcttagatttaagtctttaatccatttttacttgatttttgtatatggcaaaagatacgggtcttgtttcattcttctgcatacaggtatctagtttttccagcaccattttttgaagagactgtccttttcccaatgtatgttcttggcacctttgttgaaaatgagctcactgtaatatatggatttgtttctgagttctctattgtgtttcattggtctatgtgtgtttttttttttttttataatgccagtaccagtgatgtttgggttactataggcttggtaggtgtaattgtgaagtcacataatgtgatccttccagtttggtggttttggcttaggctcctttgttctttttctctttctccttttctcctttttttttttttgggaagaagggctctctcctcctcgtgttccgcccgaggcggaaggtgcaggtggcaacatttctttcgagctctccacgtgcaaaccctccaaccctcccagaggatctcacaagcattatcctgtgtgtgtgccctacagctctcccgaagataaacgggagactcaccgggtgtggtgtgcccccatgtgccccaggcttaaatttggagaatttttaacgataagaaaacggggtttacacattatgttgtcggcacaggcgtggtcctagaaaacctcctggaaccccaagaggccgaaccggccataaccataagccttccccaaaagggcgggggaatcaacgggccaaacccaccgaggacacaaacctgaaaggatccctagggggggaacaaaccccattagggacaaacccgggaccctggggagacgccaaaa

SEQ ID NO: 530441 - DNA, 484 bp, Homo sapiens
  misc_feature (13)..(13): n is a, c, g, or t
  misc_feature (28)..(28): n is a, c, g, or t
  misc_feature (208)..(208): n is a, c, g, or t
  misc_feature (285)..(285): n is a, c, g, or t
  misc_feature (322)..(322): n is a, c, g, or t
  misc_feature (388)..(388): n is a, c, g, or t
  misc_feature (484)..(484): n is a, c, g, or t
ccggcgagaaaantgagatcccgcgagnctcccaggatgaagtctggctctgttgcccaagctggagtgtgttggcaccatcttggttcactgcaacttccacctcccaggctccagtgattctcctgcctcagcctcaagggtagctgagattacaggctggagtgcagtggcatgatctcacctcactgagaacctccaccagctngggttcaagtgattctgctacctcaacctcccaaatagctgggactacagggtctcattctgtcacccaggttgganctgcagtggcaacatcatagctcactgcagccttganaccctgggttcaaagtgatcctcctgcttcagctccttgagtagctgggggctacaggcacttttncctacatttttcaaagggctgcatcatcacatctggccacagcattctctaatcattgagggattttctcaggaaaatcacctgtgaaatattttn

SEQ ID NO: 530442 - DNA, 137 bp, Homo sapiens
tcagcaagaccagacagctttacttacccccatgaagaactgatcaaataacaaaaacacatgatctcagtgtatcctcccaaagctgtcagatgagctgctgatgccgtgtctagattgccatgtcccaacaacag

SEQ ID NO: 530443 - DNA, 714 bp, Homo sapiens
  misc_feature (674)..(674): n is a, c, g, or t
aatgaccagagtcagctgtaaagcacataaggggaactttgtgatgcaaacacaagtatcaacagctgaattgatcaagcagaaaaaagaatatcagagcttgaagactgtcttgccaaaataaggcaggcagagaagattagagaaaaaagaatgaaaaggaatgaacaaaacctcaaagaactgtggaactatgtaaaagaccaaacctatgactgattggactacctgaaagagacaaggagaatggagccacgttgggaaaacacacttcaagatatcatccagaagaacttccccaacctagcaagacaggccaacattcaaattcaggaaatccagagaaccccagtaagatactccacaagaagatcaaccctcaagacacatagtcatcagattctccaagatcaaaatgaaggaaaaaatgttaaaggcagacagagacaaagggcaggtcacctacaacgggaagcccatctgactaagagtgggcctctcagcagaaaccccacaagccaggagacaagtgggtccaatggtcaacattcttagagaaaagaattttaacctagaattcatatctgccaaactaaccttataagtgaggagaaatcttttagacaagcaatgctggggaattatcacaccggcctgctttgcagacctctganggagtgctaagatggaaaggaaaactggtcccgccactgc

SEQ ID NO: 530444 - DNA, 876 bp, Homo sapiens
ggtcgactttgaatgagaaagactcaatgactggtttgacaagagcctagtgaccctgtgagtgttattaattttattatcccaagtggtttgacaagagcctagtgaccctgtgagtgttattaattttattatcccaagagaataacgaaaataggacctattgtttagctctcaagctaaaattttataccattatctatatgagcactatctgaagagtctcccacagaatatacttatgggagaaagagttgagtacagtcataactttaatataaaaacaaccctttaaatatgaaaatagtagcatggctctaagtccaaaatgtagagagacgattatggagatagaaaccttgagatctatttctagattatcctggcactcaggctcctatgattttctgtttagacaataccccataaagtatcacagtgaatttaaacatcacatttgcattttctagggtatttatgatgatttttctgagtgtactttctagatgagacatagaaatatggtggttaaaaggggtctttggaattagattgcttatatttgaagtcaggctctgacatgtataagccagctatgggatcttaagcaagttttctaccctctacatttcttcagtttcgtcagctaaaaaatgcaggtagtaatagcacctccctaattatgtgagtgagaagaatgagtgagataatgttaataatcccttagcccataagaaaggcccaagcaatgctgttattttgttcttaccttggtttaagatgtatttcaaacacaacatggatttgaataaagaagtgacctgtgattattccattcagttaccaaatctaaactaaattgatgacaaaaaaaaa

SEQ ID NO: 530445 - DNA, 391 bp, Homo sapiens
agctcctaccgcctcggatcccggcacgatctttgcttcgtggtgcttctcctccccgcgcctgtgtccttcatctagtctgcacctcattggtcatcagtgcttgcgacggcgcatgtataagtgtcatggcttccccatgcatcacacgccaatatccgcttgttaatccgcagccagggagcatagaacacgaagtccggggcttttttgtcaatgggcttcattgactaatttcttatcattgaaagagatgttcctgatttcactccaggcgaagcctatcttggcgagttagtctgtcattctgctcatagatcttgagacccagggcatcctcccccagccacagctctgagcctttcttgttcttgatgctgaagtagttcac

SEQ ID NO: 530446 - DNA, 526 bp, Homo sapiens
ccaagagctggcccggagcagccaggagcacctccagcgcaagcaaatctgggggcgcgggaatgacacaccgggtgaaatgaatgcttcctgaaaggacaagcgatccggctgctacttattcacctgccgaggggtgtggattatagggggaatatccagactttcagagtagcggcagaagtgcgggaggagctgtgccggcaaatgggtatcacggagcctcaggaagtgcaggaattcgccctcatcctcatcaaagagaagaggcagctggtgcgggccctggagccgggcgaatacctcaacagcgtgttagtgggccaggacgagagcctgcacagccggcggctccactgggagaccccactgcacttcgataactccacctacattagcacccactacagccaggtgctgtgggactaccttcaggggaagctgccagtcagcgccaaggcagacgcgcagttcgccagggtgggcggcctgcagcatctcagcaaggccaaaaggaatacccctc

SEQ ID NO: 530447 - DNA, 505 bp, Homo sapiens
caccgaaggtcagagagatcagtattcatggtgctttattgttcgagagtaaaaggtcgtgacagagagaccattaagatggggatataagagcttataatgataacttaccgtccacattcttctataagattgcctatggtttctgcctcatcttcagccattttaaatatattacttagtccatcgagtactacttgcacaacttgtcgagattcgaatctcgacaagttgtgcatggtggtgggtgcctgtaatcctagctcctggggagactgaggcaggagaatcacttgaacccgggaggcagagtttgcagcgagccaagatcgcaccatggcactccaggctgggtgacaagagcaaaactccgtctcaaaaaaaaaagccatttaaggcagctggcagtgactcaggcctgtaatcccagtgcttggggaggctgaggcaggaggatcgcttgagtctaggaggtcaagaccaggctgcacaattggtcgagatt

SEQ ID NO: 530448 - DNA, 452 bp, Homo sapiens
tacagtaatagatcagtgagtgataagttgataagagaaacaagacatgatagtgttaaaggtcgtaataaaaatacagaaattgcccaagaactttctgtaatctatgtaagtaatcataatggtaaatagcaataagctagtcatgtattacatttatgcagtatgtttgtaggaatcctctttgtgtttccatatgtaaccagtatgtgacccttaggaaattcttagttgagactattaagtgaagaggttcatagttttaagatatttaagtcacagaagcatattagtgtattttctgtatgtaatatagttggcattgtaattcaggtatgccagatatgacacatggacaagtgttttaaatcgtttttcctatgtctcgctcccgtaatctggaagaaatgccacaagctgtgaaaattaatgtcagtttggcttgggatact

SEQ ID NO: 530449 - DNA, 121 bp, Homo sapiens
taacgcgctgatagcctcctaacgcgctgatagcctgcaacgcgctgatagcctcctaacgcgctgatagcctcctaacgcgctgatagcctcctaacgcgctgatagcctacaacgcgct

SEQ ID NO: 530450 - DNA, 194 bp, Homo sapiens
gacgagttcaccctggggtgtacgtctccctggacaagttcctggtttctgtgagcaccttgctgacctccaaataccgttaagctggagtctcggtggccatgcttcttgccccttgggcctccccccagaccctcctccccttcctaaacccgtacccccgtggtctttgaataaagtctgagtgggcggca

SEQ ID NO: 530451 - DNA, 206 bp, Homo sapiens
tcggtcgctcggacacaagttggtgcattgtcttgagaatgtcttggaatgacactgagctcatctccacagattctgaagtttggctcagtggccctgggctagttcctaaagatggttgtgtcaacccaatagatttttccacttggtgacagttgtcagaggtcaactttgcttcttttccttgatatcctggtccgagcgga

SEQ ID NO: 530452 - DNA, 106 bp, Homo sapiens
cataccttgaccttctaattactagccccacaaatacctacgcacacttccagaaactggtgcaccagatgttccctaaacccaggattaacccgagcgctaccat

SEQ ID NO: 530453 - DNA, 95 bp, Homo sapiens
  misc_feature (12)..(12): n is a, c, g, or t
  misc_feature (54)..(54): n is a, c, g, or t
  misc_feature (57)..(57): n is a, c, g, or t
  misc_feature (75)..(75): n is a, c, g, or t
  misc_feature (77)..(77): n is a, c, g, or t
ggacataaattnagtgtacaataaatgtgtgtgtgtgtatatatgtatatgctnacntgtgtatggaaagtatcncngcagatacaataaaaact

SEQ ID NO: 530454 - DNA, 465 bp, Homo sapiens
agatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgagactcttccaaaaaaaaaaaaaagtttttcagaggcaaatcacagctattgacccaagagtggctcacacctgtaatctcagcactttgggaggccaaggcaggcagatcacctgaggtcgggagttccagaccagcctgaccaacatggagaaacaccgtctcttaa

SEQ ID NO: 530455 - DNA, 137 bp, Homo sapiens
caccatgcagaagaactttcttactctctgtgcctcttattagcatctaaattcttactaagtcctgtcttatttattactgttgtgtggctcttaactgttggaagtaaagaactgacagtgctgaatgtatcgtt

SEQ ID NO: 530456 - DNA, 1709 bp, Homo sapiens
  misc_feature (1172)..(1172): n is a, c, g, or t
tttgtgtgtgtttgttttcgttggattttttttgtttttgtggtgattggttgttgtgatttttagtgtttgttgtttttgtcttttttttttgtattgtgttgtatttgttgttgtattggttgtggggggcctattggttggtgttggttgtgttgtttatgtgttgttgttgtttagagtgtgtagtgttgttttttgatttgttttgtgtgtgttgttttgctgtgttatgtgtattgtatgttttgtttgttggtgcgtgttatttttgtttgtttgtgttttttgttatgtggagtaagtgagtgacgaaagaatatgtaaaacgaagctcggtagagggagcggatacgagaaacagaatgagcgtagccgtctctcggcgttgggttgattcactctcattgcgtccgctcttcatcgcagagctgagttgcgtgttggtctttctcgcggcacaggggggtgtgtttccacccgccggggtggctgctcgtgctcctccttcgctgttcccgcgggtgtatttcgtcgcagatcccccagaggctgttgttgatacttttctctcgcggtcactatcggggcgcttcacattgtcacacaaagtggtgtttcctgacccagagggttttttcgttgcgggcccacacttgtttctggggtgccccgccagcggttgggcccccccgcgccatgggggaagccagagctggggctttcacctttctctccaaggttggtttgttttcttgtgtgccctgcctctgggcctttatattttggcctctgccgggcttatttgtcccccgtggtgttggggaggtggcgcacccccagggcgtcacctccgttgtgcacagggccacaagtgttttgccttgagtactttggttgtatgggcatctatgtactttggtgttcgccccccctgttctctggttgtcaaaaaagccgtttgggatggaatgggcgcccccttagaaatatgtcttgtcaaaggtctcttgggtggtatagccctgcccaatattgcttggcatatataggggtgtcccctgggcctaagacgccccaataggtggtgtcttgagagagagacgtttctctctcagaacgattatccccccacctttgttggggtccgcgctcttgccctgattcctgtngattatagaggagccagaccacgtgttgccggttgggggtgcataccgagaagccactggggaccaagataaggctttgcttggaggcttggcgcaaggtctcacccaagtgttgcgcccaggtagagcgtccaagatagggcgttatatatggatgtattgtatcgctctgtgatataccctgcccacctcccacacttctgtatacttcacgtggctggagagaacgcgttctcacgagaactgtgttggattcacaattgggccacatcttaaaggtgtatagtatagtatgacagagtctggggtatatgagtaagcaacatgcacttcgtgaaaaccttcacgaaaggaaaaggaaaaatgttttgtggagcccactttggtttttttttttgcgtgtggccgagtttaagagtattagagttttaaaatccgtgacttttttatgggaaccacgttggccccaaaagtttgtccccagagaatttgagaccccatttaaaaagtttaatgtggaagaaaagaaaaaaaaaa

SEQ ID NO: 530457 - DNA, 381 bp, Homo sapiens
  misc_feature (128)..(128): n is a, c, g, or t
  misc_feature (145)..(145): n is a, c, g, or t
ggtgcacggggccccccggggcgtggggggaagaggtggttggatcaaaaccccccggaccccccggccgcccccctatatggggggccccttgggggggggggcccccaacccgggatttgggtttnagggggggccgggttgnttccgggaaccccccccatcccaaaggggggccccccccccccaccaatttttccccccaccgggggaagggcagggcaccccaatggggccccccccaaagcccaaaaagggggggccatttccccgggggttgggggaaaatttttttccctgggcctccccccccccccttgggttttttttttggccccccggcccgggcccaaaacccaaggggggttcccccccccccca

SEQ ID NO: 530458 - DNA, 726 bp, Homo sapiens
gattttaaatacactgacacgctactgttggttaaatttaaacatgttttacctgcagaaattctctcacaaataacctgcaataacttgcaaatgccatacccttttgaacacttccttttctccatgtcatacacattcaacacatgttcggctggcatttttgccaccacatgtccaattctcctcaacaacatgtgtccgctcatcattctctcgttacctgccagctgtcagctacacacggtttcagacgaaaaccccgatcaatttatcagtcgcgcatacctgtcactctaggtttccaacgccacgcccaaacatcaaaccagtgccagctccacgaaacattggccacacacacacaacacaacacacacacacaccacacacacacacacacaccaaccccattctttgtcgccgcccgcccctcgcgccgcccccgccaaaaacccctctcctaaacacacccaaccgcgcgcttacgcgagcgcgccccgaggccccccacccaccacgcactaccctctccacaaccctccggcccaaccctcgacactccccaccacgcagaagaccccctgcggcacacccagcacaaaacgcgcgcccgcgacccaactcccaccacaccctacctacaaccccccccgcgccgtgcaccacagcccgccccctctcaccaaacaccccacgcacggactcaccccacccacaaccatg

SEQ ID NO: 530459 - DNA, 182 bp, Homo sapiens
  misc_feature (35)..(35): n is a, c, g, or t
tcccgggggggcccccccccttaagcccccccccnaggggggggcccctccaacccgggagaaagaaaccctttttggtttttatttttggggcgggggggggtaacccccccccccgcccccgcccccgcccccggccgaaaggttttttttttttaaaaggcccttggggttttccggga

SEQ ID NO: 530460 - DNA, 702 bp, Homo sapiens
tcggaatggacacgcgtcgagtaaatggaaaacaaaagtcaaacccgtctagcacatattattgcctatacttcagttacttgtgccagtgaaggggtggccagaaaaaaaatcccaagtaccctcatcatcgcttactagccatcatgccccctcttcctctggcacattcctaagagctctattcataagcagcaaacggactgtgtcgattgcatctcttcctgacctacctggtggaggtgctaattggcgcatggacagaaaggggcgagccagagctcttggctttgtggatgcagaggcctgcattctgcatcggtctgtgtgcctgtaatttaggatggctttctgacaggtaagaaaatgagatacggttgatgacttaccatgcttttatattttggcagtttacaattctagacttttcctactatgtcgatcttttttttactttatattctttggaggtaacaatattttggagtcttaagaatttgattttataccattatgactgtaacaccttagggatctttcctgtagtcatatagttttactattgttagagagatctctgagattttgcaagagaaccaagcattccttaatggcagaactttgaaagttgatttgggaggcttttgctgcaggatctcaagaatagagagagagatgattctacttaaatgtttaattcta

SEQ ID NO: 530461 - DNA, 243 bp, Homo sapiens
  misc_feature (92)..(92): n is a, c, g, or t
  misc_feature (108)..(108): n is a, c, g, or t
catgattcccaaaaaggttaaaacctattccaaaaagctgtgccccagagaaatgtccttcgcctctcctatttcccctgccctggtttccnccaaaaggaaccagtncgtttattttaacagctttcctgaactataattcatataccataaaattcacccgtttaaagtgtatttagtgttttttagtattcatggaattgtgaaaccaccgcaatcaattttagaacatttttatcacct

SEQ ID NO: 530462 - DNA, 116 bp, Homo sapiens
cttgaccgggaaactggagtcctccatagggtttggttttgtagacttcaacagtgatgagtgatgccaaagctgccaagagagtgccatggatagacggtgaatattagattgga

SEQ ID NO: 530463 - DNA, 106 bp, Homo sapiens
gggcgtggtgcggagggcggtaggaaagggaaccagatagggaataataacgaacacctgctacgtgacaggccctgggctaagtacctgcccgggcggccgctcg

SEQ ID NO: 530464 - DNA, 154 bp, Homo sapiens
aaacatttctgggacacccgacgggagtgaggagcccctaaaggggtggggaggctgaccccttctttttgaaggcaaccacagggaggggactcacacggggcttttccactgggttccccttctttgttaactttttaaaagggcttacaaa

SEQ ID NO: 530465 - DNA, 80 bp, Homo sapiens
catggactcagtcctggtcctcagtaactctcgtttctgtgtggacctcgcttggaatggatctgtccctatcattcctt

SEQ ID NO: 530466 - DNA, 380 bp, Homo sapiens
ctgtgagaggctattctttcccagcacctgttggcgagatgagggtggtccagaaaccggggacctcactgctgcgatccacagagagctcctgggaaggggccataacattcacatgcttggagcagtcccagaacggaggccaacctgacttctatgcggttgaaccctacacgaagaaagaacttgttgctgttactttacctgacatgattcgcacttacaaagtcatggctgctgagaatattcctgagaatcccctgtggtctccgtatactaatattgacctggaccatgcctttggaaagtattactccaggtcttgggaagcatcagagccaatgggactggatggccctggaactggatatatcgactgg

SEQ ID NO: 530467 - DNA, 120 bp, Homo sapiens
gcaggactagaccaggcgccccgaggggaggacaaggccaaggaaggtggcgggaggacaaaggacaagtgctaacggagggggccgaaaacggaaagttcctgagggtgcgcattacgg

SEQ ID NO: 530468 - DNA, 379 bp, Homo sapiens
  misc_feature (108)..(108): n is a, c, g, or t
  misc_feature (115)..(115): n is a, c, g, or t
  misc_feature (209)..(209): n is a, c, g, or t
agagacctgctccttcccccagccggctccgaggagctgcatttctgcacaatgtacagtagccctcccgccccatctgtggttttgctttccacggtgaaagagttnggatatntgtccctgtcaaattgtcatgcccaatgctggaggtgggcctggtggcaggtgtttgggtcatgggggcagattcctcatggcttacttctgtnctcgaaatagtgagtgagttcttgccagatctggctgtttagtgctgtggcaccctcaccacccccgtgttgctcctgttcttcccgtgtgatgcgcctacccccacttcatcttccaccataactggaagcttcctgaggccctagagctgtacctcaaccgtggtacc

SEQ ID NO: 530469 - DNA, 3741 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtctgttttcttaccattcctatccagaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 530470 - DNA, 325 bp, Homo sapiens
  misc_feature (108)..(108): n is a, c, g, or t
  misc_feature (115)..(115): n is a, c, g, or t
  misc_feature (209)..(209): n is a, c, g, or t
agagacctgctccttcccccagccggctccgaggagctgcatttctgcacaatgtacagtagccctcccgccccatctgtggttttgctttccacggtgaaagagttnggatatntgtccctgtcaaattgtcatgcccaatgctggaggtgggcctggtggcaggtgtttgggtcatgggggcagattcctcatggcttacttctgtnctcgaaatagtgagtgagttcttgccagatctggctgtttagtgctgtggcacatgctcactgcccgcctgccaattttatttttacaaaggcaggttgttttgttaactgaggaa

SEQ ID NO: 530471 - DNA, 1384 bp, Homo sapiens
  misc_feature (54)..(54): n is a, c, g, or t
  misc_feature (64)..(64): n is a, c, g, or t
aagaaagcgaaagagggagagaagggagagagaaaaaaggaaaaaaaaaaaaanaaagaaagancgtgcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 530472 - DNA, 196 bp, Homo sapiens
ccagcccctgttatgcaaagagcggagagccagcgacgggagctggagccccacgcccagccagaagctggggagggcctagctgccctactatcaccactccccatacaagcacgcgcacattccggcgtacgcccagcactaccagagctacatgcagctgatacagtagaagtcggccgcacggagaggtcag

SEQ ID NO: 530473 - DNA, 1187 bp, Homo sapiens
gagagatgagagataagatagacgagagatgaggatcacgcagcagatgatataccatagatgacgaccagagataaaaagaggacgagagtgaaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 530474 - DNA, 249 bp, Homo sapiens
agctctccaaagcggcatgcgagtatactggcggtcgttgaatatagtacgtccaagctcatctgcagctgggaacgcagacggttgagtcttccctggatcggtcagccccttggcatctggtgtcaaagaagatgatggctttgaggtaggcatactcattgtcatcgatctgcagcgcctggaagggcagcacccggctctccagccgaaggatctcactcttcagctggaagatttcagcctcat

SEQ ID NO: 530475 - DNA, 3408 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 530476 - DNA, 3045 bp, Homo sapiens
  misc_feature (3004)..(3004): n is a, c, g, or t
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggtgtgtgtgccagaaagatngggcggggaggggggactatcaacaggagaagcttgcgtag

SEQ ID NO: 530477 - DNA, 882 bp, Homo sapiens
gaaggtaacggataagacagactataaagcattaaacaactaataatagaacctcaacaataaatagagagcaagagaatccgagaaacaacttgaaggtggataagatatatggctatagtaatagtcggagagttatggatcccagatccaataatggatagatcattcagacagaggatgagaaaatgagagaatttagaggatacatggaataatggcagaccgtcaagaaattaaggagataagatatacataaacacgtgcacatccgaaaaaaagctaagaatacatatggttctcaaatgtcttatggaagattgtttcagaaagatcaaatggttatggtcacgaaatataatgtctgtaaataagattccaatcaataggataggaatacttcataccaataattctctctctcattagcacgaatagcatggattaatagatacgaggctgcaactatgctaaagaacgatagagaataggaacaaacgtgtattccgagaatttctcgaatgggaaagaggggagacacaattataatctctctgtgcaggtattaagaaccaatcgaattcgcggtagctaaagtagcagggaaaatatctctagacgttcccataaaaagggaatacctatagatagaaaggggtaatctcaaaacctagactgtaatggagagaaggttgtgcgggacattaacttaggcaatgtcagagaccaggaaacattgtccggtgtagttgcttccatgactattaagccaagggtgattgaaatcaaagaccaaaaaagtgcaaaattctaaagcaaaaggacaagtatttggtttcccaaaataactcacgtgtgaacctgagacatttaaggttactg

SEQ ID NO: 530478 - DNA, 1425 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagctgctgccgcccacccctcgtcttctggctgcctccctctttgtgccccacaggctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 530479 - DNA, 269 bp, Homo sapiens
tgaccctgagctttataccctcggaataagggccactgaaggttactgccatcttgaggtcacataggttgtgatgtcaacagacgggtgtcttgacattgttggggatccattccgacaatggtagctgttgctcttgtgctgcacgttaaggcatctgctcatcgacctccttcattgacatccgaccacggaagacagcagtcacggtgaggtatcggccgatggcggggtgtcacaggcaggcatcatgttcttggtttatcgag

SEQ ID NO: 530480 - DNA, 396 bp, Homo sapiens
  misc_feature (1)..(1): n is a, c, g, or t
  misc_feature (30)..(30): n is a, c, g, or t
  misc_feature (384)..(384): n is a, c, g, or t
nccatacttgtaatcctaacactttgggangctgaggcgggaggattgcttgagcccaggagtttgagaccagcctgggcaacatagcaagaccctgtttctgcaaatatttttcttttttaaaaaaaactagccaggcataggggcattttaaaaaaattagccaggaggtggagactggaggatcacttgagcccaggagttggaggctacagtgagctatgattgcaccactgtactccagcctgggtgacagagtgagaccctatatctaaataaataaataaataataaacataagtctttttgtaaagatgaacagacctcaagataatggttatctcctgacgggtgggggatttctgtcaggggagggggcaacancaggggcttctt

SEQ ID NO: 530481 - DNA, 715 bp, Homo sapiens
cagcagttggtggtcacagccaggggacgtctcgactgtcttgagttgtgtgtacattgatcagctaactccccgaagggaaccaactggatgtcacgttaggagtttctgttaaagtgtctccttgatggggactcagtactgtgtatagacgctgtgttctctcttctggcgggtgtgcgatcacgaaccactggggccttttaagaatctacagatgccgcgccgggcgccgtggctcacgcctggaatcccagcacttgttggagcgctgaggctgggctggatcacacacgcgcaggataacttgagaccatccttgccaatatggtgaacatcgcccatctctacaaatagagatacatagatacattaccggggtgtggtggcgtgtcagcagcctcccagctacttgggcgaggctgaggcaggacgcaatcgcttgaacccgggaggcagagattgctagtgagccgagatctacgccgacatgcacgtccagtcgctggccgacagagtgagtactctatctcagagaagcgaaagcaaatagaaacagatgcccggagcatttagactcagtaagttcggcatggggcctggcgatacaggtttaaaagttccataggctagttataacgtttacacctttgtttaagaaccactgcaacagagagattgcttcatggaagggctcctggcacgcatcttcata

SEQ ID NO: 530482 - DNA, 419 bp, Homo sapiens
catgatatcccagtgctttgagaggctgaggcaggaggattgtttgaggccaggagtttgaggacagcctggggaacatagcaagactccatctctacaaaaactgcagaaagttagctgagggtggtatgtgcctgtagtcccagctactcaggaggctgaggtgggaggatcacttaggccaggtgtattattagtttgttgtcatgctgcaatgaagagatacccaagactgggtaatttataaaggaaagaggattaattgactcacagttctgcagggctggggaggcctcaggaaatttacaatcatggcagaaggggaagcaaacatgtctttcctcacctggtggtagcagggaggaccattgcagtggggtaaaagccccctataaaatcatcaaatgttgtgagcagcg

SEQ ID NO: 530483 - DNA, 315 bp, Homo sapiens
gggagctgccctcgtagagcttaaggagcatgtctgtggaactgacaggccttagttgctcttcttcttgaaaatgatttatctttctttctggtgtcatctcagccagtttagaatatgctagaattttggtgagatttagcaaataggatgtcaatcaattagcagtcacctcaaaagaaattttattttcttcattttattgaattttgttatgcaaacaaagaagaaagacaacattagaagaatgcacttagaccttcttttctaccgatagaatgggggtggcaggacggcaagattcgtattttacca

SEQ ID NO: 530484 - DNA, 1203 bp, Homo sapiens
ctcagccacctgaagccaccctgagggcgggagaactcatccttttacaccagggaccggctggctagccctcaccctggcgctggactacctcctgctgatcagtcgactgtcagcaaacctgtccttgctcctgtccagagcagatgaggaaccggacgccagacatgggagactatgcatacctactcgcgcgtgcagagtagatgaatggggagcctcatggccctgctagtagaatgagcatgcctagtgtggcgcccataatcccttcaaggactgaagcctcgaagctgtccggggtggcacgtctgcgaaaagcttgtattccctcacgagatcgttggctatactagcagtggagaagatttcaaggggcacacatgtgcgtggaaccagtcttgagtgtgtcgcttcaaggcacacctgtagggggcagcactaatgttgcctgtatcagcacattggtgcgcttcgagaaccgcatcaaactcattgggaccaatccatagtccatgaggacacccttagcaagccccttagacaagtatccatagtgacatcgactgcgaagaaaggcgtcaagatgttagcctgactttcatacggccatgacccttagtgctcgtagcttgccaggacgcatagacccagggtgacacgcctcaggggaaagaggggccgtggaccaggcaaccttggtcatagatgaaagttcttccgcgcttcctcgtccctgtgagcggagcatacgtaggggggcgtgaccgaacatcgggatagagcctaagtaaccttcatgatgaatccgaactggttccggattagagccaggaaaccagggaccaattcacattgtgcccatgcaaacaccagtgggcatgaggaggtaggggtcgtaagagggagagcacgtgaaggtatcattggacgccctctcgcgttgggtcctttgtgcacagcaacgtgggggaatctgccccacgatgttgtcgctataacagggaagcccttccacattcacacattgcgataatttttgagctcgcaaagcgttatagcacacatcaacgaaagattatctccagtagtctaataacggcgacaaagggcattcctcttttggggacatcgaaacaggcggctgaattgatgcgaccggaattggacaaactacgacgggttacaacagaggaagccacg

SEQ ID NO: 530485 - DNA, 268 bp, Homo sapiens
gtaattcctacgacacggccgagagcggcagacactggttttattgtgtattaatatatctataattaataataataaggacagaacatagtatagaacacatctattgtagattaattcttaacaaacagagaggacaactagacaagatagcaaaagaagacaaatacaggagaaaacaaaagacaacaagagagagcagacacaaacaacgaaaaacatacacacgacaaagaaagacaaaaacagacgaacaagagagaacaaa

SEQ ID NO: 530486 - DNA, 800 bp, Homo sapiens
  misc_feature (205)..(205): n is a, c, g, or t
aggggctttcacctttccgcatgattttggaggcctttctccgccccgttggaccgtgtagtcctatgaaaccctgtgggtcaatttagcgtctaaatcacgtattgtaagaaaagctaggatgggattgtgagctcttgaggaagtgacttacatatcctacatgtgggactacagtatttccccaagcacagtattctcatcnccaagggtacatactgcttatcatagaggcccaggagggactgtttaaggttgccaaggtgaacgagctgagaggctttgtcctcgggcccagtaactctgaaatctctctttaaatcccccgctgtcccaggcagcagaattagcccatggtttcccccagtaggtagctgctttagcagtttaaggcccaaagtctgcttctgttgatcagaggtctctgaatttttgaagctggtgtttcgtttctggtgactgagcttaatcctttacaatccctccttgtaaatagtgtgctaatagcaaagagatctccccttttcaaagctgcaggacccgaccgtgccctaaattgacccacgtaactgatgtgcctcaggaagtcttttgccagctgtccctgtgaagaccccctcctcccccccagctgctgccttgcacactgaagcattctcaggctgtgccaagccgtgtagtcatcaagaccagttaatcccagggcttggttaagtgctgtgtgattacttgtttggatgagactcttacttttaaccacttacaatcaacttgggaaactaaattccgaaaggaaaaaa

SEQ ID NO: 530487 - DNA, 821 bp, Homo sapiens
  misc_feature (645)..(645): n is a, c, g, or t
gctgggaccctgtacacgtatcctgacaatgtggagggagttcaaggctctcatcgttgcctcagtacagcggggctcaggtccggtgctctccgcagcacccagttccatttggcaaagcaacggagccctgaattgctccgcgaatttcctgccggcaaggtcccagattgagggtgatgatggattcctgtgtgttggagagcaacgccattgcctactatgtgagcaatgaggagctgcggggaagtactccagaggcagcagcccaggtggtgcagtgggtgagctttgctgattccgatatagtgcccgccagacagtacctgggtgtaccccagcttgggcatcatgcacacaaaaacaggcactgagaatgcacatggaggaagtgaggcgaattctggggctgtctggatgcttacttgaagagcgaggacttattctggtgggcgaacgagtgacattggtgacatcacagtttgtcttgcaaccctgtatgtgggtctataaggcaggttctagagccttctttccgcaggcctttcgcaaataacaacggtggttcctcaggctgcattaaagcagggcccaaggtccgggcttgtcttgggcgaaagtgacacttgtggtgagaaagatggncccagatatgaatgctaacaaagtttggagagaccccaagcttaaaaaggacacacccacggaacgagcggggtccacgggaagaagaagcagaagcaccaggtgagggaaagagggagacaacaaggcggtgcctggtctgaggaggagcatggatgatgtgaacagaggcggtg

SEQ ID NO: 530488 - DNA, 766 bp, Homo sapiens
cagacgtctatagggcccctctctttggccactctgcctcgtaggatcccatccagggggcctgaagcgcatgtgtctctgcgcgggcgaaaaggggaacgactggagcgatccagcaccacaaacttaccctgtccaggtggaccacgaagctacccaagacatctctgcacagccctagcctttttggcttcacccactccgttcgggagcttggggacccggcactctacacttccttcaggggaactccagtctccaggctctgacgagctcacctggcagctaccagcacagcatcactggcggaccctgcgggcagcagcccagagcatcctggctgctggcgcccccgaaggcgcgatagccttcagagcctccagtgcctgctgcgggctggaggtgaagctagggggaccatggatgctgctgctggagctcaccctcctctgcagcctggtgcccatctgtgtgctgcgccggccacgcgagctaacccatgaaggctcagcgttcccgtcagaaagcacctgagcctagctcacctgccacgccgcggagcgccatcaccggccactagactcctggacctgctgcctgactacctgggcgacatacatgaacgcccggccagactggacgtgacgcctcccagataccactgcacgagatcataccggacatgcgcctacctacctggacccggtgactgacacagaatccacagcgcctaaaccgagcagacacgacggccacattgcacccc

SEQ ID NO: 530489 - DNA, 419 bp, Homo sapiens
aatgttgtggcgagcctgagactgcaactagttctttcagatacagtctgtgccccaaatcattaactgcgcaagttcttcgtgtacttggaatctccttggggttacttgataacttgtgccattaactcctcatcaagccaaatcccggttcccaactcgacctttccattgtttaggatatacttgtccatgacaggcgcaagagcgaggttaatagtgacaacgtatattgcttcctcactgaaagtgctccgtaactccggctcgggctcgagacattctgactttactttttccagatcaatggcgggaccgctgccaagcctcaggagcaggacgtcctggagcctccggttaaggtctcggagctccttcatttcagacacgagtgccccgtactccttgagcttcttggc

SEQ ID NO: 530490 - DNA, 421 bp, Homo sapiens
  misc_feature (360)..(360): n is a, c, g, or t
actactattactaatactcccccagagttagtattaatactatactattaataacagtgtactataatgcctaatattattactatactatgaacagataaatcagtggaggccttaaggacattaaaggaatggaccacattgcgcccaggtgtggtggctcatgcctgtaatcttagcactttgggaggccgaggcaggtggatcacctgaggataaaattattcttttattctactaaaaattaaaaaaaaatatagcccaggtgtggtggtgggctcttgtaattccagccacttgggaggctgaggcaggaggatcgcttgaacccaggaggtagaggttgcagtgagctgagantttgccactgcaccccagcccgggcaacagagtaagggtaagactgtctccaaaaaaaaaa

SEQ ID NO: 530491 - DNA, 144 bp, Homo sapiens
  misc_feature (128)..(128): n is a, c, g, or t
cccctcacaaatcaatttgcccaggcagcagccaaactcaagcacccccgcaaaccagcacgcagctcacctcaagcaaccagctcaaacagcagctccaccgcgtctcatgtcagcggcgacatcangtgggcaagcatttca

SEQ ID NO: 530492 - DNA, 178 bp, Homo sapiens
ctgggaggtgccagtgcacccataataaaagcatggcagaataatgcggaaagactacacagctttatcttctggcctacaacttctctcccatgactggatggttccttcccttaaacgttggactccaagtcctttacctttttgactctggacctttgaccacggactaaatggc

SEQ ID NO: 530493 - DNA, 782 bp, Homo sapiens
aaagcggtgtcgccggattacgggatgtgcacgcaccgcatgagcggcgtccggctgcgcgcctgctctcggcgccctgggctgtgtcctgctcctgcccctctcctcttcctcctcttcggacactgcggccctggagccggctcctggccgccctgccccgtgggtgctgctggggagaccggagcgtgggtgtgcctatgtggcccggggaggggagcgtggggggtgggggcggcgggggtctggctgcccgggcattgagtgctgtgaagagccgcaagaggctggcaggggtaaatgcctggggcagcagccggcggtccgggtgtacagcggccgttgtgctcgtgttgccaagagcccgctaccccggtgtgccgggcaagcgacgggcaccacactaaccccgagtcgggctggccccaaggctttgcgccgacccgccaagccccacgagggggctccggaaggatgcccccggcgcgtggcatggacatgtggcgcacattccaacccaccaatgagcgttacaacagcaaatcgagggggcagaccccttggccgggaatggcaagagtggggcttcccttttcacacaaagttaatggtttggaatctgacctacgcaccctacaagaggggggatagcaaattcccttggtcgacaacttcgggttccaaccttgggggcatggccccccacaacagtggttgcctcaccctatcagaaggaccttcggttggcaaacggatccaaccttccgcgcgcaaacatcccc

SEQ ID NO: 530494 - DNA, 868 bp, Homo sapiens
  misc_feature (23)..(23): n is a, c, g, or t
  misc_feature (76)..(82): n is a, c, g, or t
  misc_feature (84)..(84): n is a, c, g, or t
  misc_feature (170)..(170): n is a, c, g, or t
  misc_feature (190)..(190): n is a, c, g, or t
  misc_feature (286)..(286): n is a, c, g, or t
  misc_feature (299)..(299): n is a, c, g, or t
  misc_feature (304)..(304): n is a, c, g, or t
  misc_feature (324)..(324): n is a, c, g, or t
  misc_feature (340)..(340): n is a, c, g, or t
  misc_feature (398)..(398): n is a, c, g, or t
  misc_feature (481)..(481): n is a, c, g, or t
  misc_feature (493)..(493): n is a, c, g, or t
  misc_feature (507)..(507): n is a, c, g, or t
  misc_feature (514)..(514): n is a, c, g, or t
  misc_feature (520)..(520): n is a, c, g, or t
  misc_feature (552)..(552): n is a, c, g, or t
  misc_feature (577)..(584): n is a, c, g, or t
  misc_feature (589)..(589): n is a, c, g, or t
  misc_feature (596)..(596): n is a, c, g, or t
  misc_feature (598)..(604): n is a, c, g, or t
  misc_feature (631)..(631): n is a, c, g, or t
  misc_feature (641)..(641): n is a, c, g, or t
  misc_feature (644)..(644): n is a, c, g, or t
  misc_feature (648)..(648): n is a, c, g, or t
  misc_feature (653)..(653): n is a, c, g, or t
  misc_feature (679)..(679): n is a, c, g, or t
  misc_feature (696)..(696): n is a, c, g, or t
  misc_feature (707)..(707): n is a, c, g, or t
  misc_feature (716)..(717): n is a, c, g, or t
  misc_feature (720)..(720): n is a, c, g, or t
  misc_feature (724)..(724): n is a, c, g, or t
  misc_feature (730)..(730): n is a, c, g, or t
  misc_feature (736)..(736): n is a, c, g, or t
  misc_feature (738)..(738): n is a, c, g, or t
  misc_feature (743)..(743): n is a, c, g, or t
  misc_feature (747)..(747): n is a, c, g, or t
  misc_feature (749)..(749): n is a, c, g, or t
  misc_feature (755)..(757): n is a, c, g, or t
  misc_feature (775)..(775): n is a, c, g, or t
  misc_feature (792)..(792): n is a, c, g, or t
  misc_feature (849)..(849): n is a, c, g, or t
tttataataataattgttataanaatataatcaagagggaaaactgtttgtagtaaaggcaaaagcaaaaccagannnnnnnanatgattatattcttataacaattattattatgtactttatttttacttcaatggcaggaattcgaaatattggcatatggttcttntggattagattatataaaancagaagaggtagaaccaggccccaagcactcctttttctctgcatgatacttctgcttattgtccttcacactagctacatgatttatagtcttgntccccaatatgtnatgtntggaagccaaaattacttantagagactaatataanttctgataatcataaaggcaattcaaccctttctgtgccaaagagatgtgatgcagangctcctgaagatcagtgtactgttacccggacatactattccttcacaagttctggttcttcagtgcagcaaacaaaaaaagnaaccgggcctcncttggggtattttngaaaggncccccngcctcctgtcgtccagggaagaaatcggttanaaaaaaaaaaaaaaaaaaaaaaaannnnnnnnggggnggggggngnnnnnnnccccccccccccccccccccccccccngctttggggnggngggngggtntctgttatgcattttttaagtattancttacatttgggtttgntacttgctttnataaaaaannganaaanaaaaanaaaaananatttntttntntttttnnngtatattgtatatagatnacatttaattacatatnatgctatgtaatatagatactggcttgtgaggatgttgtgcaaatttttctctatgntatagtgttaatgattaaa

SEQ ID NO: 530495 - DNA, 862 bp, Homo sapiens
  misc_feature (238)..(238): n is a, c, g, or t
  misc_feature (258)..(258): n is a, c, g, or t
  misc_feature (354)..(354): n is a, c, g, or t
  misc_feature (367)..(367): n is a, c, g, or t
  misc_feature (372)..(372): n is a, c, g, or t
  misc_feature (392)..(392): n is a, c, g, or t
  misc_feature (408)..(408): n is a, c, g, or t
  misc_feature (466)..(466): n is a, c, g, or t
gttgcattgctgtttgtaatttctctcttcttgtccaaatttagataaagctcttcattcagctggaatagattctggtttcataatttctggagctaacctgagtaatccactgaatatgctttggcctttactacaaacagttttccctcttgattatattcttataacaattattattatgtactttatttttacttcaatggcaggaattcgaaatattggcatatggttcttntggattagattatataaaancagaagaggtagaaccaggccccaagcactcctttttctctgcatgatacttctgcttattgtccttcacactagctacatgatttatagtcttgntccccaatatgtnatgtntggaagccaaaattacttantagagactaatataanttctgataatcataaaggcaattcaaccctttctgtgccaaagagatgtgatgcagangctcctgaagatcagtgtactgttacccggacatactattccttcacaagttctggttcttcagtgctggttactattttggtactgggcctttcttggggtatatgatcggtcactttgtatcctgttgtaaagggaagaactcggtgatcgaaggagtcgatgaagattcagaccataagtgatgatgaggcctctggtctaattctggttgacaagccttctgtcttaaagggtttataatgcttactggaatatctggtaatgcatttttaaagtattaaactaacatttaggattggtaactaagttaccaaacatggggacatggtattagaacactatatttataaatgtttggaataacctgggtctaattacctttaatttcctaac

SEQ ID NO: 530496 - DNA, 901 bp, Homo sapiens
  misc_feature (901)..(901): n is a, c, g, or t
gttaatccaacacagtcatgcaagttttatttctgggatgcaaggttgattcaccatacagaaatcaataaatgtgattcaccaaataaacagaatcaaaagcaaaaactacatgatcatctcaatagatacacaaaaagcctataatataatccaacatcccttaatgacaaaagccctcaacagattaagcattaaagtagcatacctaaaaatagtaaaagccatctacgacaaacccacagccaacgtaatactgaatgagcaaaaactggaacggttcccctgtgggaaccggaacaagacaagtatgcccactttcaccactcctattcaatatagtactggatgtgctagccagcgcaatgaagaaagggaataaataaaaggcacccaaataaaaagagagaaaatcaaactctctctctttactgatatgattcaatacctagaaaaccctaaggactctgctaaggtctcctggaactgatacatgacttcactaaaattttaatatactaaaccaatgtacaaaaaatcctaacatttttatacaccaaatatgttctaggggagatccaactggagaacagaatcatttacatagccaaaaaagaaaaaaaaaaaaaaaacaaattgtggggccgtcggacccgcgaaaatttttgaaacctcgggtgggggcggcgccaagagtaagtaagggcatagagggtccagaaacgcgggagcaagggtgtggtttcccacaaaaaagccgggggagcgctggaaaccagagctgggtcagctcacaagaccggtagaccccggcgcagggacaaccgaacaccagaaccacggaccgacaagcgtcaacaacagacacagagcgaggaacaacacaagagacaacacacan

SEQ ID NO: 530497 - DNA, 3900 bp, Homo sapiens
  misc_feature (3374)..(3374): n is a, c, g, or t
  misc_feature (3646)..(3646): n is a, c, g, or t
  misc_feature (3900)..(3900): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 530498 - DNA, 2467 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggcctt

SEQ ID NO: 530499 - DNA, 322 bp, Homo sapiens
gtgtgtgtgctgctgtgtgtgtgtgtgtgtggctgtgtgtgtgtgctgctgtgtgtgtgtgtgtgtggctgtgtgtgtgtgtgtgttttagctcccttggtcttgtaatgcagttaactgtgtgtgtgtgcgtgtgaacactctctgaggtctctggctgtgtataaaagtaaaggctttgtttcaccgtggctattttgtggttaccatggtaatcatagatttgttgagagcaacagggttaattctattcagatctaaatgaattcaagttaccgtaaacagaagtcagaatagatcgagtagcagagtgatggtcgac

SEQ ID NO: 530500 - DNA, 332 bp, Homo sapiens
  misc_feature (45)..(45): n is a, c, g, or t
  misc_feature (156)..(157): n is a, c, g, or t
tctctcggaggccccctaataccgagtggagtgtgggttcacccntggggggtgtgtcgctgtgatgggacacgtaggagtccgcgcttgaaaccagggccctgtgccgcggggctgccgagtgggtgtgtggactcggggccttcccagcaaaanncctctccggctctgggcccgagacaaccgcgagccccagccggtgaagggtactgggagcggctgggggttggtgaagtcgtgtctggtattgtgtcccctctatggacaaatgtatatgttaggtctcaatttgtgtggttaagtaaaaataaaaacattttcagacgaaaaaa

SEQ ID NO: 530501 - DNA, 519 bp, Homo sapiens
  misc_feature (402)..(402): n is a, c, g, or t
gctcgacctctgttgcctgagttaggaagatctgcctagctaaggctgagttacacatacaaaggaaagcagaccagcatgggcaccatagtgagaccccgtctacaaacaataacaaaaatttggccaggtacagtggccaaattacacctgtaatcccagcactttgggaggccgaggctggcggaccgcttagggccaggagttcaggaccagcctggccaacattgtgaaaccccatctctactaaaaacacaaaaatgagctgggcatggtggtgcacacctataatcccagctacccgggaggcggaggttgcagtgagccgagatcacgccactgcactccagccccggtgacagagcgggactctgtctgcaacacacacacacaaactagtgnggtgtggtggcacatgctcataagttccagctactcgagaggcttagggaagaagatcgcttgagccaagaagcccaagatgccgtgagctatgattgcctgtgcatccagccgggg

SEQ ID NO: 530502 - DNA, 4929 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtctcagcaggcgccacctcctctgtgccagcagctttagagaaggctttaatccccaggacggaggcagggtgctctggtttaaggccgagctagcgattcccctgatgcaacctgtcaggttcactatctttaaaatgggaagaggaacaatctctcttttcctttaaggatgtgataggatcagataaagggcttcggaataagggagttctgtgagtgcacaggctcattcactatcattctcctcctctgttagggaggagaatggtggctggagtccccagcaatgaggacgaagagcagtgtgggaatggctagacctgtttttgtttgtttgtttttaacagaatagtaaactcggagctgcatagaaccttattcagtgcctccttttacagatgagggttgaaactcggagaagtgaaggttaaccctaaccttttacccaaagacttgcagtttttgtgtcctctgattaaataagtggggagagggtgcttttcctagatcaggcaaggggaggtgtgcttttttccaagacctatgggaggagtagaatacaggccgggcgtggtggctcacgactgtaattccagcactttgggaagccgaggcgggtggatcacttgaagtcaggagttcgagaccagcctggccaacatggtgaaagcccgtctctattaaaaatacaaaattagctgggcacgcctgtagtcccagctactcaagaggctgaggcaggaaaatcacttgagcatggtaggcggagattgcagtgagccgagatcgcgccactgcactgcagcctgggtgacagggccagactctgtctccaaaaaaagaaaaaaagaatgagaacatacacattctgaggcactgtagccaggtacatggagctgcaggcagtggtggctgtgaccagggagaaggcaagtcagtagtgcagtcaattctttctccttcagggcgaggactctgcctatccctgtgaaatgcctatgctttcatctatgtttggtctcttctcccccgtctcccctcagggtcagtgaagtttaacaagggctatactgctcttagccagagtccagatgaaaacctggtgtccctcgactctgacaggtgagtgctccccttggaaatacccccttgggaagcaacttggctgggactgaagatcgcctgatgcctttgcttgttccctgtctcctccaaggcccttcatgtacattccagggccgttctcttctgaacaatatcccttcccaggatggcttggttagaagactcataggtaatcgtgctgctctagaattcggagcaccaatgtccgggggatcatcctgccctgttatgtttgcattgttagtgagagtgaccctgtccctgccagaaccaattgagggaaccagtattattcaaggcctgttcggacttgagttctgttgtgtgtggcctttgcttcaaaagtcttccagatgcccttgcatgctctccgcctgatgatttacagctgtgcaccacaggtacctcccggaactgactgttttcctcttctcctagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530503 - DNA, 3441 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530504 - DNA, 752 bp, Homo sapiens
  misc_feature (304)..(304): n is a, c, g, or t
agcggctctgttctcgattaccttgggcaacggctgaggcgcggcagaccggtggctctgcaccgtccatggtagggagatatgagtggctggactctcagccagccactgggatgtgttcgcggctttggagcttgatggccggagagagctcccgagaggaggcggctgccagcgttacgtgtcttctgacggtggacggtacgactttggggtgtttgcgctctaggattctccgctgcccgtttcctctgaacacatggaccaggagagggaagtgtgactctgaaaggtcacacgtaantacatttttctaaggagctgaacaacgaatccaagtcgctgtcaagctgtcgagagtactgagtagatcttgctgctgtctatactcttggaaagcacatcctaggatctttgctagattatcctgtggaaggaaatatgcctaatagtcaatgagaacgccggacagcacccccagatggctgggagttggatcgagccaacagtggatgaattagatcagatgatgagagaagctgaaacagaagcgcctgagggaacagaggaacgtggaatctctgtggcccatcttcagagatccgaccaccagaataagcccgcgtaccatcttcgagctcttttacaagcggacgactgccgatcgatgagagaactctatgaagtatgtatgaaagaaggctatgcagacaaaagacctggttgcgaattgggaaaaagcaggatatgag

SEQ ID NO: 530505 - DNA, 335 bp, Homo sapiens
ggaaatgttagagatgtcggctgtgcccagtgggcgtctagggccggcgtgtgggctaccggtgttgtttgccactgtgctctaagcgcggtctgatcttgtggcacagatttcataggaggcatgccgagaggtcaggtcttctatagaacactggtttgcaatattgcgatcttatccgacagtgtaacccgtgttagatggatcctgattgcaaaggatgcctttaggaagaagcacaatttggaaccagctgtgttcaagagatattcttgtagttcgcggatgtaaaggttttggacgacaatgggaacaatggtgtagctgagcttctc

SEQ ID NO: 530506 - DNA, 4234 bp, Homo sapiens
gcggccgcgtccccagggcgggttccggagctccgctgggcctcggccccggagggaaggggttagctgcagcctgctctcgcccctcaaaatccgttcggaaagagcggcctcccagccttcgggagacgcggcggagtggggaagacccggctgacccgggtcctttaacttccagagaagcaccgggacctggccaaggccgttctgcggagaaaaggcatgctgggggcctcgccgaaccgcccagactcttcagggaaaaggtctcagcaggcgccacctcctctgtgccagcagctttagagaaggctttaatccccaggacggaggcagggtgctctggtttaaggccgagctagcgattcccctgatgcaacctgtcaggttcactatctttaaaatgggaagaggaacaatctctcttttcctttaaggatgtgataggatcagataaagggcttcggaataagggagttctgtgagtgcacaggctcattcactatcattctcctcctctgttagggaggagaatggtggctggagtccccagcaatgaggacgaagagcagtgtgggaatggctagacctgtttttgtttgtttgtttttaacagaatagtaaactcggagctgcatagaaccttattcagtgcctccttttacagatgagggttgaaactcggagaagtgaaggttaaccctaaccttttacccaaagacttgcagtttttgtgtcctctgattaaataagtggggagagggtgcttttcctagatcaggcaaggggaggtgtgcttttttccaagacctatgggaggagtagaatacaggccgggcgtggtggctcacgactgtaattccagcactttgggaagccgaggcgggtggatcacttgaagtcaggagttcgagaccagcctggccaacatggtgaaagcccgtctctattaaaaatacaaaattagctgggcacgcctgtagtcccagctactcaagaggctgaggcaggaaaatcacttgagcatggtaggcggagattgcagtgagccgagatcgcgccactgcactgcagcctgggtgacagggccagactctgtctccaaaaaaagaaaaaaagaatgagaacatacacattctgaggcactgtagccaggtacatggagctgcaggcagtggtggctgtgaccagggagaaggcaagtcagtagtgcagtcaattctttctccttcagggcgaggactctgcctatccctgtgaaatgcctatgctttcatctatgtttggtctcttctcccccgtctcccctcagggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530507 - DNA, 3882 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacaggtgagtgctccccttggaaatacccccttgggaagcaacttggctgggactgaagatcgcctgatgcctttgcttgttccctgtctcctccaaggcccttcatgtacattccagggccgttctcttctgaacaatatcccttcccaggatggcttggttagaagactcataggtaatcgtgctgctctagaattcggagcaccaatgtccgggggatcatcctgccctgttatgtttgcattgttagtgagagtgaccctgtccctgccagaaccaattgagggaaccagtattattcaaggcctgttcggacttgagttctgttgtgtgtggcctttgcttcaaaagtcttccagatgcccttgcatgctctccgcctgatgatttacagctgtgcaccacaggtacctcccggaactgactgttttcctcttctcctagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530508 - DNA, 451 bp, Homo sapiens
  misc_feature (147)..(147): n is a, c, g, or t
ccccatcaacccaacgagtggataaagaaaatgtgttttatatacaccgtagaatactactccagcccataaaaaaggaatgaaataatgtcttttgcagcaacttggatggagctagtggcccattattctaagtgaagcaactcnaggaatgaaaaaccaaatatatgttctcaccttataagtggcagctaatctatgaggatgcaaaggcataagaatgatgtaatggactttggggacttatcagggaagttcaggaggaaaattaggtataaaagactgtatattgggtacactgtacactgcttgggtgatgggtgcgttaaagtttcagaaatcaccactaaagaatgtatccatgtaaccagaaaccacctggaccctaaaaactattgaaataaaaaatttttaatgtggctgtttcttataaagtgaacaatacatttac

SEQ ID NO: 530509 - DNA, 3431 bp, Homo sapiens
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcggtcagtgaagtttaacaagggctatactgctcttagccagagtccagatgaaaacctggtgtccctcgactctgacaggcccttcatgtacattccagggccgttctcttctgaacaatatcccttcccaggatggcttggttagaagactcaagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530510 - DNA, 3067 bp, Homo sapiens
  misc_feature (175)..(175): n is a, c, g, or t
aagctgctcaccatgaggcctacagagccctgttggccactcatagctcacacagtgcagtgacagtgaagtctggacagtactaaggcttactgctggctgaggcacaagtaggagaaggtggtactcctcctgtagtccagggatgtgtggggttggcctggggtggacatgnacaggaagccctggtaacggaatgtggttctgtcttttgggtagcagttacttctgctttgcatcttggcctatagttccctcctctccttctcttagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530511 - DNA, 356 bp, Homo sapiens
tcgaatcgagctcggtaccagtaaacgagtaataagagaagagaagaatctgtagaagccagaggggaaaaacactttgtttatatgtggcgcaggaatagtggattacaggtgagacttctcagtcagaaaccatgcaagtgagtaaagagtaggataaaatatttcaagctcccaatggccaaagctagaactgttaaagcaacagaataagatagtactggattaatatgcaaagtagtaaaatcaacagtctcggagtccatttgatataagtaaatagttgaacagtacagaataataaataagaggtgaagagacaatggaaatctttatgcagaattccaagtaactta

SEQ ID NO: 530512 - DNA, 3269 bp, Homo sapiens
  misc_feature (377)..(377): n is a, c, g, or t
cgtggagtctcagagctccttaagaggtgaaggcagccgggcgcggtgtgtagacaaagctgctcaccacccccttccactgtaacccatgctctactacgctagcccattgttctgttattatcccatattcttcagctttgatagggactagtctgggctcccagtgggaactgtcagagcactgattttcaaacatattgggaactcgatatttacctgaatgcctcaggatttagtgagaacagatcctgggggtcagtgacagtgaagtctggacagtactaaggcttactgctggctgaggcacaagtaggagaaggtggtactcctcctgtagtccagggatgtgtggggttggcctggggtggacatgnacaggaagccctggtaacggaatgtggttctgtcttttgggtagcagttacttctgctttgcatcttggcctatagttccctcctctccttctcttagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 530513 - DNA, 198 bp, Homo sapiens
cccccccaaaggccccccggggggggacccccccccctttgggggggggggggggggccccccccggggggggggttgggggggaattttttccccttttttttttgccccccaaggggttccccctttttggggggggggggtttttccccggggtttttggggggggtttttttccctttttttttcccccccgga

SEQ ID NO: 530514 - DNA, 3933 bp, Homo sapiens
  misc_feature (3407)..(3407): n is a, c, g, or t
  misc_feature (3679)..(3679): n is a, c, g, or t
  misc_feature (3933)..(3933): n is a, c, g, or t
ccgcctaccccaaaaccgagaacggaactgcccggtcccccgaaaaagaagggcggaacatttcggccaagtcctcagactaccgaaccggagagctccgaaaggggactacctgcgcctgcgcaccgccatcttgttaaaagagcccgcctctccctcggccggtcactctttcgccacgggcggggttgcaccatccggcagggcggggcccggccatggcgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtcagtgaagtttaacaagggctatactgctcttagccagagtccagatgaaaacctggtgtccctcgactctgacagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttaaaaaaaaaaaaaaanaaaaaaaaaaaaaaaaaaaaaaaaaacaaaggaggggggcgggggcgcctcccaaagaatctacccccggggggggccccacagttttagcgcgcgcgcccccgattttttggtcaaagggggggccccctaaagggggagagcgcgcgttatataaaagacggcagaggcccggaggcgcgcggcgttttaacaacaaccgggcgggcagaggggaaaaacacagctgtggatgagggtggggaatctcttggggaggaggagaacccccntctactgctagcgggagggggcgacaaattagtgtggggaacaacacatatcctagaggggagtttatataaggcgtactagaagggaatatattacagaaattggaggtggtataatgagggggtgtaaacacgaagggagaattttggatgcgcagtgggttagtagaagttgttggagctagagcgggggatgtttgatctgttaggaaaagtattattatacgaggggcttgtgctagtatataagatgn

SEQ ID NO: 530515 - DNA, 982 bp, Homo sapiens
agcgggttctcctgcgtcgctccgggagctgcagacggacggagcgccccggcgaagcgggcgacgaactgcgagcgcggtggacttggccagaatgcgataacgcagtagtaaggtgctgctactacggaccgaggtagcgagttgcccgagcggagcagcccacaacaagcacatgggcgaggtgctgacccccgagctgtacgcggagctgcgcgccaagagcacgccgagcggcttcacgcatggacagacgtcatccacgacaggcgtggacaagcccgaggccacacacgtacaatcatgaccagaagggctgcagtaggccgggcgaccgacggagtaccatacagaagctgtagcaaaggactcatctatcagaaacaccagtcctcagacggacacggacacggacagggctaacaaagcccagccgatgagcacagagagcgaaacgtcaaccaccgacagaccgtgcagggccgagccgacagaccatggaacccaaactacagatgctgacgctcgcagggtgcgcacgaggacacagcagcaatccgaggcttaacatgccttccccacacgacaaatgcaagccagcggggaagcgcacgagccgatcgagaacgcatacgacggagggaaagcaccatgtaacaagcctgggacgggagacccaggacacggagccgaatacctaaaggcagacacaaaggagcagtgcagcggaagagcagagagacacagcacagacaagagtccaatgacgaacagaaacgcaactgcagctacatagcgaagcaaagaccaccgggagtcagaccacactgggctagccatggagaccatccgagggaacaaagaggacccggacgaagcagggccccggaacgccaaggaaggagacttcttggcgccaccaggcggaacccagtaaaacgaaaccgtagcactggaggcagtagggcccaaacgcacgaga

SEQ ID NO: 530516 - DNA, 522 bp, Homo sapiens
  misc_feature (254)..(254): n is a, c, g, or t
  misc_feature (368)..(368): n is a, c, g, or t
  misc_feature (409)..(409): n is a, c, g, or t
  misc_feature (423)..(423): n is a, c, g, or t
  misc_feature (481)..(481): n is a, c, g, or t
  misc_feature (521)..(521): n is a, c, g, or t
aattcgcggccgcgtcgacacggctgcagaagacgacagagcgagattccatcccaaaaaaaaaaaaaaaaaaagaatgtaatactttaaaggttaccaaatcttaacaaattcttatagcctgggtccttggtctgtgatatattacacaaaaatgtgatgatataatggctttggaatcaggtagacctggattcgaatcctgcctctgccttcattaactgtgtgaccttaaattaagcaagttatttctntaagtcccgtttttccatctaatccttcctcccttttttttaaaggagggatagaaaagttaggcgaaattagggagcatatgagagcgggtagaatgctgccattcataaacntgtatcaattttgaacattgagagaagagagtagcaggagngagtggtgatagcngaaaccatgaggccactgggtcctaaggccagggccagacctaaccaattagtcaggngagagtaagacggtagacccattgtaatttggatggttcnc

SEQ ID NO: 530517 - DNA, 1242 bp, Homo sapiens
tgtgctgcagtgagcctgcagggccgtaggcagccatggcgcccagccggaatggcatggtcttgaatgccccacttccacaatggacttggcagctggctgctgtggcacactgtggttcaaccatgcctggccctgtaaggatcctgcatgactgtaatgtgccctgtgcaatgccaatggctgctgcctgcaatctgcccctgtgcccctgctgatctggagtcccagtcctgtgcccagtctgttgctgcattgcccacactggattctgagtacgcacactgacagtgtgctgctgcctgtgcctgcggtgttatcaggccttgggatgggaagctcatgtggattgagcctgggcgattacacaatgaacgtgttggccccgtgacccattccggcagtttcttgttggatccctggacggagggctgtgaaaccaacgttccaactggatgatccacttgacatgtgcccatacggttgcaagagcgagcctgacacttgagtaaccggctaccaggacctcaatccatcattacgccccagtgaactgcccatcgtggacaccccaaggaaggtggcagaccagtttcttggcttgacagacacttgacaacttgggcccaaccccatggctgaccctggaccctgtggtcaattgccctgtcacgggaacgcgtctcactaaagcaccgcgagacacagctcgacgttcatcacttgaaggaacggacgaacgaatttcaaaaatggcctatcgactatgtcctcgcgtattgggccctgttgccaaacgccccggacttctctcgggccataacggtgccaaaagaaatgcatgccaatggcaaggcccgtcaggaacccagggattgttttgaaaactacgcccacacacattaaatgccccctcacattgggggaactttggcacatccaaaacgcaaaatgggatcattatgaaacacatccaggcgggagacatacaaaaggaacaggcaggccgcgcgcgagacaagcacgagcggacaactagacaatcgtgagccaatttggggtgagcaaacagttggagaacccttcagacccacagcagttacttatgtggtcacacacacatgtgtgaacaacaatctgcagcggcgcccaccaaaaaaagctgctgcactgaatatataatatacagaaaacagccacgtgtgaaccctcgaagaagacaatacagtgacagacgaatgg

SEQ ID NO: 530518 - DNA, 633 bp, Homo sapiens
  misc_feature (77)..(77): n is a, c, g, or t
  misc_feature (89)..(89): n is a, c, g, or t
  misc_feature (134)..(134): n is a, c, g, or t
  misc_feature (139)..(139): n is a, c, g, or t
  misc_feature (183)..(183): n is a, c, g, or t
  misc_feature (185)..(186): n is a, c, g, or t
  misc_feature (207)..(207): n is a, c, g, or t
  misc_feature (217)..(217): n is a, c, g, or t
  misc_feature (226)..(226): n is a, c, g, or t
  misc_feature (244)..(244): n is a, c, g, or t
  misc_feature (247)..(247): n is a, c, g, or t
  misc_feature (454)..(454): n is a, c, g, or t
  misc_feature (496)..(496): n is a, c, g, or t
  misc_feature (524)..(524): n is a, c, g, or t
  misc_feature (578)..(578): n is a, c, g, or t
  misc_feature (581)..(581): n is a, c, g, or t
  misc_feature (603)..(603): n is a, c, g, or t
  misc_feature (622)..(622): n is a, c, g, or t
gcttccaagcaggcggatgtgaacttggtgaacgtaagactgctggtgaaaaaggctggcctcaatgtcacccctcnccaaagccttgntcaccaggggagcaaggttcggggaatgctctggccgtggcctgncaggngccccttccaggctgtgggcttggtccaaggcactacacctgtncnncaggggctcaatggagctgtnttcaggccanaagtgcctntccgcagggacctgcccntgntcctattccggactcagacctctgaccctgcaatgctgcctaccatgattggcctcctggcagaggcaggggtgcggctgctgtcctaccagacttcactggtgtcagatggggagacctggcacgtcatgggcatctcctcctttctgcccagcctggaaggcgtggaaccagcttgtgactgaagccttccagttccacttttanccttggagctcactggtccctgcctttggggcttttttgaanaaaccccccccctgtgatcaataggganagaaaatccccatttttgggctgaacgcgggcctttgacactgcttacactgcnctntgaccctgtagtacagcaatanccgtttaataaagagcctncccccaactca

SEQ ID NO: 530519 - DNA, 597 bp, Homo sapiens
  misc_feature (273)..(273): n is a, c, g, or t
gggagagttcttcaagcaactcactatgtcaacagacacaggtgtttcccttccttcatatgaggaagatcagggatcaaaactcagttcgaaaagctaaagaggcatccagttacgtgacccagttggtaatagcggggttctgttgcacgcaactctgtgtgctatagtggatttatcatacatatctgtaagagatagggcgatacattactacagagatggtctcatgtgcatacttggatccaagcttgccgctgatgtgcatgcccnaagaggcctctgtgttatgtgacggtaagccaactcggactatgtatagcgtcaattgtggcgtcatttcccgatatgtcattccgcgcgtacatcttccttgcgtgccataaaatcccttagacgtccgcttaatgccaaagcaaaagtaagcattgcgtatgtgccttgtgggatctgggttagggagtgagcattgcgtttaagtctacgatgtcattattgattcataagttaccatattgatagtctgcgagatataaactaattatgtatcgggtttacgatgtgtaacgagtggtcattttcgaatcattggggttc

SEQ ID NO: 530520 - DNA, 120 bp, Homo sapiens
gatccttaccgtacgccaactcttagacacaacttcctagagaaatcttccaggcataaattactatgtaaacagtagctgtgtctggaaaagtgggtacataatttactattccaatac

SEQ ID NO: 530521 - DNA, 474 bp, Homo sapiens
  misc_feature (77)..(77): n is a, c, g, or t
  misc_feature (89)..(89): n is a, c, g, or t
  misc_feature (134)..(134): n is a, c, g, or t
  misc_feature (139)..(139): n is a, c, g, or t
  misc_feature (183)..(183): n is a, c, g, or t
  misc_feature (185)..(186): n is a, c, g, or t
  misc_feature (207)..(207): n is a, c, g, or t
  misc_feature (217)..(217): n is a, c, g, or t
  misc_feature (226)..(226): n is a, c, g, or t
  misc_feature (244)..(244): n is a, c, g, or t
  misc_feature (247)..(247): n is a, c, g, or t
  misc_feature (295)..(295): n is a, c, g, or t
  misc_feature (337)..(337): n is a, c, g, or t
  misc_feature (365)..(365): n is a, c, g, or t
  misc_feature (419)..(419): n is a, c, g, or t
  misc_feature (422)..(422): n is a, c, g, or t
  misc_feature (444)..(444): n is a, c, g, or t
  misc_feature (463)..(463): n is a, c, g, or t
gcttccaagcaggcggatgtgaacttggtgaacgtaagactgctggtgaaaaaggctggcctcaatgtcacccctcnccaaagccttgntcaccaggggagcaaggttcggggaatgctctggccgtggcctgncaggngccccttccaggctgtgggcttggtccaaggcactacacctgtncnncaggggctcaatggagctgtnttcaggccanaagtgcctntccgcagggacctgcccntgntcctattccggactcagtgtgactgaagccttccagttccacttttanccttggagctcactggtccctgcctttggggcttttttgaanaaaccccccccctgtgatcaataggganagaaaatccccatttttgggctgaacgcgggcctttgacactgcttacactgcnctntgaccctgtagtacagcaatanccgtttaataaagagcctncccccaactca

SEQ ID NO: 530522 - DNA, 699 bp, Homo sapiens
ggagagagagaggacgtggtgggtcctctggtgcgaagtccggattccttgggtcttccggtaggagactgtaatcaagtgtagctgacaacacaggagtccaaaaagctgtatatcatcctccgtgaatggggatcattgggacggctgaatcagcattcgcggctgcttggtagtggtgtgacatgggtgactggcgccaggccaaagagagtgccgggaaccagatgctcgagtagatacaagaggtaccatcccagcaagggtccattccggacgaacggaaagtctgttcgcggacaaaagatggcgtgtttgcttgattgcggaaggatagtgcaggagtcatagttgaacaataacaggcgagatgacaggttcctgggcatgagaggaccagtgagcaaaggaagtgtcgcgggacgttgtggccgccgcgaagttggcattgcataagggctaggggagagtcatttagtcgttgaattctgccccatatgagctattggttacaagaagtgtaagagaagaatagctaaaatcgccgggctaatagtggacaataggcccatacccattgacagagaacaaaagggatgctcgccgtcaaattggggtgggagggagtaggagatggagggtcagggcgttctggttgaatgcgtcgtggcagaaccggcgtaatgtgaggggaggaaa

SEQ ID NO: 530523 - DNA, 138 bp, Homo sapiens
  misc_feature (59)..(59): n is a, c, g, or t
gaacagccttgaactgagatatgtgggggtagagctctgtatgatctagggggcgtacngcttaccgaaatcaagcaaacttcgaataccatatatcatgttcaggagtgagtccgtggatgacaaggtcctcggacg

SEQ ID NO: 530524 - DNA, 913 bp, Homo sapiens
  misc_feature (3)..(3): n is a, c, g, or t
  misc_feature (167)..(167): n is a, c, g, or t
gtnaccgtgcgtaaggagtaactggtaagaaaccgggataaggcttctttacgagacatcttttgcaatacttgtgacagtggcccccatcaggtcccaacgtggcacatttgttgtgctccaatagccggttttacatatacccgccgggtttctaaaaaccgttngcaaacgcagccaactatccggcaagtgagcagggggcataaacattgttaccggggtcctttcccatatgcgcgcttcttttgcccacaggtcccgtccacaatttgtctccgaccaggtgcctaatctttttctaggggacccaataattgtaattgggccaaatttacacttttaatgggtccggcgccggatctcctccccctttaaaaaccttggggtagtaatagcaccccccacagcgggaaggttgtgtaataatcaaataccacgaacaggtgcactctgtcggttacaccccagactcttccattttgggacacggaagacccctgcaaatagacccttgtttaacagaggcgaacctgcgcacttttccccggcatttttctcgcccccgccaatttctttgggggattagttcatcgagtacatgagcagagtgcggtatcagggaggcgtgcactataccaggcccatcttgaatgcgaattatgctgagcctcgcgccgccatgtttaatatgccacctctcctgatgatacagaattctgttgaaaatctttggcactgaaccaccaaagacatattggatcccaagtgtcagaaaaacctacacaaagtgggtggatgaggacgcatgcacccccatgaccacccatgcatcctgaatgttaccgccctccggtgcccacgccaaaatcttcaaccctaccgattccaacaaagaaaaacccacaaaacg

SEQ ID NO: 530525 - DNA, 478 bp, Homo sapiens
cggccaatggcagttgtcatggtgtattgtaccccaccccatcccctgaggagacatggtgctcagtccctatgcctggtgccacagccacgagaagatggcatgtttctctagacctgagtattctgtggcgtggcagggtcagcacccctgagtgcatcgaagccatggtcagaggaaagtgttggcaggctcggtacagcgaaagaagtcaggagccatgagacgggtgaagcgtttccagatgcgtcaccttcacagggtcaaaacctccagtagaggcggccgagaaggcatgtcggcgtacccaatcagcatcctgaagtgaggcgtcggatctcatacggggacccctcttccagtcagtggcctccggggaagggcattgtctacatgctggggggggggggtggaaaggcatttgtcccctgctcgcaaggatgtgatcgtgtcttctcgggacccagaacaagggaga

SEQ ID NO: 530526 - DNA, 292 bp, Homo sapiens
aaacagaaattcaaaaactaagaataagaatgagcaaaaattgttctgtggtgagcaggtgcatgaaatcatactcccaaaggttgagggagctgagaggctgaagaaaagaggttaacaaattcagtttctcaacaagaaatattttatagggactcgccaacagaagcaatgtcctgggcaatcgggaggtggtggatccctgcactcaccctccagaaagtactctttatagaacaagcaatttacggtaaaatgcgtgcagctggttacatcttcagacttttttttc

SEQ ID NO: 530527 - DNA, 313 bp, Homo sapiens
tctctagtctatcaggaactagtatacaagagtccttttcatagtcttttccataaactctcctggccagtcttccttgaaatacaaaaagtgacatcacggcgtgctacgattgtggattatagaaaggcaaaagttcctaatcctggaggagcaatgactctgatagtcaaggatgtggagcttgcctcgccagtggctgagttacgagcagagcaagcatagagcccattatgctttggagtaatctgagggataaagagctttggtcctgatagctgaaacttcccattaattgtccaagaatactgtg

SEQ ID NO: 530528 - DNA, 668 bp, Homo sapiens
  misc_feature (14)..(14): n is a, c, g, or t
  misc_feature (40)..(41): n is a, c, g, or t
  misc_feature (57)..(57): n is a, c, g, or t
  misc_feature (59)..(60): n is a, c, g, or t
  misc_feature (70)..(70): n is a, c, g, or t
tctctcttccaacncacctccagtctcccccaagcccccnnacaatgataacctganannctcccagctncaccgccgtggtggacgctgtagaactagcggatcccacggactgcaggaatattttactaggacgcagtggccgacatgactgcttcgctggtggcggctattaatgtttccccaccgccaaacctgaacatgagcagtctctacacgtacctcttctcggtgctcaggacgcccctgtgactggggctaaaatcacctcgcccagatgcacgttttcaagagcgactattctattttcgaaccgataggggcgccggcggtagttccgcccaggacgaggccccttcttcaaaacaaaccctttttactaccgtttacgcaagacgattcagctgcagcgcattttagacacacttgtttaagaataccgacctggagaaactcagagaaccttttgaagcaaccagagggcctatctattcatgagccatctagcaaaggtttcaaacatgaaaccgcaagcttgggcttacaaactgtgtccggggcaccacatttggacaaacatttaaacaaatctttaaaattagaacagaacaagaaaaaacttgccaacaaataccctacctcccctaactctgccacccctcccctct

SEQ ID NO: 530529 - DNA, 287 bp, Homo sapiens
  misc_feature (10)..(10): n is a, c, g, or t
cccaccccgngcatctaacacacgggcacacgtactctgggcttcttaaacttgttcctgaactacttacggagagtggggttgggggatattggaaagaagtctgtgaaatatagcctgactcctgatcttcacctctgcccccacagacaagttcaccgattcagccattgccatgaactcgaaagtgaatggggaacacaacagagaaggtgcttcagcggctgggaggcggggtgacagcaaccagggacgactactgaccctcgacgtctgacactggtata

SEQ ID NO: 530530 - DNA, 346 bp, Homo sapiens
  misc_feature (27)..(27): n is a, c, g, or t
  misc_feature (41)..(41): n is a, c, g, or t
agcgctgcgtagtgtaaacgatcggangatcccgcaaggtnaacaacacagcgaaacgaagatacgaccacgtcattggttttaaaaccttcacgaaagagatcggcgggcgatgcgccgggctcaagcgcaagacgaggcggacgtggcggcatttgtccgcctgcgaccatgttctgatagaagcgctgggcatcccgcctgaaccaaagcctggcgacgggcagacctttttcagtgaaatcggcctcgatcagccgccctttgctgcggttgacatactcggtttcgggtaattgctttactcctcccggtacttcgtttcgctgtgttgttaaccttgcgg

SEQ ID NO: 530531 - DNA, 103 bp, Homo sapiens
agtcgtggtattagatcctagccgattgtatgacgcgtcgtacgtatacgcggcgaggcgaacgaatctctgcaatctggcgactgtcagtggagcggtaggg

SEQ ID NO: 530532 - DNA, 350 bp, Homo sapiens
  misc_feature (46)..(46): n is a, c, g, or t
  misc_feature (164)..(164): n is a, c, g, or t
  misc_feature (188)..(188): n is a, c, g, or t
  misc_feature (197)..(197): n is a, c, g, or t
  misc_feature (219)..(219): n is a, c, g, or t
aagaaagaagggtaacagagtctttgctgggccattcttggggaancctgttattaaaatagccactaggttgggcatggtggctcacacctataatcccagcactttggaagaccacggtgggtggatcacctgagctcaggagttcgagaccagcctggccnacatagtgaaaccccatctctatngaaaatacnaaaattagctgggcatggtggngcacacctgtagtcccagctactcagaaggctgaggcaggagaatggcttgaacccgggaggtggaggtcgcagtgagccaagattgcgccactgtgctccaggctgggcaacagagtgagactctgtctc

SEQ ID NO: 530533 - DNA, 137 bp, Homo sapiens
tatggactttatgtcataacttctgttactcctttggtccatagctaaggtcatccttccccacagggtggctttgggattggatgatacagcttttgttctgtgtacgtatacctgtacatacgcccaggtaagca

SEQ ID NO: 530534 - DNA, 921 bp, Homo sapiens
ggcagacacggtggctcacacctgtaatcccagcattttgggaggctgaggctggtggacctcctgaggtcaggagttcaagaccagtctggccaacatggtgaaccccgtctctactaaaaataaaaaaattagctgggcgtgatggcgtgagcctgtaatcccagctacttgggaggccgaggcaggagaatcacttgaacatgggaggcggaggttgtggtgagccaagatcgtgccattgcactccagcctgggcaacaagagggaaactccgtttcaaaaaaaaagagcaaaacagaaagaaatggagaagtaacgcctcataatatttgtccccagctttttaaattgaagctggttgcataatctggggaatagtccataatttccatgtgttatacagtttaaaaagcctgcaaaaagtgacttgtgctgggttactttctgcctcagattgactattttaaccaaatatgtcacgactagatcatagctcctagctgaataacatgaggtgttttaaagtcaggcctattacagaattaacataagcacaattttaattttatgatatctgatatgcctatctaatactccttatgcattaaatgctggcagataagaatcctgctattttccaaagtcagacgaacttgcacagttggaatcctgaaccctttcattcatcaaggcaaagccctgagtgtttgctcactagtgaatgggtatgggttccagaagggccctcatttcgggggggtcaaatccctgctttaaccttaaaaacccctgtttctaaaaagagaaaagaaaaaacatggcgggatctgggaagagagaaagaaatacttggtggcgcagggacacacccaagggaggaattacgccagggatttcacatctcgcccctcctccccc

SEQ ID NO: 530535 - DNA, 87 bp, Homo sapiens
aatgttttataatgtccctgcccagggacctgttagaaagcactttattttttatatattaaatatttatgtgtaagcatgaaaaaa

SEQ ID NO: 530536 - DNA, 646 bp, Homo sapiens
ttcaagccaagctggaattacaaattgtagcccatttgaaaatgcatacaaatgtgtgacatatacacccagaggaaaagaagtcacagttatgaaagaacaaagtgggaaaatatctttttcatgtaagattgagcattttggttgatactgtgataaaaaatcttgtgactgattctcttttgcattggtttttagtgtcatgtgcactctgcccaactcagataaaattgtatatgatgtaaatagcaggaaactataaatggtgatattgtcctgaaaggaagccacttcatttttcaaagatttcttccgcggcagggatctaggagtgtgcagggatggagttttgcatttctagaggaaacagcaggcagggtgtgtgcagccggaaaggaggcgtctaggttccaagggcaaatcccacccccttagaggggattggagagcctgggaaagaggctgggctgcctgtgatccccaccccacaccctgcctcctacaagcccctagaaggtccacactttgagttgtcagccagagacagtaactcaaaacctcggcttcgggcagccagaagcccagaaatgggggagagggcaggcctagacaccagggatgaaaataaagtgaatattaaaaatta

SEQ ID NO: 530537 - DNA, 158 bp, Homo sapiens
atttcgaattcggaaaggaagaagtcaaattatccttgtttgtagatgatataatcttatatctggaaaaacccagactccatcaaaaagctattaaaactgataacaaattcagttaagttgcagaacacaagtcattatacaacttcagtagtgtt

SEQ ID NO: 530538 - DNA, 259 bp, Homo sapiens
tgagatacaagaatactgcaattagaacaattactaattctataatgggccgaagtgggaggatcacttgaggtcaggagttcaagaccagcctggccaacatggtgaaacgccatctccactaaaatacaaaaattagccgggcgtggtggtgggcgcctatagtcccagctactcaataggctgaggcgggagaatcactggaacccgggaggcagaggttggggtgagccgagatcacgccattgcactctagcct

SEQ ID NO: 530539 - DNA, 113 bp, Homo sapiens
tttggccccccccccccttccccgttccttgggcccccccctaatttttttccggggggccccccccgggggggggttttgggcccttcccaaaaaaaattttttggttttca

SEQ ID NO: 530540 - DNA, 385 bp, Homo sapiens
tggggctgggttatcgccaacatgcccgagcagccttcatagatacagtatcttgaagtctgcttccaggtgtgactctatctccctacagtagttaagtattagagcaggaggtggtgtgtgtaggtctatcgtcaacagttctgccaagcgtttgcttgttcattatctgtgctgaaaaggcagctggaggcaaatctgagaggctaggactgagaaggggtcttaagacaaggccagaagtcagctcacagttgcaggaagatgttctcagtgaatctgaaagccagtttatctctccatggatgttctgacatttgtctcctggtttctgtctttagggcatttgtttacctgagcactctgctgtatcccgtgcccctga

SEQ ID NO: 530541 - DNA, 964 bp, Homo sapiens
gggggaggggcgctctcacctttccaaagtgctgagtgattgggaggcgttgctgcatgctggtctgagcggctggggagggctggtggcccatcagagcagaccccctcgctctgtcaggagcatcagtcctccatgccgtagtgaacgagacacgagtgaatgctgggaaggcatctgctcgacagagatcatcgcgccaggcgagcgcctctaggcagttgggctacttctagtgtatagctcgttcttgtgttctgtgtgtgtattcgacaattgcaagctctcagcgtcgatgtttggccccggggcttggcacgctgcgagttggctgaccatcgtcgcgcggtcagcggtgctaagcgctcttgacctcgcgcagggttcaagaggcgacttcgtccgtggcactctagactgtcccaaggatagcatgcggatgtactagggcagtgtcgcacaccgatagccgcaagctaattgtctgctagtttgaaggtatgagcatgtggcgtttcacctatggtgggatcgggcttggtctcagaaggtcctgcacctctaatgtgatccgacctctcctctggcctcccgaaggtgcgtggggattacgaggcgtgagccaaccgtgcccagtcgacagtcttcttgttcctcagagaccagggtctctctgtcagcccaggttggctgtacagtggcgctatctcaggcttactgcaacctccgccttctagcactcaagcaatccatattcagatcattcttaactatactgcggtagagacacggcctactatattgccaagctggtctcaatcgtcctgggctcaagctgtcctcctgactcggcactcactaaaggtgctgagatgacaggagtgacgccatgaacccggcgcaagtgacttaacttaatacatcagaaggctctgaccctcttcaagccaatcttgggcaataa

SEQ ID NO: 530542 - DNA, 959 bp, Homo sapiens
agcccagcatcccctatcgtgggcgtcatcgctgagctggtctctcttcggcagctggtgatcgctggagctgtggtcgctgttgtgatgtggatgcgagggaggagagcgtcacgatcaagagaacaggagggagctcagtcctcaaggcctggcaaaagacaagtgactagtagcccaaggggctcctgatagtagtgcttctcgacacgcgtggtagaagtgtggacgagagcttggctcgttgtggggcgactgagcatggcaccgatttcgttccgtgctccttcctcgttttgtgactttgagccgaacccttggacctctttgtttgccgtgcacatgggcatccgtgggatgtagtctgtgcttccgtgttggagcatagaagatgctcgaaggacgggtgaggcgaatgaaccaacctcgagacccctaatgatacgaagccaatgtacaccatcttcccatgagctgggcttgatgccttcccgttctaccaaattattcctggccatggttccaccagaggagccgactgaggtgtcctccatcccctggtctcagcattcctgggtgcagcctgaaacctgtaaaatgtctttccttcccctagttaaaagttagacagcctgtagttataacctggggcttctctacgcccattgctgggccatggagaccgttgagtgacgtcacgtcccccggcaaggatctcctgactatttgtgacgaccatctacatggacccactgtgacaacttgcggggaacaccggggtccttggaagactcccaagtagcccgcgaactgcataccccaaaacgaaaaggagaccttgggcgcccggcccactaaggccaacagagggatgccgttgccaccaacacgcggccaaacagggggcgaccccaaaaaaaccccggggcaccctgaaagagaaaggacggggaaggcca

SEQ ID NO: 530543 - DNA, 528 bp, Homo sapiens
cccacaaatggatcccatataggacacgaagcttggtgggcttaagctggttgtccaaaaagtgatgtttttattagtttgattttacccacttttgcctttgcgtttagtctcagtaaaatccaaaattgaaaatgaatccctaatgctactgtattttataaattaacagatttattcttattaatgttttccccttctcttctaaggattactttcgtcccctgcatttaaaggctttcacttatattaatctggcattaagcgggtcttgggtcccgccacttcaaggtttctgcccaccccactgttgtattcgcttattgagaaaacaatgccaaatgtgaagcctcccgttactgggccatttctatattaggacagccactgggccaacaaagttgagaaactcactttaaaccatgctggtttccctttcctttgctattctggaatccccacagtttctttctgtttttgcgaagacacagattatccttatttgggttcccccctggacaccttatt

SEQ ID NO: 530544 - DNA, 135 bp, Homo sapiens
ttcgttctagtgtgtagcgtgagcaataggggaaatcagtgtaatgaagcctcctatgatggcaaatacagttcctattgataggacatagtggaagtgagctacaatgtatatacgtgtcgtgtagcacggatg

SEQ ID NO: 530545 - DNA, 145 bp, Homo sapiens
gcactgctgcggcggggcgtggagggcagagggccgcggagccgcagttgcaaacatggctcagagcagagacggcggaaaccgttcgccgagccagtgagcttgacaacccctttcaggacccagctgtgatccagcaccgacc

SEQ ID NO: 530546 - DNA, 99 bp, Homo sapiens
  misc_feature (2)..(3): n is a, c, g, or t
annggggaaggagaagggggggagtaggggggggtggtgcgtgggggggggggggggtgggggggggggggtcggcgcgggcgggggtcgggcgggggg

SEQ ID NO: 530547 - DNA, 338 bp, Homo sapiens
aaggtttaagttgttagggattttgagtttttcattttattgcaaatctggggtggatgttagactaaaggaaaccccggaatatttacctggtgttacatttaatatttaatgtaactggtctagcaacattaagggggattttttaaaccaactccggagggtgtggggtgcacattttgccctggttttaaaaacttggattcaaatcctcttatcccctcagactcagacccaaggccttttacatggaaatttttcaaattacttccctttatgtaaaaaaacgtcctgtggcccagttgtttaaatggaaaataaagggctttttttaagga

SEQ ID NO: 530548 - DNA, 557 bp, Homo sapiens
  misc_feature (522)..(522): n is a, c, g, or t
tatacgtgttcggggttggtctgtcagtactgcatgacattcttcttcagttgccaagccatcaccagttcatgagtgcattagcgcccgactcgggctggggagttccttcgctatctgttactcagccctgctgaccaagacaaactgcattgcccgcatcttcgatggggtcaagaatggcgctcagaggccaaaattcatcagccccagttctcaggttttcatctgcctgggtctgatcctggtgcaaattgtgatggtgtctgtgtggctcatcctggaggccccaggcaccaggaggtatacccttgcagagaagcgggaaacagtcatcctaaaatgcaatgtcaaagattccagcatgttgatctctcttacctacgatgtgatcctggtgatcttatgcactgtgtacgccttcaaaacgcggaagtgcccagaaaatttcaacgaagctaagttcataggttttaccatgtacaccacgtgcatcatctggttggccttcctccctatatnttatgtgacatcaagtgactacagagtgcagacga

SEQ ID NO: 530549 - DNA, 288 bp, Homo sapiens
tatggcgttcgcacgtgacatcgcggctgccgacatcgcgtcactccttgctacatctcatagctcctgtgagcatcttatcggtccttccgaagtctcatgcgaccttcctccgatcttcttgccccttccaacatctcgattcctccttccaacatctcatccctccttccaccatctcattgcttcttccaacatctcatagcccctaccacatctcaagccgccttccaacatctcatctcccttccaacatctcatacccccttccaaaatctcatagcccct

SEQ ID NO: 530550 - DNA, 283 bp, Homo sapiens
gggaaaaagaactaggatctctcgaaggttgataggtccgcacggtatgaggattctacgtggttctcttggttcccctggtgtgtgtgtgtgtaggaggatgccgcggcccttagatcaccttcttgatctcgtcgtcttggacatggcggcggcgatgcctccgggcaagaagtctttggcgaacgacatggcctgttccgtcttgcgatccaaccatcggtagtcgattccgtgtcttgatcaccgggtgggagggaaccgtggcgtcttgcgggggctg

SEQ ID NO: 530551 - DNA, 446 bp, Homo sapiens
cccggaaattcggccattatggccggggccacaaactttaagggccggcagagttcacaggtttttaggccaggagccaggaggaaaccaccggagggacccatttaattgggggtaaccatgatttccaggttggccggggttttttgggcagccttcctgatttctgcagttttgggtgaaggtgcagttttgccaaggggggctaaggaacttagatgtcagggcttaaggccatactccaaacttttcaacccaaaatttataaaggaactgaaagggattgaaagtggaccacattgggccaacacagaatttatggtaaggttttctgatggaagagagctctgtttggaccccagggaaaactggttgcaaagggttgtggagaagtttttgaagaggcctgagaattcataaaggcaaatttacttaaccatttaatg

SEQ ID NO: 530552 - DNA, 886 bp, Homo sapiens
ttctgtctgtaaaatgaggatgttggccaggcaccgtggctcaatcccgtcatctcagcactttgggaggctgaagcagaaggatggcttaagcccaggagttcaaaaccagcctgggcaacatagtgagatcccacctttagaaaaaaaaaaaaaattagctgggtatagtaagcatggtagcctcttggtatgtcacaagttaactggaggaggctagaggcgggaggatcgtttggagcccaaggagttcgaggatggaagtggaagctatggatcggagaccattggagatcttacaacttctggggtggacacacaggaaaggaaactctgggtgcatcctttataaaaaaatatgggatcgataagagctggagtaggggggggtgagactactatgggctttggaaatatccaaaggcaaactttggggaaagaggcccaagagtgggcgggtgggacatacaattgggagggggtccaaaagagaagtttctaccagaggaacacaaaacactttggtgcgccacaagaacaggggtagaagaacccgcacgaattctgggtgacatataaaaacaatctaacacgaggacaacattaaagacactgagggatcgtaagagaacgggattagtaatggcccccggtacaaaaataccccagagcgggtcaaacccaagtgggggcaacacatccacaaagcatgggggggtgaggacaacaacgaaaggcacagagaaaaaatccgtgccccctgacacaaacaaacaagaagaaaaacagaaaaaaagcaaaacaaaaaaaaagaaacgcgggaggggtcgaggcgaagaaagcacagaaaggaaaaaccaagcgagaatatacacgaacaaacacc

SEQ ID NO: 530553 - DNA, 284 bp, Homo sapiens
aaaatttctttagatagtagcttaacatactccacacttccaatgctgagacctaaaaccatatagcaactgtgtatccaatagtgaagtctgtggaactggaaaactccacaggtccaaccacctttcactattctccacttgcctcatgccttctccctttacaatactataggcagtcataggaatcactcctgtgcacatgcccccaccttccttgaacctctctcatctaaatacaacatacaaaaactaatctctgcctgaacctgtgctggagaata

SEQ ID NO: 530554 - DNA, 266 bp, Homo sapiens
ttgacaggtgggatcgtgttatgacacatgtgaacaatcatgctatggacatgcttcaggatatgttactatactcgattcagtggtgtaacccgtgggatagtcaacgccttccattatgtctgccagagatcttggagtcggtcacattatcacttgagcccaaagaagcaggcttataacctacgaatgaggttattaaccagttattgcaccacgtctggtgcgagtgtgcattgcaccgaactacaaagtcgggtaccgag

SEQ ID NO: 530555 - DNA, 129 bp, Homo sapiens
gctgtttgataatcttgtccttcgtattgcattttttacccctatcaaaggataatgcattatactgtccctattctgtccttccaaaatccacatttattctatgcaaacgtataacctctctgaacc

SEQ ID NO: 530556 - DNA, 199 bp, Homo sapiens
cacgagggcatcttacacccttctgtcttcagtcaaacccaacagtgatagcatgtgtctgcattcatttggcttgctaatgggccaattgggagatccctgtttcatctgatggacagcattggtgggactatgtggatcctaccgttactctagaattattagatgcgccactacatgagtttctagatgtattgcc

SEQ ID NO: 530557 - DNA, 128 bp, Homo sapiens
  misc_feature (33)..(33): n is a, c, g, or t
atggcagaacagtccctcaaaccactgctgtgntgatcttggggccaagccagcttttggtattgtcacagcgccacgtgacacgtgcccagccagggagtgcaagctctagcacctaaggtgcaaag

SEQ ID NO: 530558 - DNA, 960 bp, Homo sapiens
gtggttcagccaattggttctcctatgaagcccatcaatttatacttcctgggtgtgctgcgcagcaagttactaagaagtatgacgcttgtagcaacgatgagaggctgttaatcgctatgacctataacctatctagcaagccgaagtacgcttgaaagacttgaccggcggcatcgttggtgtgtcatgacatgtcatcatcagacataggtttacgtacagatggcacttgctgtaattataataataaaatctatagggactggacatggacctgtcccgcgaaactaaggctttacgaacaggacacttgttgggactggaccctgtaatgcgtactacgtaagtcctattggtgttgcaaacccagtgcttgtaacgtgactcatatgacgccaacgcgggaaggaataaatggtcggggacatcaaaggaagtacttgtcagctcatatttcaattgggtactattctgagcactttcggcgcccttctatgggaagtattaaacgatctcatttttttttctaatagcaggttcgcgcttgcgggtgcatccttacgcgattttcaaattccgaaccgaagttttgaactccccatgggatatcttactatcacggcacaagtccgggaattatccgcagtgcgcaaaatctttagggaaacgaactaggccatgcttcaggcaacacgtgcaatcctcccagggggaagccacaagtggctaccgcgtattgcatcagtcttgaccttgagcttaagagtgagagccaaaagccagaaagcctaaaagtccaacgccacgtgttcgggtcggcgctaggacaggcatcatcgggcccatccacgaagtctctagcgtagcaccgacgctggcggatgctatgcttggaattctgtgacacggctgtagagcgatctctcacccagcggaccttggctaccccccgattac

SEQ ID NO: 530559 - DNA, 471 bp, Homo sapiens
agccactaatctggccaccctgatctctgtggatttacctattctggatatttcatataaatggaatcatatgatatgtgaccttatttatgtatctggcttctttcacttagcataatattttcttttctttatatctgttctttttctgcacacaacagtttaactacttatttgcccaggctgtatgtgcaataggctgcaatctcaacctaccgactaccacaggtcatcaagacgattactccgtgcctacaggcatttcccccaaggtagctgtggtgcacatcactataggtggtgatacacaaccgagcgacccaagccaaagatttgttgtgcatacccatatatagcgtacataggaagaccgagagggtgaccaagacacaaagattgggacacacaggacagagccgctatgaacgagataccagacagagaggatacacacacggcaacggaacgacc

SEQ ID NO: 530560 - DNA, 717 bp, Homo sapiens
  misc_feature (27)..(27): n is a, c, g, or t
  misc_feature (46)..(46): n is a, c, g, or t
acgggtgtttcggtgcggaggcgcgcntgtcgatcagcatcggtancacttccggctcggggcggcggtaagcggcggtgattgcggcacgcaataccgattgcggcaggatgctctcggcgaactcaaggaagcactggtgggcgtggtcggcctggacctcgccggcatcatcggcctccttggtgctcaagccattgagctcggacagggttgcaccaccctcgagtttctccaggtaattgaaaatcgcctgcttgatcagccagtgcggcgtgcggtcaatggaggtcgcggcggccttcaggcgttcgcgggtcgggtcgtcgagtttgaccccaagggtggtcgttgccatttttttatcctcatgggtgccactaccgagtggcatctgctggcggcaagattagctttgcccatcctgaggtgcaaccgggtgcaacccttttgttggttaaatgttcgacgcttgatcggaaaaaaataaacacacgacggaatccgcttcgcgctggtgcatttgcttctgagatcggctgttcttgctccgaaaaggagcaaaaaaagcgcgtttgtcctaaaacatacttgggtgcaacttaaacggcagaaactggttgcaccttatttgctttgttgaatagcattcgcgcaccaaggtgcaaccaaccctctgggtgggtcatcggctggcggctttctgggaacgcagtc

SEQ ID NO: 530561 - DNA, 99 bp, Homo sapiens
tcaagcttctaacatgtacggggacatgattgagcttcagagctaaaatgccttcacccttcccccaagttggaatatatcctcccccaaattaaaaaa

SEQ ID NO: 530562 - DNA, 322 bp, Homo sapiens
tgtaattcaacgtgttacacgggcatatcggattcgagcctgggcctcatccgcgggcaccacaacagagtttcacctggatgtcagagtgggtatgagttgtcacgcagcggcacgccagagcagagcaggaaggcccgcatggatagctccgagtgtcccctgcagctcatgagcaggcgcaccttgacgccacgctcgtaggtcgcccgccgcagcccatcgtccatggcaggccaaaacctgtgagggtgggagaactccacattgcgcaggtagttcatgacagctacgtagatgaaactccgggcattgtccacca

SEQ ID NO: 530563 - DNA, 144 bp, Homo sapiens
gccccactttttcataaaagagcagacattgttatcctgcttgtccagattttggctgagaagtagttactgtgcacatgtgtagattgcagtctgtggctcctgatgggtctgagaagatggacgtggaggatgaaaatctgt

SEQ ID NO: 530564 - DNA, 182 bp, Homo sapiens
ataaagtgtaggttgggtatcccagcgtgcatctttagaagctgaataaaatttctttttttcagtaatggccttgtaacattggtaaagggagtctcgctctgtcacccaggctggagtgcaagggcctgatctgggctcacggcaacctcggccttctaggttcaagcaatttcacctga

SEQ ID NO: 530565 - DNA, 272 bp, Homo sapiens
attttacatttgcaccagcaatgtaggagggttgtgatatctccacgtcctcaccaacacttgtgattatgtgtcttttaaaattatagccatccgtgtggatgtgaagtggtaactcattgtggctttgatttacatttccttgatagctaatgatgagcatttttcatgtgcttatgggccgtttatatacctttggtgaaatgtcaatttaaatcttttgctcacttttcaggtgggttttttttctcattaaatagtaagagttctta

SEQ ID NO: 530566 - DNA, 118 bp, Homo sapiens
cggtcctcatatcttatacttcataccgggaaactgagaagctgtgagaagtataaagcgttgaggaagtataaagcgttgaggatgtataaagcgttggggaagtataaagcgttgg

SEQ ID NO: 530567 - DNA, 85 bp, Homo sapiens
cagactgaggctgacccggaaacttaggggccacgtgagcactccacggccgcataggcaagcaccggaagcaccccggcggccc

SEQ ID NO: 530568 - DNA, 173 bp, Homo sapiens
  misc_feature (9)..(9): n is a, c, g, or t
aggggtatnagtatttgaaagatcaaggggttatattacacggaattgcatattggctattatgaggggttaaaagagcaccaaagagaaaatattgcatacagcagtgattacaccagggtaatggtgatattcgaaagggctaagataatttgggagggggcttagagaat

SEQ ID NO: 530569 - DNA, 686 bp, Homo sapiens
  misc_feature (486)..(486): n is a, c, g, or t
  misc_feature (612)..(612): n is a, c, g, or t
gaactagtctcgagtttttttttttctgttttgttttgttttgttttagcacaaccctttttcttcttcttcacttcccttcttggtgctcagcctgttccagccaccgtgtcaacatgccttggtccatagctctggaaggcacacaccaagcaggaccagtgaacagaagatgagaagggtacattttgacaccaaactgcctgggttggaaacccagctctgtgacctaggaccagtcacttaacttctgtgcctcggtttccccatctgtcgactggggatgatgagagtatctctcactgggttgttgtgaggaatggatgaggaagtacaaatgccgtgcctaaagcagcgcctggtgcacactgatatgataagttttattattatcatcatccaattatcatgatttctggcaagtgggcactttccgtcagaaatctcggtgaggagacagggccatccacccgtataagaatgcangctcagcggttggcactttcattgagaatcaacggtgacttattttgcagtccccaatcccctcattgtcttccatcgaaatgggctcaccgcttggtctgtgtgttcgtgggccccatgctttanccattatgccccgaatagccccttttaggtcacattaattgcgtattttggggttccccctttggggtgggggg

SEQ ID NO: 530570 - DNA, 581 bp, Homo sapiens
gggtaaactacctttgcatgaatttggttgaaagcgtgctgttaataatgacttacctgtcttggtttactctatggagatgcagccgactccattgccatgcgtttgatttcatctatacgggacagtccatcagggacatctacgttcaggtaaactcgatggtgatgaatggtccaaagttaccggcaccatttggcaaagtgaaggagaaaaagctctatatcgacgactcctctgctcttccacctacagaagttcgtgctcgcgcacgtcgtattgccaaacagcacgatggtaaactcgggctgcatcatggtcgattacttacagctgattgaaagtaccaggtatgggtgataaccgtgtcggtgagatttcagaaatttcacgaggcttaaaaaagctcttgccaaaaggaaaatgatgtgccctgtaatttgcactatcgcagcttaaccgttccctcgagaatcgtcccaacaaacgtcccgtgatgtcagacttacgttgatccgggtgcgatcggagcaggaagccgacttggtcatgtttatttaccgtgaggaagtctataacaa

SEQ ID NO: 530571 - DNA, 202 bp, Homo sapiens
cccgtatttcactgcagatagtggatggtaagatgacgatgctcagattattcttctcattggcaatgccaggatggcagtggatgacttcaacctcaagtatgaaaatgaacactcctttaagaaagacttggaaatttgaagtcgagggcctccgaaggaccttagacaacctgaccatggtcacaacagacctagaaca

SEQ ID NO: 530572 - DNA, 200 bp, Homo sapiens
  misc_feature (85)..(85): n is a, c, g, or t
cagtgtgacagcaagtttcattctagcgtggccgctggtcactgaggtctgaccttatgcatgtatttattagaagggaattctntcattctcaccttgggatacagtacagctttctcttcttgagctgtgtgggctattaaaattcccccaggctgagtgtttcaggaagcaccataaataaataaaattgtctgtga

SEQ ID NO: 530573 - DNA, 138 bp, Homo sapiens
gaaggaagaaccagattgctgattggagaatccacaggaggggagaggaggaaagggaacgtggctagggaggaggccaataagaccccttcctttctgggcacaggaaggcagcgcaggggcaccagagtccaggca

SEQ ID NO: 530574 - DNA, 772 bp, Homo sapiens
ggccattatggccgggcttggtggctcatgcctgtatttccagcactttgggaggctcaggcaggtggattacctgaggtcaggagttcaagaccagcctggccaacatggtgaaaccccgtctctactaaaaatacaaaaattagccaggcgtggtggcggtgcctgtaatcccagctactcgggaggctgaggcaggagaatcacttgagtctgggaggcgaggttgcagtgagccgagattgcgccactgcactccagcctcagcgacagagtgagactctgtctcaaaaaatctatctcaataaagtttataggtgcaatatatatgacatgaagcagaaaagatgagaggaataaatgtacctataaatgcaaggttcgtttattttacacgaagtaggaaaaacagactttgataaattaacgatgcatattataatccctagagctaccatcttaaaaaatgcgagagaacagtttcagcgccaaaatactatccaaacgaaatgctaccattctaattaacccggcaccacacagttaggtcttaggcacagggcatccattctcctctcttctattcctcccccacaactatgccgtccggcttcgcccatccgctcctagcatcctgcacagcttactccttcctgctgacttcccggcttcatttggcccaactcgcccttaactgactccgactaccactcactcgctctcgttaccacttcggcgctcctcgctcctctctcgtcgtcctctcctctcc

SEQ ID NO: 530575 - DNA, 160 bp, Homo sapiens
acggcagtatagctgtatcgtgagtgtaaaacgacggcagtcatagctgttcctgattgtaccccgacggtgagtcatagctgttgcctgattgtacaacgcacggccagtcataactgttgcctgattgtaaacggccggccagtcatacctgatgcct

SEQ ID NO: 530576 - DNA, 759 bp, Homo sapiens
tagaaacattcttcaggagcgcgggcgcaggaggtccgtgaacatgggcgtagctgttacttaggagatcctgagtcagatagtactgagtgcttggagtattcttctctcggaatctacgaacaaaacgcctcgtgtggatggaccggtagcggtatcattggaccttgtttcttggaatcgcgcagtccatcgataggtcgatctacgtgggatctaatcgtacgtcgagtgcagaatcctaaggggcagtctcgattagcaaaagttgacgcgcctcgagatcggcccttagtgtcgtatgggtcacctcaatttccattcaggcctgtgccatgctgtcgtgcacttggtgctcccctggatacttgactgactttggactgactggacaacagcctccatacgccactgaaaactgacacatgaaaacgactgggaacgttcttggctgggatttggcactttcctttacagtgaagttggggccatagggagcccctatggcccccgttggaggaaggatctatccgataaactttgcgttgagtcaaaggacacacaccgatgaccaaattcacttttcacacaaacatgtgagctcttcccactgaggggccaacgggcgcaactagacatctttttaacccatgtgctttcaacacccttacaagattggccacctacataatttggccaaaggggccggcgccggtaagggcttaacccctcatatatccttggcggaagaggttactc

SEQ ID NO: 530577 - DNA, 562 bp, Homo sapiens
aatatgtatttttaatcattcatagtgctggtaaaaaaaaaaaaaaaaaaaaaaaaaatggggggggggccggggcgcaggggctcaccccggttaatcccagcacttggggaggccaagggggggggattcaccttcatggggccgtggatacatccccagcattggggagtgggaggctgagggtgggtgggatggcttgagaagtttcaaagaccagcctgtgtccaaccatgtgggcaaaaccccggtcctcataccataaaacattagaaaacttagccgtgggcatgtgggtggcacacggcctgtttaatccccaggttaaccgggggaggcgctgagagggcaacaagaaaactggtcgttgggaaccttgggagaagggcacgaaaggtttggcgacgtggagcgcccaaagagaatcaacgcgccacgggcgattctccagggcctgggggccgagaacagggggtgaaaacggggtttcaaagagacaaaaataaagggaaggcaacatgaacggaaaacaggaaaaacttggggggaacattagtgtccg

SEQ ID NO: 530578 - DNA, 211 bp, Homo sapiens
  misc_feature (29)..(29): n is a, c, g, or t
gcttcctttgcctttacccaaaacctttntgacgtccccccccgtttgttgtgtgctcacccccaggatgtgtacccggttgtagtaggagctgaaatccatgttgagctgtaccaggaacttgcatatttaaagacaaagactgagtccctggcccatttttttgtttttgtgccccaggccaaaataaaaaataaagtgtaaagtgtca

SEQ ID NO: 530579 - DNA, 270 bp, Homo sapiens
  misc_feature (255)..(255): n is a, c, g, or t
atctcccggctgggcacggtggctcatgcctctaatcccaacactttgggaggctgaggctgggggatcacctgaggtcaggagttcgagatcagcctggccaacatggtgaaatcccctctctactaaaaatataaaatttagccaagtttggtggcatgcacctgtaatcccagctacttgggaggctgaggcaggagaattgtttgaacccagggaggcacaaaatattttattgaaggaaaaacgaggggngaggagtcaggtggg

SEQ ID NO: 530580 - DNA, 375 bp, Homo sapiens
tgaatcagcaacgcaccccatcgttcctggtccagcgtgacgaggtcaagcgcgtcggttacatcgtggtctcctccgaccgcggtctggccggcggcctgaacaacaacctgttccgcaagatgctgggcgaaatgcgccagtggcaggacaagggcgccgacatcgacgtggtcaccgtcggccagaaggcctcgaccttcttccgccgcgtcaaggtcaacatggtcggcaccgtcacccacatgggcgatgtgccgcacctggaacagctgatcggcgtgatcaaggtcatgctcgatgccttcaccgagggcaaggtcgaccgcgtctacctggtctacaaccgcttcatcaatacgatgacgcagaagg

SEQ ID NO: 530581 - DNA, 135 bp, Homo sapiens
gagcgtgaaactccgtctcagacaaaaaaagtctggttctcgtaggttcatccggtgtcacaaatggacaggatttccttctttttaaaggctggactaaggctggggtatgatgggctcattcctaataatcgc

SEQ ID NO: 530582 - DNA, 1472 bp, Homo sapiens
aaactattatacgtagcagtttacctttcctgcacgtgcctagaggaagtactgagctatgatcagcgtcacaacgctcatatccatcctctactatgcctagcaaggcaataatcactatcgactggcaccattactagccatactcatcaataaggcgcgtcaagacgacgcagcgacgtccgcatcttagaccaagtatatggtgaccctattggccaatacgtaggtctttgccgacctgcgaaagcagacggtgggccctagacccatacctagctctcaaaatctccaaacacactactggcactacgcacctaacgctacaatacaccctcaaaccctaactcccacatgctaaacaactcaatacgtacccaacaaactcatcatcacctacccacactgcaccatgcaccttatcccaaaaaaacaccacccataaaatatcgacactccaaaccacaaaccaaccacaacaagaccttacaattatttcacacactcaataccacatcataacatcactcttatatatcaaccaaaaatccaatcacacaaaccctaattgatcagacctagctaatgccacaccagaaggcctataacaccaatcccggaaaccaccaccattaaaacatacacatccctcgccttccagtaaaactgaacgtaaacgcattaacctctgcacattcactaacccctacatcaccagaatgacgatgcgacaagcacaaatagacacaacgatcattccagcagatgacaccccatcctaacgttccagcccgcacacacaacccaacacatccagcacacaccatccacaccgtaagcatcacgtgaaaaacatcgctcgacgctgacagccaaacatcctaccagagtagaacatgaaacacaacccactcccgagagaggaagccagtaaggcaacgtcaaactcacacacaactcgaaatagcatgcagcctcacagcgaactacacacggcagtaaactgccgcccacctatgcgactcaaacatccacgcccggaactagaacggaccaccccagaggcgaacccgcgcccagcaaaaatgcgccagcgcagaacacacaccgccctcagacgcagcacccccgcaaaaagtgaggcgcaccgaaccccagacacaccaacggaacaagaccatactagagacctcacagaacagccaccccacaagcaaccaagtacacacaaacaacgaacctaacctactgccgaccaagaaccacaaaccacctcacgaaccacaccaaaaagaaccaagacaagacaacaaagaaaacaagccaccagccgcaggaacagacagaccacagcaccgacacacacctcacgagcatcaacacactgcacacaccacgcgaaggcaaagacacaagtcacagaagaaagaaaaagtacagcaacacaccataacacgacacacacacagaac

SEQ ID NO: 530583 - DNA, 940 bp, Homo sapiens
gtgtgcactgaagaagggtaactgggtccagacccactgcgtcgccgcgtatctcctgagtgtgaacggacaacccggtgcagagcagttccgtaactgattgtggatcacgagggttcacctcttattggaggaactcatgcgttgtgcggttcagaaacacatgctggatgaacaggttaagggtgaaatttgggggacatcgttctcgtgttgataagatgtagccaagggcgtcttagaagcattgggtaggaattttttacagtgggaaatgtgaaggcacgatgggtagtatgcagggaggagttgggttttgatagtgggttcattgatagagtgtcggaggatatatatgagtggaaaagcataaagatgttggtatacacattatactgtctagtgttacgtggcccatgtttgtgagtgtatgccccggtgggttaaacataaaactgggaagttttgtcctgttgaaatcgaaacaagggataccaaccttttttgaatgggtacaaactcttatttttttggagaaacccttttgtgtgttcgggacacaacaacacaacgctgggggggggggttcaacaaaaacaaacacttttttttttgccttcttctgttcccaacacacacccatacaaacacacgcggtcttttttttctcacacaaccgcgggcggggggggggggggaacaacccaacctataatcaaaaaacaaccagcctccttcttttttctttcttggtccccgcccactcaacacgcagaggcacggggggcgggccacttccatttcatcattccaacctcaaacccgcacacgcaacacgaatacaacgatacgataggtcggtcggccccaccccaaccgataggcacgatggtcgtactcaattcatcgccggcgaagcacacaccacgacccaccaaca

SEQ ID NO: 530584 - DNA, 1531 bp, Homo sapiens
  misc_feature (325)..(325): n is a, c, g, or t
  misc_feature (824)..(824): n is a, c, g, or t
  misc_feature (926)..(926): n is a, c, g, or t
  misc_feature (1087)..(1087): n is a, c, g, or t
  misc_feature (1089)..(1089): n is a, c, g, or t
  misc_feature (1142)..(1142): n is a, c, g, or t
  misc_feature (1237)..(1237): n is a, c, g, or t
gaacgctcaccccgcgaccttggtggggtgtcagcagacaaggggtgggggtggagaacacttgtctccgccgcgcttttttataagaatatgtgatcgcctgtgtggcgggcgccgtctggttgttgtggtgctccagacgaccagccggccgctcgtgttagtggtgtccacccccccagccgtggtgctttatagggggggagaactcctgttgtgatgcacgcccaagaggggggggagctagttcttccccccgttgttaggacgaccgtgggggggagagactgattgtgtggtacaaagagacttggttgcccaacancaagtgtggggggcgccgcaggagaggaggagttgttttgtgtgcggccgccaaccgcggctcggcagacagcgtctgcacaccagcaggcgcaccactgtggggggcggaaaaccaccaacaagatgacgccccaccagggagtgtttttcttttggaggacacgttctacgacagtttgtgaatatcagcgcggcccctctagatgatttgttggtagcccaccccgttcctcctcgcgccgttgtggttgatcgagcacctgcgctcgccccaggcttcatatattttttcctggaggacaccctagctaaaaaggtgtctcggagagaggggggagaaatgttttctctcgctgggggggaggcccctctcttgaggaaggcggggagatattgagagagggggtaattagttgtggtgtcggcgccacacagggcgacacaacacacgcgggtctcgacacgcacacacacacgtgcgccccctctgtgttgtnggtgtttttttaaggagagaccaacacagcggggtgtcacaactctcagcagctggtgctctttggggtgctccacacagcacacctctggggggacaacancacacaagcagggtgtgagagagacccccctctgttgtgtctcacgacacaacaaaaaatagaagagtgtcccccctctcgagacactttgggccgcagaatggccctcatatatatagggggggctggaaatacacccacactcgggctctcacatatananaggagagagagagtgtgagagcccaccactctttgctctataaaaagagagtnttggtgcgccacacagaagtgataatatagagagggttttggggtatacgggtgtgcgtttataccgccctgttataatctccaccgcacacttnttgtggagagggccacacaggagagggccggagatcacatttgagagtgtcacaagagagttctgaagagccaccgcgcctggcgcacacacacatggccacaaaccctcgtttcttgctataaaaatacccacaaaattatggctggggcgtggtggcggcacaagcctattataccaccacgctaacttgggagggctgaatgccacggagagagagttgcttgaaacccgggagggcggagaagttgccatgagcccagatcaagcccctgcactcccggatttgtttcca

SEQ ID NO: 530585 - DNA, 746 bp, Homo sapiens
  misc_feature (38)..(38): n is a, c, g, or t
  misc_feature (101)..(101): n is a, c, g, or t
  misc_feature (160)..(160): n is a, c, g, or t
  misc_feature (171)..(171): n is a, c, g, or t
  misc_feature (200)..(200): n is a, c, g, or t
  misc_feature (205)..(206): n is a, c, g, or t
  misc_feature (211)..(211): n is a, c, g, or t
  misc_feature (215)..(215): n is a, c, g, or t
  misc_feature (243)..(245): n is a, c, g, or t
  misc_feature (247)..(247): n is a, c, g, or t
  misc_feature (250)..(251): n is a, c, g, or t
  misc_feature (254)..(254): n is a, c, g, or t
  misc_feature (314)..(314): n is a, c, g, or t
  misc_feature (358)..(358): n is a, c, g, or t
  misc_feature (371)..(371): n is a, c, g, or t
  misc_feature (433)..(434): n is a, c, g, or t
  misc_feature (437)..(437): n is a, c, g, or t
  misc_feature (448)..(449): n is a, c, g, or t
  misc_feature (462)..(462): n is a, c, g, or t
  misc_feature (465)..(467): n is a, c, g, or t
  misc_feature (472)..(472): n is a, c, g, or t
  misc_feature (474)..(474): n is a, c, g, or t
  misc_feature (477)..(477): n is a, c, g, or t
  misc_feature (484)..(486): n is a, c, g, or t
  misc_feature (490)..(490): n is a, c, g, or t
  misc_feature (494)..(495): n is a, c, g, or t
  misc_feature (500)..(500): n is a, c, g, or t
  misc_feature (581)..(581): n is a, c, g, or t
  misc_feature (588)..(589): n is a, c, g, or t
  misc_feature (597)..(597): n is a, c, g, or t
  misc_feature (614)..(614): n is a, c, g, or t
  misc_feature (639)..(639): n is a, c, g, or t
  misc_feature (641)..(643): n is a, c, g, or t
  misc_feature (653)..(653): n is a, c, g, or t
  misc_feature (657)..(657): n is a, c, g, or t
  misc_feature (662)..(662): n is a, c, g, or t
  misc_feature (671)..(671): n is a, c, g, or t
  misc_feature (684)..(684): n is a, c, g, or t
  misc_feature (714)..(714): n is a, c, g, or t
aaacttttttctgacaaaaaccagacagtaaataattnggctttgtaggctttaccatctctattgcaactactcatttcaaagcagccacagataatatntaaacagatgagtatagctagttccaataaagctttatttgtgaattctgataattttnacgtcatgaantattagtctttgatttcttttcccaaccntttannactgngggncccattcttagcttacagggtatattannncnggnngcnggctggatttggcccacatgctgtagattgccaacccatgctacaaaatataccttaaangcctgtcacctcaaaatttcaaatcactgcttcccaaaggcttnaagtgttttttcnaatcttcctcagtaacttcttttagatcagctggtttccattttggactctggtctttttcnnttnaaacagctctnncgccttcatgaangtnnnggccncncgnggggggnnngggngggnnggggngccggggggggggggtcggggggggcgggagagggcccgcgcgggggggggcgtagtgtgatctttagaaatgttggaganattttannaattaccntcaattgctctagggcnaaaaaagaaccatcttgctgtaagnannnaataatttcntccncagtnttggctganaaacaactgtttnttttgtccatgtgttcctcaagtataaaanacttgtctcgctcaatcttagactctgtatgg

SEQ ID NO: 530586 - DNA, 111 bp, Homo sapiens
cggcgaattcgtggtgctgctcggcgaattcgtggtgctgctcggcgaattcgtggtgctgctcggcgaattcgtggtgctgctgagaagagtgtgctggagatgctctag

SEQ ID NO: 530587 - DNA, 1131 bp, Homo sapiens
  misc_feature (109)..(109): n is a, c, g, or t
  misc_feature (111)..(111): n is a, c, g, or t
  misc_feature (113)..(113): n is a, c, g, or t
  misc_feature (122)..(122): n is a, c, g, or t
  misc_feature (133)..(133): n is a, c, g, or t
  misc_feature (163)..(163): n is a, c, g, or t
  misc_feature (210)..(210): n is a, c, g, or t
  misc_feature (220)..(220): n is a, c, g, or t
  misc_feature (225)..(225): n is a, c, g, or t
  misc_feature (228)..(228): n is a, c, g, or t
atagatgactgtgctcctgatagtccaacgctacccccactcccctcctcctggtgagtaaattgatactgatactgaatttagaaatattgctttaaacaacagaganananaaaaagaanaaaggaatctngtcatttttattctgtatattcattatctngtatacttgtgaagaagaatcttttactctgatttggacaaaattgnctaacacaantgtcnatngcttttttgaataaaaaaatgttttataaagaaaaaaataagtaaaaactattaagaaaattttacccagtatttcctagaatatgtccaagttttattggaaattatcagtacccacatgtttaatttaagtttcacgatggatggctaacatgagttttttaaaacattgaaccggctcggcatggtggctgacacctgtaatcccagcactttgtgaggccgaggcgggcagataaccaggtgaagagttcgagatcaacctggccaacttggtgaaaccccgtctctactaaagatacaaaaaaaacacacaaaaaaaatttagcgggggcgtattacccatgtgccggttaaccccaggttacccagggagggctggggcgcgggaaaatcggtttggaccctggggatcgggcacaatttggctgtggacccaagatcattcccatgtgggcactccacagcctgggggtagaccaggggggaagactccattctgggggaaacaacaaacaaaaacaaaacaaaaggggcgcggagcgccataaaaaatatccccagaggagggcaccaaactatacggatacccagagctttctggaaccaaggcgcctcaataggagagagggcgacattaataacgcgcatcaaagacacaggcgacgcagagagttaacacacacggcgccacaacgggggaaaaacagcggcaaccacggagagaaccacatggaggaagaggagaaccccaatcatcggcgcggggcgcgcacacacaggtggggaacaaactccacatgacagagaggatatataaacaccggcgagacacacatcaacactacagacgagtcaaaagtgagtgaacaaacaggagacataaaccgggccgtggacaaa

SEQ ID NO: 530588 - DNA, 713 bp, Homo sapiens
  misc_feature (54)..(54): n is a, c, g, or t
  misc_feature (73)..(73): n is a, c, g, or t
  misc_feature (81)..(81): n is a, c, g, or t
  misc_feature (89)..(89): n is a, c, g, or t
  misc_feature (92)..(94): n is a, c, g, or t
  misc_feature (101)..(103): n is a, c, g, or t
  misc_feature (105)..(105): n is a, c, g, or t
  misc_feature (129)..(132): n is a, c, g, or t
  misc_feature (135)..(135): n is a, c, g, or t
  misc_feature (141)..(142): n is a, c, g, or t
  misc_feature (144)..(144): n is a, c, g, or t
  misc_feature (149)..(149): n is a, c, g, or t
  misc_feature (151)..(151): n is a, c, g, or t
  misc_feature (153)..(153): n is a, c, g, or t
  misc_feature (159)..(160): n is a, c, g, or t
  misc_feature (166)..(166): n is a, c, g, or t
  misc_feature (168)..(168): n is a, c, g, or t
  misc_feature (175)..(175): n is a, c, g, or t
  misc_feature (181)..(181): n is a, c, g, or t
  misc_feature (197)..(197): n is a, c, g, or t
  misc_feature (204)..(204): n is a, c, g, or t
  misc_feature (212)..(212): n is a, c, g, or t
  misc_feature (226)..(226): n is a, c, g, or t
  misc_feature (240)..(240): n is a, c, g, or t
  misc_feature (246)..(246): n is a, c, g, or t
  misc_feature (249)..(249): n is a, c, g, or t
  misc_feature (252)..(252): n is a, c, g, or t
  misc_feature (254)..(254): n is a, c, g, or t
  misc_feature (532)..(532): n is a, c, g, or t
  misc_feature (628)..(628): n is a, c, g, or t
  misc_feature (694)..(694): n is a, c, g, or t
ggtagtgcctcccttagataacttgtggccaaaccctgtgcagctgctgggtgngtccaccctcatcctgtanttggagtntgtgggtnagnnntctggannntnttgggagcttgggacagccgtgannnnggngttgtnntnctttntngntctttnnactgtngntggaggnctgggnggggtttttttttttnttttttntttttttnggtagggaggtttnttgtattttttttngttacntcnttntncaaccctccactagcgctgctttcctggtcaaacctgcatcttcactgggtcatgccccaaggcctctgagggacttccacagtggtaaggagggctgccctttttatttttttttggttgtggctgagaatgctggagatgctcagttctctccctcacaaggtaggccacaaattcttggtggtgccctcacatctggggtcttcaggcaccagccatgcctgccgaggagtgctgtcaggacagaccatgtccgtgctaggcccaggcacagccnaaccactcctcatccaagtctctcccaggtttctggtcccgatgggcaaggatgacccctccagtggctggtacccaccatcccactacccctcanatgctctcactctccatcaggtcccaatcctggcttctctcttcacgaactctcaaagaaaagganggataaacctaaataaaca

SEQ ID NO: 530589 - DNA, 536 bp, Homo sapiens
taacttcataggccagggttgaagttctgaacacttggaagtctccaattatgaaaaatccatgtctaacgcctcgggcctggcgtatttacgcaataagtggcttaattgtgggaaggagggagtcatccactctggagccactggcagtggaatgtcactggatctcagtctggggggaaaacacttcaataagctaaactattctacgcttggatatttcctggaaggggaatcaccctgggtgttccacatttggggggtagttccttgggggggccactggcgtggactctggttatgacactggtggatccaagggaaaacgggggaaagaacagggtggggctttataaaatcgggagggtccatggttggctacgaaatagggcagattacaaaattcttatttcattcattaattaattttgggaaataagagtctgggctgggtggcccaagatggccccatggtactccagctaggcaacaagagggaaaggtctcaaaaacacaacacacacaacaacgggggg

SEQ ID NO: 530590 - DNA, 271 bp, Homo sapiens
atgatcatcgtaagtatgtgatctgtaagtggtgatcgttaagtaggtgatcgttaagtgtgtgatcggttaagtaggtgatcgttaagtatgtgatcgttaagtagtgatcgttagtaggatgacgttagtaggtgatcgttaataggtgatcgtttagtaggtgatcggttacagtaggttgatcgttaagtgaggttgatcgctacagtagggtgaccgcgttacagtagggtgatcgttaagtacggtgatcgcttaagtagggtga

SEQ ID NO: 530591 - DNA, 1491 bp, Homo sapiens
  misc_feature (656)..(656): n is a, c, g, or t
gaattggtcgccaatcaatttgtctttctgtgctgagcctgtcgccgatgaaggacgagcgtgtgcaggatattatgcggtatacagatgattcttgatccctgtgaacacggagcaggcgccgtactcatcacgggaccgatcgcggcacaggtcagtgcaatgatttactcatttgcgtatacctgcagaagatcgtggattgaccttgttccaattgaatggaacactccattcagcgactacggagtaaactgcgtgggaccataggtcgcctcttcacaagaaatgcgtaaagactgtaacaacacggtgcaccaggatctgtgacaagtactactttcagacttgctgaagagaggacaccctcggaccggaagcaagatcgaccatattgtccgagaaactgggctcgttttaagcttgacgttggcgatacttgcctctcgtcgtaggcattcatcgataattgagcgcacaaaatgcagggacaaattcgaagacagggccttgggaagggtttgaggcaagacatgggccttaccaaggcagaaacgtagaaccaagacggcctccattcgacgcgggacgttgcctcccatgcgcccccgcccaccgctcacacactgtggcgtgagaccacttttcgacggagncttacggcactaaagaactcttggacgactaacgttgaggtatttggccgatggccttaacgtgagttatacgggcttaatcaaagagtatgacgacatagcagactacatttatagggctcacaatcgaggaactatgtgtttgaaaaacgacactgtgttgatggagtaaatggattaaaatagaggactggtgacccgactgcaatagtttttagggtacgttgaaacaaaacagtgcctattaaagagagaggtggcaagggtaaatataacggaacaatttgtgtataaaacatattatagaacacggataggtatgggaggaagtaaggggattataaagtaacgataatacaaattatgaatattaaggcaagaagagtaaataaatgacagaaccaaaaaaaggagcggtcacgtttgaggatgtgagagcgcattagattaatgtgagcgaaaaagcagaaggaggtggatacaattaaagttttatacacatatgtgggtaagaacaggagaaaaccattttggaattgtaaagagccgatgtagtgcagtagaacgacagattagctacagagttgttcgtgtttatggataagtaatgaatagacacacgcagatatagatgaggtgaagagtatatgataggttaaggagccgagaagatattggaagatatcagctatagagaaatagccaagtatagttaagaagatacaagtgaaaattagtagaagatatagtagtagtatattctatatcagagcgatagaaacactagaataaaataaagcgattgtgtaggttaggaaggtaacaatagataaag

SEQ ID NO: 530592 - DNA, 1140 bp, Homo sapiens
cgagatcacaccattgcactccagcctgggcgatgagcgaaactgtctcaaaaaaataaaacacgtgggggtctcgcctgtgttgaccaggctggtctacgaactccgggcgctcaagtgatcctcccatcttggcctcccaaaagtgttggggattacgggcgtgagccaccaaagaccctgcctgggttggtgtactcttgttaaatactaagttattaaatggtaaacatgctggcttttcagcatcaccactgggtaaaacataccaccttatccaactgcagttcctgtctcagttcaacaacacattggcaacattggtaacttaagaacgtcttcacagatacttcacagccaatcaattccaaggctctccaatggggtgggggtctacttcaaggtattctctctcacattgtcttatctccagtttacaatcacgcatctgtggtcacaaatgtggcacaggcgagttctcacgtgtcgcaattttctcactgtggccggtgtgcagccactaagaggtggcctctgtggccaaccaaaaagtggtctcatatagaggggccccaaagttcacaagtgtgacagcacctgtggagaagcactcgtagcatctcgataaaacttcccgctcttgtgggacccaatttataaacacgtctattgtgggtcgccccgcgtgcttacaacaacccaagagcccatcagtgtttcccaaggcattgtggtcggcacacaagcacattttgttagtgggcgtcaacaagttaaagtagtggggatagttacgaatagcattacaaagcactcgtcttgagtcgtgcacacgcttatcgttatcagcagggggggatttatgataagacaggattacctcttgtaaaagcacgcggtactatcaagtcgttcatggggcacacgaagaggggaaagatagattttgatccaagagatgacgacggcgcagttagtatacaagaatgttggtgggggagcgttgtattagtgaagaaccccgagaggcgattagtttctgatagcgtcgcatctgtattaatcgcacccagtggttgataaaacacaagcccgccgagatgcaaattattggggccgaaatttagagttgggattaac

SEQ ID NO: 530593 - DNA, 215 bp, Homo sapiens
agcttcatataaatggcaccattgtgtgtataagtcatctgggactcgcataattcaatgttaagtttccaaattcattctgtgtgtagcttctgggtaatgttccattgtaaaaactgtatgaaaatttatcgatgtattttcatacagtttttacaatggaacatgtgggttttcagtgttttgttattaaaatgtgctgataataaaaaaaa

SEQ ID NO: 530594 - DNA, 266 bp, Homo sapiens
tcggttcgactctacgacggactccccgagcccggtcagtactcattgcaaaccggcttcaaagcctatttatacaaacccgtctgttccaatctctcagacttccgttcacggttttagccagttaaatacctcaaacctgcatctgttctccgtagctgtgttaaccactgtgctggctcactacagcactcttcggcatagtaaatgatagtcactacacccacaataagaaacaaacaaacaaaaaagcagtaggaaacatt

SEQ ID NO: 530595 - DNA, 637 bp, Homo sapiens
ccgctgctgactatgttgaaactcacagaattatacattaaataaggtaaatttcactatatgcaaattatatctcaatttacaaaaatgactacactacctaggttaactttataaaaactgacattggataaattcaatatgtgaataaagatcctcaagggaatctactttgtattatcaaaggattattcctatgtacaaaaagatttataatactagtctcttaaataggctcttcttttgagagcatttacatttgaatacagattagctattttctgctaagagtctagaagtcaaagaaatggtgtatagggtgaatcccagattaaacatgaaacataaataatatgacatctctgaaataatcataagtccatgggaaaatataaccacttaatgtaaatacatttttgccaggaaattatcatagagaaaaaggtatttattattatgacatttgtatttaactactgtatcataaatgccatttgagatctaataatgataaatctgaccctgaatctgacacatcctaaaagctaagcaattattatcacctaagtagtatttgtatggaagagtgccataaatgctaaaacagtcagtgactatacttatataaaatgtgaga

SEQ ID NO: 530596 - DNA, 228 bp, Homo sapiens
ggaccgactgtggtgtacgtaggtaagccctcttttgccagttccgggtgaatgtcatgttgaatgcaaattcaaagaagcagcttcaattctgccgggacttctcccgcctttttttcctgcggcgggagaagtagattgaagccagttgattagggtgtttagcatcttttcatgtgattttggacattctgtatatattcttgggagaaatatctatttagatct

SEQ ID NO: 530597 - DNA, 347 bp, Homo sapiens
tgacagcttactaagaatttgaaaggtgatggggaacaaggtaaagcccagttaatatgcctaagcagccggacacggcggctcacgcctgtaatctcaacactgtgggttgctgaagccggtggattgcttaaggtcaggagttcgagaccagtctggctaacatggctgaaaccccatctctactaaaaatacaaaaattagccaggtgaggtggtgcatgcctgtagtcctagctacttgggaggctgaagtaggagaatcacttgaatccaagagagggaggttgtggtgagccaagatcacaccactgtgctccagcctgggtgacaaaacgagactctggc

SEQ ID NO: 530598 - DNA, 126 bp, Homo sapiens
acgatcaacgccgcttggaatacggttgttagcggatagctaatattagtatggtaattaggaagatgattagatctttgaatattctgattattgtttggagtctgagttttatatctcacagtg

SEQ ID NO: 530599 - DNA, 105 bp, Homo sapiens
gaatcctctgggaaattatttaactcaaaggcctcgaaagcctgactgtgaaccttccagatattttcattaaaagactttacagttttcttgcaattcattttg

SEQ ID NO: 530600 - DNA, 870 bp, Homo sapiens
cgaccgcttagtgacgagcgatgattttaaagagcagaataaaaggtttccctgtgcctgccccacagcccctccagtctcgaataatggagaactgtcaatgcactccgcgagcggtggcccattgtactgcagctgatggcgagtgaggtcgactgggggtagcaggggctctcgttgaccctcgtccctatgcccataataaacgctgcaaatcgcgctcccgtcttctggtcagttaaaaggtgaagacgaacacgattaagaagtagaccatacagtaaagagaaacgcacataagaacaagcctttctatgtacagattctaaatcgtactccccagtacagtcatgatggcagggatgtcgagggccgatggcagcgaggcggagagagggatgatatgtgcgagggaaggagaacgcggatagagactaagggagtgggagacacagcgacagcagagcgccagtggcacctgtaggcgacactggatgcccagtccggcggcccagccgaacctcgtgaccctgtgaccgtgacgtcgttgggcaccgagaaacgtagactcggccataatcctgccttcaccagcaggtagcatgaagcctcacagagcaaacaggtgttggcattgaattgaaagctaggcccactgatggaaccatgttttactaccgtgtagccacatatattgataccatgggatgagatggctgtgtggcacgtcgtggcctgccatctacaggtctgcgagcagcactgttcgtcagatagtttcctatgtaaaagttttccttgtatgttcgcatgattgcaacgagtgatgcccctagaagcgtggcatccctatataggataggcttacca

SEQ ID NO: 530601 - DNA, 1173 bp, Homo sapiens
ggctggatcccgcacctctgggcctacccggcgacttgattgcctctccctgaccgcgcatcggccatcgtccgtgctcgagcagaccactaggacgtgactccgggaagacaagttcgacagtctgcaaacatcagattgttggcgacacgaagtagtggacacgatatgatcgcggcatcatgtattgggcagcgcacagtccgatgattgaactactgctttaggagcaccaaatggagaggcgattggtagagtgagccacattgagtaggacagagtagccgagttgctctgcgcaggaggactttcaacgtacacacgcgatcacgaggcgggacgacacgtcccgactggactcggataaacttacggagccgcgcaattcccaagggaaaatggaacgccagggcctagggagaagcaagtgggaagaaacactagagaacttccaatgcctcaaactactaactcatcccttggcctcaggggggcacaaatagatggcgtggtgtgcaatggtaacaagcctatagacgacgaccaatttccatggtagaaagtcgaaaaccaaggaaattgtcaagccccgaagagcacgcctcgggtttgtgaacttcccacggatggagcatttagacccccggcccaacacatggcccctatttgtggcgcgcacgttccaaattcaacttgacaaatctacaggccgtatggccccccttacccaagggaaagaacgatcgtgtcacccgttacgttgccccacaattacttcggcaaccattaacaaagtttggtagacactgcgtgttgcccaataccttgtgcaggatcgcctttgcaacacccaattccaaattacaacaccatggccgcttccttaaatttaaacccttaaacccgagaaaaggtgaacacaaggttcaaagggttcagagacagagcagggaccattatcaatgtaacacggccatttgggcgcgtacccaagttttttgccaccccatgggtgaaatttggccataggtttaggaaaggcaaatagagggagtaaccagacgcatcgcaggtaagcgtacacggaaaactctagggggaatccgggcgcaaatagaccatatactcaacgttatgcgctgaatctcgagacaactataaaacaacttacct

SEQ ID NO: 530602 - DNA, 1148 bp, Homo sapiens
taaaggggaggtgggttcctgcatttccactctttgaccataggaacgccgggcttacaaaaggggctgtaatgggctgctgcctataggggccccaggtccttcctccaatgtgcaaggcagcaattccgaagtctctaagtcccagtggaaagtggcaggtggtgtgggctggactgtggcttggaggattcacggggccttcggttcttcaagcaccactcgtgtcgtggctgcagctgtgggcccttcagctgtgggggccaggtgtgtgcttctccagtgtgcccccaccgggctcagatcatcttctggcgcaaggaacgacgctgggtgggatatcttcttaacgtggtgcctttctcgacaggctcttctctccactcttaggtgtggcctctctggaccgcctggcccccggaaggtcttcatcacacgctgtgggccctcccacatcatccagggagggttgggcatgttagaccgctggaagcccccagcggactggatggcttacaaccaagtgtgtttcctctttggacttcctcatttagggacttctctgaaaaggctcgggcaatgttcaacacagttctcctccggagggagacttttcccatagtgtttcaagcttgtccctgaataaagggatcttcagaacacagggggtttgggtcacccaagtccctgggaccggacaggaaacgccaaaagtcgttccagaaagaccacgctgctcggctcaacatcgggggaacggaattcaacggaaccttctccaacacggggagacatccggcacaaggaagctcttagaacaccccctctctggaaaaaagggaactcctctcccaggacaggtccaggacccctgtgtctacgccctgccaaccgggggtataattatatcttattttctcacccgagagatggggcagccacagatactgtagtatggctacacttgtggacacagtgaaaactactccgagcgccaccaaaagggataaacacaaaacgtcatgagtcgacaaccacacctcaacaaggcggtagcgcagggacaatccacaataagaaagacacaaagagacacagtgaagctagtgcgacctaatgactacttgggcgctgatactacaaccaac

SEQ ID NO: 530603 - DNA, 791 bp, Homo sapiens
  misc_feature (375)..(375): n is a, c, g, or t
ctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacacacacacacacacncctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggctcggtaaggaaattttaagcattccttcaaagattgacgtgctaaaataagcattgatgttttgagtttttttacacctaggatttttagcttgggtgttgtaggtgaaggccaagactttctgcaggaaaaagcttattttcaaacttcagaaataaaatgtcaatcataaaaatttactttcaactttagcaaaaggaaaaaaaaatatcaaccaaagagtt

SEQ ID NO: 530604 - DNA, 171 bp, Homo sapiens
cagagagtcaacttgggtggcggaacgccgagatgccagcccaagaaacaaccacatcgatatcgcgtgcagcaggtgccgtcggtcaagggtggcttgtacgaacggtttcggttcaaaccggcggtgtcggtggtttgcagaagaattaaccggggttgatttaaagct

SEQ ID NO: 530605 - DNA, 99 bp, Homo sapiens
cacctgactgccccaccggctcccctgagtacattcatcccctgcctgcgggagggcgacggacaagccgtgcgccggccgatagtgatgtgtccgctg

SEQ ID NO: 530606 - DNA, 303 bp, Homo sapiens
agaaaaactatgttactttgtatatatcatgtatataagaaatacatagaagaggccaggcatggtgtctcgtacctgtaatcccagcactttgggaggctgaggcgggcagatcacccaaggtcaggggttcgagaccagcttggccaacacagtgaaaccctgtctcttctaaaattacaaaaaattagctgggcgtggtggctcacgcctataatccaagctactcgggaggctgaagcaggggattcaattgaactccagaggaggaggttgcagtgagctgaaattgcacctctactc

SEQ ID NO: 530607 - DNA, 296 bp, Homo sapiens
acgtgggtacttgcgcttactttgtagccttcatcagggtttcgctgaagatggcggtatataggctgagcaagaggtggtgacgttgatcggggtttatcgcattacagaacaggctcctctacagggatatgaagcaccgccaggtcctttgagtatttaagctagctgcgctcgtaactgttctaggcgagcagttcacgtagatctaactagttgaggttcagggctaagcatagtggggtatctaatcccagtttgcgtctaagctattgtgtgttcagatatgtcaaagc

SEQ ID NO: 530608 - DNA, 82 bp, Homo sapiens
agacagcagcatatatctctgcagtgtgacgccgctaacctcctacgagcagttcgggccaggcacgcggctcctggtgctc

SEQ ID NO: 530609 - DNA, 193 bp, Homo sapiens
aattcaagcttctaacggatgtacggggacatggtggcacaccacctgtggtcccaagctactcaggagagctgaggcaggaggatggcttgagcccaggaagtgtgaatgctgcaagtgattgcgggtgagcctattatggtggccacatgcattccaagcctgggcaacggagtgaggctctatctcaaga

SEQ ID NO: 530610 - DNA, 316 bp, Homo sapiens
ttggttgggggggcctcggagcagaacccaacctccgagcaggacatggtaagacttccccagtcaaagcgaacttctatactccattgatcccataacttggcccacggaacaagtttccctagggataacagcgccatcctattttaaagtccatatcaacaatagggttttcgacctcgatgttggatcaggacatccccatggggcaaccgctattaaaggtttgtttgttcaacgattaaagtcctacgtgatttgagttcagaccggagtaatccagggcgggttttattttcttccaattcctccctga

SEQ ID NO: 530611 - DNA, 135 bp, Homo sapiens
agagtcgtgatctccttgccatggtgtattgccctctggctatagttcttggctgcatcttccttggcctgtcatgagttgctcaggtggaagagctggcggtagtgccagtgcgaacttcatcaatgactgtgg

SEQ ID NO: 530612 - DNA, 322 bp, Homo sapiens
  misc_feature (17)..(17): n is a, c, g, or t
  misc_feature (22)..(22): n is a, c, g, or t
  misc_feature (46)..(46): n is a, c, g, or t
  misc_feature (221)..(221): n is a, c, g, or t
  misc_feature (241)..(241): n is a, c, g, or t
  misc_feature (283)..(283): n is a, c, g, or t
acggcccagttgggttnaagcncccgagctttatcaccaactgatntcgcgcccgtcggacatggaagaccttgctgcttggtcgcgcccgcaaagcccgcccgtggctgcaccgttcctggccgaactgcgtgaagcggtgggcctgcgctcgttcgtcaaccccgtcccgttgcgcccaccaccaagaagaaagctgcgaaagccgcgcgctttgtcanttccgcgaagacgacggcanttccgcttccgtttgctggcgccgaaggcgagcaaactgctntgtcgcgcaactttgccgacggtaaaaccgcaggcgccg

SEQ ID NO: 530613 - DNA, 4386 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530614 - DNA, 419 bp, Homo sapiens
attcgaggctcggtacccagctatgcccaccctataccccctatacctccctatatcacctgagggtttgttttttctgttgatcagaggtgaagagttgacagatatggactggttttgaatgccctttggtagactctttttaaaggtctctctccttgcaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggtaaaagtatggtaagaaaaagaactctgtacatggagaagtggtgtgacctgtcttggacctttctaatttgggtgtatcagcggatcctcta

SEQ ID NO: 530615 - DNA, 369 bp, Homo sapiens
gcacgagggcaggtgatgaacggaagtagatataatgcagcttagtgacctagcacctgtaatcctgagagaccagaataactttacatcatagcaggcggggagacgagagattgagtatgaggaccaaggtcgtgggtagcggatcttcttagatgctgtcacctattgatggggggaacagagatcatcttacagcttttctgagagaaagaggcatctgcagatgacatgctgcctctgtaagtactgctgctagctcttcatctgccaagtggtgacaatgcagacgcataccaggaacacgtgtacttgcatgttcagaacttatgatttgtcaacctgtcctgtgcacgaggctatggttcg

SEQ ID NO: 530616 - DNA, 9338 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctcggcaacaacaaaaaaaaggagatgcaggaacagtcactatcattagtcatcagggaaatgcaaattaaaacatgagaagccgttacacattcatcagtgtggctcaaatgaaaaaaacgcgacaatgtcaagtgtgagtgaagatgtgaagcagctgggactctcgtaccttgcgagtgggaggcaaaaccgtgccaccctcgcgagaactgtgtctcagggtctcagaaagttcagcacacaattcattaccctgtgggccggcagattcattcctaggtaggttttttgttgttgttgtttgtttgtttgtttgttttgagatctcggcttactgcaacctcggttcactgcaacctccgcctcccgggttcacgcctttctccttcctcagccttcctagtggctgggattacaggtgcgcaccaccacccccaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530617 - DNA, 134 bp, Homo sapiens
cacgacaagtacagaaacaagcccttgccacaacttccggcactgcttcggcgtggcccagatgatgtacagcatggtctggctctgcagtgctccaggtaaaagttctcacaaagcggggtaccgagacacga

SEQ ID NO: 530618 - DNA, 156 bp, Homo sapiens
ccaacttgtactgatgaatggagaaaaagtcagtgaatcatatgttatcacactagagagattagaagatgacctgcagatcaagggagaaagagctgatcagagctatggatatatttggctctgattgaggccttcagtgaagtcaatttaaat

SEQ ID NO: 530619 - DNA, 4456 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttggagtgcactggcaaagtcacagctcactgcaggccttgacttcccgggctcaaacgatcctcccacgttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530620 - DNA, 9262 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530621 - DNA, 170 bp, Homo sapiens
tacttttccacaggtgggcagtttcaggtcagctgagtcacccgagggaggtggcatgtgctaagacactgccgggaagacggattcctgatggcagaagggtgtattaaggatttccacccccggtaggcggcccgtcctttgctgagcctctgaaaatgacccgcgcc

SEQ ID NO: 530622 - DNA, 143 bp, Homo sapiens
atgtacatatagtcactcaatgttatggatgaatcttctactattagtgacttttctgctacgcaagcgaaggcttctcaaatcatgaaaattattaatattacttgctgttagcagcaatgaatgatgcctacagactgata

SEQ ID NO: 530623 - DNA, 152 bp, Homo sapiens
tgtcgaggaactgtacaggggggcatgcaccgcagtggtgaatacacgtcgaccaggctccatctataacgatcttgggaggtgagcacggtgctcactgtgatctgaaggaactagtacagggaggcatgcaccggcagtggtgaatacac

SEQ ID NO: 530624 - DNA, 9061 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6183)..(6183): n is a, c, g, or t
  misc_feature (6186)..(6186): n is a, c, g, or t
  misc_feature (6218)..(6218): n is a, c, g, or t
  misc_feature (6229)..(6230): n is a, c, g, or t
  misc_feature (6236)..(6236): n is a, c, g, or t
  misc_feature (6246)..(6246): n is a, c, g, or t
  misc_feature (6252)..(6253): n is a, c, g, or t
  misc_feature (6256)..(6258): n is a, c, g, or t
  misc_feature (6273)..(6273): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatggtgaaaccctagttctaccaaagaatagataaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530625 - DNA, 4445 bp, Homo sapiens
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcacctcccgagtagctgggattacagatgtgtaccaccacacctggcgttgccatctttatgcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530626 - DNA, 9670 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
  misc_feature (9372)..(9372): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaaaaaaaaaaaaaaaaaaaaaaaaaaaaaaaaaaaaaaaaaaaaaaaaaacgggggttttttggggggggggacaaagtaaaggcggttcacgttgttttttcggcaacccnttttttctcaacgaggggaaaagcggcgggaccccaaaggggggaggataaaattcaaaaaccggcgtctccctcttcgttctctctgcatagacaaccataagatcaacaaacagaacgcagcagatacatagcatagagggataagagaaaagaaaagagagatcataacacagacacagaactaacaaacgcagcacagaaatgacgcaacagacatgatcaatcaacaataaatgagagaaatcagaagtagagggtaagccaatatcaagcaatgagagaaagacgagaggca

SEQ ID NO: 530627 - DNA, 167 bp, Homo sapiens
ggccctcatgcttatactttctcaacgcttcatacgttcgtcaacgcttatactttctcaacgctttatacttcctcaacgctttatacttctcaacgctttatactttctcaacgctttatacttcatacccggaaatgacatgagaagcgttgagaagcgttgag

SEQ ID NO: 530628 - DNA, 1103 bp, Homo sapiens
ggtactgtggcgccttatgagactgcgaggtggtgcctctcacccagctaattggtctctagacccttggtacttcacaggctgttgcctgcctggccgagtaacagcactctctgacctgtggcccgctcatcatgtcatccgcacaagacgtttggtgcctgatggaggcgggacacggagtgactgtcgatgtcgtagatctgaccacgagcatgacaggtgccgtgggtccatccgtaagctgtggagactatgcgagtcggtacctgatggtccacagcactgtgcgtcccggttcatgtctatacgcagcgtgggaccatccgtagagatgggagttcccgcgagcaaatgtaaaagtgcaaaccaacaaggcggtctgggatagtcgggcctagggatcatggcttaggtgctggtaccgtacttatataggggacgccttgtcgaatactcattcaatagacaattatatccaaccgcgttgcgaaaaaatttggtgattgctacgccaaatgggttggggagaaaaactcttatagtggtgggttgcgatctctgcctaatttgacaggagaggcagggaattctgtagagggcaaataactgaccatgtattggagggatatttgccttataggggaagcgtgtttggaatacgtttacgaaattaacttgcgcatacacattgtgcattggtaaacaccatgcgttgtggagatttggtggggctttcggggcagaccaggggacggatactattgggggaactggcgtgggaattagaaagatattggtttaggggcaccttacaaggaatttacccatgggttaaagaacgactttgggtggcgcccccagttcatggtggagacgtctttttcttataaagaaatattggtggaacggaagctggatacttggttcagttgtggtttcaaaacttagtgggatttgtgggcaaagtggacggacggtaaacaacttgcggcaaggtatggagcttatagggagcgctacaacttctcaccggggcgtttttgagaaggtacccttggaggatagaataatcggtcttgtggggaaaagactggctgggc

SEQ ID NO: 530629 - DNA, 965 bp, Homo sapiens
  misc_feature (965)..(965): n is a, c, g, or t
cggaaataggcatactagaatctcgcgtacgtgggggccgacatgggcgaacagttggtaatgtggccaatgttgctgttacatgaggccgagatgacttcagggtctatgaccgcggttgaaactgggcactgaagaaccatgacatctgttcccggcagtttgattgcttctatagccagccttaaacatggtggttgtaagtaaagttttacagagcaattagtgaaacataaactcatagcttgggagcgtaccaaaactgtccaggctatcggttgacaaatgcaggatatgattacctggctttgaaaacactttcttctaggcaagtagttgagtgtgtggaaaccagatgggtgttggcgaaagaatcagatatttacattgtggcccatgaagaaggacaacaatttgcattaacagcttcacagactaggaagaacctcgttcgacactttgaaaaacaaacgcgattatcataaacataggcacaatgtggtctggcttcattatctcgtctctactggcatgaacggattttgcctattgacggcattgtttgacgaggacactttcccagctccaaggcgattgaataaccacggccattgcggggacatggcacgtcatacatggttccctatgtacacttccctgtgaaaaccggcccagaatgcgacttggacttatgccactgcacatggagatatggagaacacaacagcgcagaggagatctactgtggcatcgactaagccaccaccttagaaaatcaccatctactacagacttgttttcttttttttcctgtttcctcctaaatatccttccccccaaaaaaaaacaaccaagacaacaaaaacaacaaaacaaacacaaaaataaaaaatacaacataactcatcatcaactcaaccataaaagaacatcaactcaaatagaacaacaaaaacaaacgccgn

SEQ ID NO: 530630 - DNA, 9900 bp, Homo sapiens
  misc_feature (4052)..(4052): n is a, c, g, or t
  misc_feature (4061)..(4061): n is a, c, g, or t
  misc_feature (4065)..(4065): n is a, c, g, or t
  misc_feature (4070)..(4070): n is a, c, g, or t
  misc_feature (4080)..(4080): n is a, c, g, or t
  misc_feature (4095)..(4095): n is a, c, g, or t
  misc_feature (4129)..(4129): n is a, c, g, or t
  misc_feature (4159)..(4159): n is a, c, g, or t
  misc_feature (4168)..(4168): n is a, c, g, or t
  misc_feature (4172)..(4172): n is a, c, g, or t
  misc_feature (4175)..(4175): n is a, c, g, or t
  misc_feature (4185)..(4185): n is a, c, g, or t
  misc_feature (4194)..(4194): n is a, c, g, or t
  misc_feature (4374)..(4374): n is a, c, g, or t
  misc_feature (4379)..(4379): n is a, c, g, or t
  misc_feature (4454)..(4454): n is a, c, g, or t
  misc_feature (4458)..(4458): n is a, c, g, or t
  misc_feature (4498)..(4498): n is a, c, g, or t
  misc_feature (4506)..(4506): n is a, c, g, or t
  misc_feature (4514)..(4514): n is a, c, g, or t
  misc_feature (4516)..(4516): n is a, c, g, or t
  misc_feature (4542)..(4542): n is a, c, g, or t
  misc_feature (4552)..(4552): n is a, c, g, or t
  misc_feature (4604)..(4604): n is a, c, g, or t
  misc_feature (4611)..(4611): n is a, c, g, or t
  misc_feature (4623)..(4623): n is a, c, g, or t
  misc_feature (4686)..(4686): n is a, c, g, or t
  misc_feature (4795)..(4795): n is a, c, g, or t
  misc_feature (4838)..(4838): n is a, c, g, or t
  misc_feature (4888)..(4888): n is a, c, g, or t
  misc_feature (4893)..(4893): n is a, c, g, or t
  misc_feature (4900)..(4900): n is a, c, g, or t
  misc_feature (4953)..(4953): n is a, c, g, or t
  misc_feature (5035)..(5036): n is a, c, g, or t
  misc_feature (5061)..(5061): n is a, c, g, or t
  misc_feature (5142)..(5142): n is a, c, g, or t
  misc_feature (5152)..(5152): n is a, c, g, or t
  misc_feature (5177)..(5177): n is a, c, g, or t
  misc_feature (5191)..(5191): n is a, c, g, or t
  misc_feature (5200)..(5200): n is a, c, g, or t
  misc_feature (5207)..(5207): n is a, c, g, or t
  misc_feature (5221)..(5221): n is a, c, g, or t
  misc_feature (5238)..(5238): n is a, c, g, or t
  misc_feature (6384)..(6384): n is a, c, g, or t
  misc_feature (6387)..(6387): n is a, c, g, or t
  misc_feature (6419)..(6419): n is a, c, g, or t
  misc_feature (6430)..(6431): n is a, c, g, or t
  misc_feature (6437)..(6437): n is a, c, g, or t
  misc_feature (6447)..(6447): n is a, c, g, or t
  misc_feature (6453)..(6454): n is a, c, g, or t
  misc_feature (6457)..(6459): n is a, c, g, or t
  misc_feature (6474)..(6474): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctgggtgacagagcaanacnctacctcagaaaaaaaaaaaaaaaaaaaaaanaaaaaaaaaanntaaatnaaaaatcccntggggnnttnnntttattttataaggngaaggaccctctgcaacaaaaaggaaccagcaagcacaggctccctgttactccctgtggtgcaggaggcatttttctgagggcattaagcacttcaaagtgtgcctgtggtgggagtgctgtgtgggcaggaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaaaaaaaaaaaaaaaaaaaaaaaaaaaaaaaaaaaaaaaaaaaaaaaaaaaaaaaaaaaaaaaaaaaaaaaaaaaaaaaagaaaacgcacaaaaaagaagaaaagggggggcggcgcgcgccgcgcaataaagaactctatctacgcccaggggcgcggcgcaacaaacctcagacggcgcgccgcccgcagctgttatgctgagagaaagaggagcggcgcgccacctaacacggaggcggctggtcatatatatacaaacggcgcaggcacggcgcgcggcgcgtagataaaaaacaacggcaaccgtcagcgccaccacaccgaccgcgccaccagacgagaaagcactacgtgtcgaaggaaacccaccccacaaccaagagggggggggagagaagcaaaaaacgaaggagggggggcacaactcacacgccccccaacgaagaaaacaagacacaacacaacgccgcgagcgagggaaagcccacaacaacagagccaccagagcaacgggagacgaagcggcggaccaaccccacccgcgcgcgccactacacccaccgcaccgagaaaacaacaaaaaacggcgcggccccaaagaaggacactcaccccacaaacacatctttacacaggg

SEQ ID NO: 530631 - DNA, 179 bp, Homo sapiens
aatgacggatggtagcatcttgggtcatacgcattgtctgagaagtgtatggatctagccttggtataaggttctgggtatgccatgtctgagaaggtaggatcttggccctgataggagggatcatgaggatctggatctgtcagaatctgaggaggtaggatctggttgccggtatg

SEQ ID NO: 530632 - DNA, 181 bp, Homo sapiens
acctgcctgccaagtgctgtgattacaggcatagccatcacacctggtcttcttcgtatgtttcttaccctactcttattatctagtgtcacatttagaaaatcatagacatgtcttaaagtcttcattgttggaaacactcttgtcattgaacgcaataccatggctatctactggtccc

SEQ ID NO: 530633 - DNA, 124 bp, Homo sapiens
ccgtcagctacgccgacgatgctcgccgcagttaccaggtgccggccggcagcctgagtgcggcgctgacccggtttgccgggttggcgtcacgtcggtgatgctggcgatcttatagccacag

SEQ ID NO: 530634 - DNA, 9243 bp, Homo sapiens
  misc_feature (3957)..(3957): n is a, c, g, or t
  misc_feature (3966)..(3966): n is a, c, g, or t
  misc_feature (3970)..(3970): n is a, c, g, or t
  misc_feature (3975)..(3975): n is a, c, g, or t
  misc_feature (3985)..(3985): n is a, c, g, or t
  misc_feature (4000)..(4000): n is a, c, g, or t
  misc_feature (4034)..(4034): n is a, c, g, or t
  misc_feature (4064)..(4064): n is a, c, g, or t
  misc_feature (4073)..(4073): n is a, c, g, or t
  misc_feature (4077)..(4077): n is a, c, g, or t
  misc_feature (4080)..(4080): n is a, c, g, or t
  misc_feature (4090)..(4090): n is a, c, g, or t
  misc_feature (4099)..(4099): n is a, c, g, or t
  misc_feature (4279)..(4279): n is a, c, g, or t
  misc_feature (4284)..(4284): n is a, c, g, or t
  misc_feature (4359)..(4359): n is a, c, g, or t
  misc_feature (4363)..(4363): n is a, c, g, or t
  misc_feature (4403)..(4403): n is a, c, g, or t
  misc_feature (4411)..(4411): n is a, c, g, or t
  misc_feature (4419)..(4419): n is a, c, g, or t
  misc_feature (4421)..(4421): n is a, c, g, or t
  misc_feature (4447)..(4447): n is a, c, g, or t
  misc_feature (4457)..(4457): n is a, c, g, or t
  misc_feature (4509)..(4509): n is a, c, g, or t
  misc_feature (4516)..(4516): n is a, c, g, or t
  misc_feature (4528)..(4528): n is a, c, g, or t
  misc_feature (4591)..(4591): n is a, c, g, or t
  misc_feature (4700)..(4700): n is a, c, g, or t
  misc_feature (4743)..(4743): n is a, c, g, or t
  misc_feature (4793)..(4793): n is a, c, g, or t
  misc_feature (4798)..(4798): n is a, c, g, or t
  misc_feature (4805)..(4805): n is a, c, g, or t
  misc_feature (4858)..(4858): n is a, c, g, or t
  misc_feature (4940)..(4941): n is a, c, g, or t
  misc_feature (4966)..(4966): n is a, c, g, or t
  misc_feature (5047)..(5047): n is a, c, g, or t
  misc_feature (5057)..(5057): n is a, c, g, or t
  misc_feature (5082)..(5082): n is a, c, g, or t
  misc_feature (5096)..(5096): n is a, c, g, or t
  misc_feature (5105)..(5105): n is a, c, g, or t
  misc_feature (5112)..(5112): n is a, c, g, or t
  misc_feature (5126)..(5126): n is a, c, g, or t
  misc_feature (5143)..(5143): n is a, c, g, or t
agcggattgtgcgaggcaccgggacgtcggcggctggcggagccgggctgggctgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgttttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgttttttatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcgattcccctccctcggcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctcaatgacaccagtctttttttttttttttcttttttgtttcccttttagagacagggtttcgctctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcnggtggatcncaangtcangggattgagnccatcctggccaacntggtgaaaccccatttctgttaaaactacaaaanttagctgggcatggtggcgagcgcctgtgntcccagctnctcnggnggctgaggcnggagaatcncttgacccaggaagcgtaggttgtagtgagctgagatcgtgccactgtactccagcctgggcgacagagcgagactctgtctcaaaaaaaaaaaaaagatgtggtcttgccatgttgcccaggctggtctcaaactcctaggctcaagtgatcttcctgccttggttcccaaagtgctgngattncagctgtgagccactgcacctgaccttttttttttcccccctcctttttttttgagacaggttctcgctctgtcncccnggctgaagtgcagtggcatttgaggtcagtctcaccttgncctccccnggctcaancnatcctcccgcctcagcctcctgagcngctgggactncaggcatgtgccaccatccctggctgattttttaaatttgttgtagagatgnggtctcnctatgttgcccnggctggtcttgaactcttgggcccaagcgatcctcccgcctcagtgctgagattgcagtggtnagccaccatgtccagccaactctttaataataggcagttctgactggtgtaagttctgactggtatctcactgtggttttaatttgcatctctgatgattagtgatgtngggcattttttcatgggttttttgtttgtttgttttgagacanagtcttgttctgttgcccaggctggagtgcagtagtgtgatctcggctcnctgcngcctccncctcccgggttcaagccattgtccagcctctgcctcctaagtagctggaattncaggtggctgccaccacacccagctaatttttttagttttggtggagacagggtttctccatgttggccaggctggtctcgnnctcctgacctcaagtgatccacccncctcggcttcccaaagtgctgggattataggtgtgagccaccgcgcccggccctcatgggttgttttgttttgttttgagncggaatctcnccctgtcacccaggctgcagtgcantctcatgatctccncttactgcnacctccncgtcctgggttcangtgatgctcctgcctcngcctcccgagtggctgggactgcaggcgtgcacccacgcctggctaatttttatatttttggtggagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggagctcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtggctcgcgcctgtaatcccagcactttgggaggccgaggcggtggatcatttgaggtcaggagttcgagacagccaggccagcatggtgaaaacccatctctactaaaaataaaagaaattagccaggtgtggtggcacgtgcctgtggtcctagctgcttgggaggctgaggtaggagaatcgcttgaacccgggaggcagaggttgcagcgagccgagattgcgccactgcactccagcctcggcaacaacaaaaaaaaggagatgcaggaacagtcactatcattagtcatcagggaaatgcaaattaaaacatgagaagccgttacacattcatcagtgtggctcaaatgaaaaaaacgcgacaatgtcaagtgtgagtgaagatgtgaagcagctgggactctcgtaccttgcgagtgggaggcaaaaccgtgccaccctcgcgagaactgtgtctcagggtctcagaaagttcagcacacaattcattaccctgtgggccggcagattcattcctaggtaggttttttgttgttgttgtttgtttgtttgtttgttttgagatctcggcttactgcaacctcggttcactgcaacctccgcctcccgggttcacgcctttctccttcctcagccttcctagtggctgggattacaggtgcgcaccaccacccccaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 530635 - DNA, 305 bp, Homo sapiens
tccccctgaaagggaaaaaggggatagtccccggggcccccccccccaaaatttttaaaaaagccaaaaagggaaaaaagggggcggggggcccgcccccgaacaggggggccccgaagctccccccgcaaaaaaggggggggtttggccctttggggattttaggccccaaaggagatcctttaaattttggttttttttggggaaagggttaagaaatttcccctaaatcttgttttgtttggtgggatgaaaagttacctttttttcccaaaaaaaaggggggatttttcctgtttggttta

SEQ ID NO: 530636 - DNA, 269 bp, Homo sapiens
ccctgtttctgacttgctggctgactttggctaccgcccgaaccatattaagtacgttactcatacttgaatgtaacacaatttgccataaaagaagtaatttgataagtgagcaggaggatactgatacattagctaattttgggcggaagtgaatattggcgccgtgcctgtagctaaacgagatcatgtgatataagtgctgtagggcgcgcagatgcagtgatatttaaacggacggaccaccagaccccgattatagcgcatcg

SEQ ID NO: 530637 - DNA, 427 bp, Homo sapiens
gcagccagtgctgtggtcaatcacaaggcctagggttagggtacaggttagggtaacgagccaggttatggtcaacatgagacttaggattcagggtttgatgttggagttagggttagtgctagggtttaggctagtggttagtgttagggttaggcttagggttagggttggaattaggggttcagggtacgggtccatatgcagtgcatggtaagggttagctgtcagggcccacatgaggcattgtaaattaggtttagggctcgggatagggttagggtagtaagtaaggagtaatggtaaaggttaaggtttgggttgaagttagggttagggttagagttaacggtaaaggttatggtagtaggagtaagtataactggttaggggtaaggtataggagtagagatagggttaggattag

SEQ ID NO: 530638 - DNA, 197 bp, Homo sapiens
aaggcagagaaaaataataaagatacagaacacatgaaggaaggtaatcagaaggaaaggagtctagatatgtcttaactatgtaagatagataaagactcacacttctaatcttctcaaccctgagagtgatttaacactggtcttgagacagactttattcggctatccctctatataataggtaccaccagggg

SEQ ID NO: 530639 - DNA, 430 bp, Homo sapiens
  misc_feature (21)..(21): n is a, c, g, or t
  misc_feature (40)..(40): n is a, c, g, or t
  misc_feature (56)..(56): n is a, c, g, or t
  misc_feature (79)..(79): n is a, c, g, or t
  misc_feature (108)..(108): n is a, c, g, or t
  misc_feature (421)..(422): n is a, c, g, or t
cccagaatgggcgcccttaanagctgtaaaactcaacgcnaaaggtctgcagcttnactccctgagcccagcgagaccnacgaaccccacccagaaggaagaaacttnagacgcgcccaccttaagagctgtaacaccgcgagggtccgcggcttcattcttgaagtcagcgagaccaagaacccaccaaatccggacacaactccctttctccctatccctagcccctggcaaccactaatctgctttctgtctctatggatttacctatcttgggtatttcatgcaatgaaattgttaatggaaaggagtcctgacccagagcccaagagagggttcttggatctcgtgcaaaaaagaattcagggcaagtccataaagtgaaagcaagtttatttaaaaagtaaaggaataaaagaannaatactct

SEQ ID NO: 530640 - DNA, 192 bp, Homo sapiens
ttgtatagctgttctagagtgtacctgagaggtagaggtgggaatcgtggcagcatgtgaggatgtgctgggaagtctggtcgagaggtgagaggtgggaactcggtcagagtgtgagaggtgggaactcggtcagaggtgagaggtgtggaactcgtgtcagagtgtgcccgccctggtcccaatgatcgg

SEQ ID NO: 530641 - DNA, 1233 bp, Homo sapiens
cgtttcttgttctgtattgtttctgttcatcttttctctttgttttctctctttttgttctgttgttttctttcttttttttttgttcttctctgttgtttttgtttctctttttcttgttttattattatggctcagacgggggcggcagcaggaggagcgccgttttctcgtctcattgtgagttcacctttatggcgtgaatggtgatcttcttctaaaggttcccggtattttgtttttatgcgcgcgtggggtcgtgcgggaggtggccccaccctcggggtggaagcagccccttttagtgccgccaaagcgccaccaagaaaaggggcacgacatctttgaaagaaagggagtaaaaatgggcaccccccctctctttgtccaatatgagaattggggaagccgctgcgtccccggaccccgagggaccacaagggctatcggagggttcaccaaggtccctgtgtgttgaaaaggattctttcggattgtcagaatgtagagagttgccattttagaaaagttccacctgggttccgggagatttttcacggggttaaaactgccctcgactgacttccatggccacggatcttacccgtgaccaaaatgtgtttcccatggtcccaaaaactggccagcaccatgattgaagctcacgcttgatgtcaagacatacccgatggtgtaccttgcttctgtcatgattctgtgtgtggttcttacctacgagataacctgccgaccaatccagattaccggaagacctctctatgcgtcgagcgaacaccaaccaggtcccgctcctaatcccggaagaagatgcatggcacaatcgctgagccccgagaggtcgccagtaccaatgagcattgcaatagtatatgtggtgccatattcacatctggattccaacgacagcacttggaacaagacactagaacaaggcttgcccactctatttatcctctcccctgactgtgcttcgttagaaaacacgtataaaactgctgaagaagccccacgtttgatacttgggagaaagctcactggaggcttcattggtgaacggcacgtagttcctgggaaagccacctggggacgtatgtacccgagtgcctataagttgtatacgagactgatgcgatatgaacccccccgtcgccgagaatctgtttaaagttcagacttccaatagtggccaattaaaagtgctatttgtgatgg

SEQ ID NO: 530642 - DNA, 418 bp, Homo sapiens
caaatcactaagctaaagggaaaagtcaagctgggaactgcttagggccaacctgcctcccattctattcaaagtcacccctctgctcactgagataaatgcatatctggttgccttctttggaaaggctaatcagaaactcagaagaaatgcaaccatctgtcccttatctgcctatgacctggaagccccctccccactttgagtcctcccgcctttgctttgagttgtcccgcctttccagaccgagccaatgtttatcttctatatgttgattgatgtctcatgtctccctagaatttataaaaccaaactgtgctctgatcacctttgacacatgtcttcaggacctcctgaggctgtgtcatgggcatgcatcctcaatcttggcaaaataaactttctaaattagctgaaa

SEQ ID NO: 530643 - DNA, 338 bp, Homo sapiens
ctaatggtcaccgccacgttctgtccgatcagtattattttaaaatgactaatcttggctgggtgcggtggctcacgcctgtaatcccagcactttgggaggccgaggtgggcggatcatctgaggtcgggagttggagaccagcctcaccaacatggagaaatcctgtctctactaaaaatacaaaattagccaggcctggtggcgcattcctgtaatcccagccactcaggaggctgaggcaggagagttgcttgaaccttggaggcgaaggttgcggtgagtcgagatcgtgccactgcactccagcctgggcaacaagagcaaaactcagtctc

SEQ ID NO: 530644 - DNA, 935 bp, Homo sapiens
gattttccgggagactgcagtcgaaggtcgtgaggtacttctaagtcagccatagtggcaggtgaagaaattactgaagactatccagtagaatttcacgagtgtttgtcagcgtatgagaattccattgaggctgtggatgagatgctgaagaccatgatgtctgtttctagaaatgagttgttgcacaagttgtggatccaacttgaacatgcaaatagtggattcggtttctgcaatacacattaaattcattgttgggcggtttgattgtggcaacccaaggagtgtaatcctaaggaacttccagtaaaacatggagttggaatgatgtcagaggtatattactgcagacggagtcagggacatgtagcagacaagagaaaaggcctggcaggacgtggtactgaggtgcaagcttcaagtattgcgtaaaccctggtgccctctgggagaccaaagatcgacaaatttgcattcaacagagttgccaactaatggacagcaagctacaagctaaacctgtttggtttgatgtacacctatgcaaaacagtacatttttttccccccgcgccaacgcaggtaataaaattggtgtgggagctacagtggttcatgatcttccaaaggcttgaggcattcgcactgaaaagttaggccgaataggtactgcccggagaagactgctatttgagcgagaccgggtattaccctgcggaagcgcttttatacttccacgacatcttggatgagcacgcatggttatcatgagcggcgcggagcaacccttttggacgtcaagctgtgaagtgctttgatcactcgcactaagtgaggggctcgccaagacttggagaagtcctgtggcaattaaacacaagagctaaatgtcgagttaccaataatgtggtgaagaaaaagaattgggctcat

SEQ ID NO: 530645 - DNA, 956 bp, Homo sapiens
tctgaaagttggctataatttctctatccctacccacaaccctgggaagtggagcaagaggggcatactattgggctgggaggatttgacagcatttccccagttgccctttaagttcttctatttcaaacgttaattttgcttctctttctaaaaaaaaaaaaaaaaaagaaagaaaagaaaagaaagtgattcctacccccttaaactccagaagtgtgcttgaaagctgaaaagcttcacaagaattcttcctgttaaactggggattctcgttccagaaaatggggggataaaccgggaatatctgggtttaagaaaaactttctttagaagaaggggtacctagacttacgggatgaagtggtgttaaggaagtggggcaacgtgagagtgcgtgtcagtgtgtggaacactatttaaggggccctattattaacatttatcctattaagaaagtggacaagtggttctacctccaaaaggtcttaaacattatttccaagtggcaagtgtacagaaactttccgtggaagaaccacctgtggaatgaactgttggaaaaaagtggtctgacgaggagattaaaattagacttgtggacaaaaagccctttttaatatgagaaaattatatttgtgaaatgtggccataactatgggggggctctttaaaaaaaccgcgaggtctattttaaaacccgtggttaaaaaagtgggtcaagtacggcgcaaatgtggaagggacttgaaaggtatatatgttcttaccgtgagaaagtgtccacaaatcttaccctgtttgggaagttttataaaacaaggggtgggcccctcaagaagaaactaacctgtgaaaaaactccacacgattttttcacaggagcacactgtgtgggggagaaaattaaagggattcaggaaaatgagagggggacaaaccgcggggtaagatca

SEQ ID NO: 530646 - DNA, 664 bp, Homo sapiens
cacgaggtttttctctcactcctaacaaccttctgttcactgcctctcaatttttttgcataattgttaaaacttaatgtttaggtctatagtgaaatcataaaaaataaaggctcatcaaatcaactcataaatatctgagtagatttttcactgggctttgtaatcttatagctccatcctcacatttctagtggctctctcgacctttcctttcattacatcccaaactgtaatcatttccagcagcatgtcccgtgttctgtgttactgtgtcctgttaattaactctgccatgtgagtcattcaagctggaaacattgcaattacatatgatctctccctttcccttcacatttaatccacacttttaccaactcctgccaactcttctactacaccatttcccttccctttatctgtctaatcccaccaccatttttttagtcagtctctcattggtcattattgaggtctttttaacggactttccatcacgagtatcttccctctgctttaacagcctgtctccctgatataatggctctttggttctaagaaagaagctattatatcttgtcattcagaatacccatggggaaagactcatcttcttccaatctaatttctaactaaacttcatactttttccaaatgaatttgt

SEQ ID NO: 530647 - DNA, 573 bp, Homo sapiens
gagctcttctgatacagtctgagccgaacatttgtcgtagtttgtagcaaggtctaatctcactatcgagtgaccacagtccggaccaggctggagtcagtcatgtgtccgagcacctttcatagccatagtagaggcttcttcagacaatcgaaggcagggcggtactgggcgccactgcaacaatggtcttcaaaccactttctacatatccggaaaactcacggctcacactgcttaacaagtctcgattagccatcctagaataagcctccatggtagctctcagctgaggaaagcttcttgtagcaaggatcatgttaaagcaagattcatcggtccctagtctcccctcaccagcttgatagagacgctgagcatcttcctgagccatttggtggtttatactctggttctcatcacgatttccctggcacatggacacaagtaaacgttcaaaatgtcctgatgtatctgacctaatgtccttttcaaggtctcgtccaaattctgactgataacatctgacaatttctcggatttcctgatttgttcttgtggtccgagcggacc

SEQ ID NO: 530648 - DNA, 259 bp, Homo sapiens
  misc_feature (24)..(24): n is a, c, g, or t
  misc_feature (38)..(38): n is a, c, g, or t
aggctgaggtgggcagatcttctngaggtcgggagttncaagaacagggccggccaacatgggtgaaacccccccactcactaaaaatacaaaaattggctgggtgtggtggcatgcgcctgtagtcctggctacttgggagtctgaggcaggagaatcacttgaaccagaaaggcggatgtgtagtgagccgagatcgtgccactgcatttcagcctgggtgacacagcaagactccatctaaaaaaaataataaatt

SEQ ID NO: 530649 - DNA, 449 bp, Homo sapiens
cctgcaaggtcgattcttgaggtatcccgtttctgcttctgcctagagtgatagatgcaagaccctatctcatacaatgatcgaaaccgaaagcagaacaaaaactctctctggaaaggttttctctctgaaagcagttcccctgctccagaagatgcttatggcccatcgtatcttcttccaactggtcgagacagttaaatacttcaaaatgccccaagaggtcccaaaatttagtcaaggcaagtatcaatcaggctacatactttctaggtgtgacaaatatcagagttttgagaaagacattaaaatcatcatggaatccttggaggcctgagatactaaagcaccaatgcagacagtcttataggaagtctggaaccaatacttcttccgtcagtaacataggcctttctagactttggtctagaagaagatgatttttttgt

SEQ ID NO: 530650 - DNA, 110 bp, Homo sapiens
cactctctcagtgtggatcccacccctctttcatctctgtaccccacaaataacacagacaccccatcctatcgtcgacgcggccgcgaatttagtagtagtagtcgacc

SEQ ID NO: 530651 - DNA, 563 bp, Homo sapiens
taggctagtcgagccgcgggtaatcggacgagggagtggggcacagcgaggcggctgggggaacgctggctctgaaactagctctgggaccggggctctgctggcggcccctaggcgtggccccggtctcccagtgccccagaagggtattcactggggattcgtgagctatggctactccagtttcccacgacacgagtgttccctgttctagcaggctgctggaggactggagctgctactactactcctgggctgtggcaggtgaggagaatcctggcggacagaaggaaaaaacttgcgaggttggtaggagagaaagggtaaagagtctgagaaagagttggctctagtgaagagggtgaaaccactgtttaataaaagctttgagagcactgtgggccagggttcagacacgatacatctacatcttcagggtgtgccgggagagctggctaaccgacactatcgtggggcaggccgtggtgcgaaatcaacaataagtaatgggaaggagacagtggtagggagactccaacgagactcacatcttcgacggaagt

SEQ ID NO: 530652 - DNA, 236 bp, Homo sapiens
  misc_feature (154)..(154): n is a, c, g, or t
  misc_feature (190)..(190): n is a, c, g, or t
  misc_feature (203)..(203): n is a, c, g, or t
  misc_feature (226)..(226): n is a, c, g, or t
gaaatttgacgcacgaagaaatggatgtcacctcacagttcacccctgacatctgtgatagtgtatgtaatcactgacatgttctcattcaaactatgttataagagcaaggagaaagaagtaagaaaaatttcctatcatgtagaaaattctngggaacctcaaataactcactttatatttagcaggngtttatgcttcanagatcatctttccctgcaatagncattttatca

SEQ ID NO: 530653 - DNA, 472 bp, Homo sapiens
cagcagatatctgtatctttgtcacttgagagttcatgggaaatttagagacccaagagcctgaattccggtagttcagaagtgctcataagcaaggaaaggagagtaagatgatttggacaccaggaaaaatgaacacagagagtggcaggaaatggaaatattttcttcaagtcataagaaatggtgcctggcaatgtcaagaagcagcaattccacttaacttcacggtactgcaagctactgaaaatggtgtggaactggtataaactggtataatctacttggtgcgaaggcaatagtatatgcaacttaaatcaagaaaccaaatgctcagggaaatgcaacgtacaaagaagcaatggcaaatatatatgtgttgttctacttcatcaatttttcttagctgctagagcatttgaaattattctgttcacactaaatattcttaaaattatgtaaactctttaaa

SEQ ID NO: 530654 - DNA, 304 bp, Homo sapiens
  misc_feature (64)..(64): n is a, c, g, or t
  misc_feature (177)..(177): n is a, c, g, or t
  misc_feature (207)..(207): n is a, c, g, or t
  misc_feature (219)..(219): n is a, c, g, or t
  misc_feature (245)..(245): n is a, c, g, or t
  misc_feature (278)..(278): n is a, c, g, or t
  misc_feature (292)..(292): n is a, c, g, or t
cttgtctattgtctatgtctgtctatgtctatgtctatgtctatgtctatgtctatgtctatgntctagtctatgtctatgtctctagctctagctctagctctatctctacctctatctcctgttagttctgtccctctaagagaaccctgactaatacaggatctgaatttaggnatcgataacaaaaacaatttttgggaaacncataaatatgtngtaaagtaaataaaatagtcttaaanaaccaagggattaaagaagaaaaccaaaggagnaatttagaaaatanctttgagatgaa

SEQ ID NO: 530655 - DNA, 921 bp, Homo sapiens
  misc_feature (54)..(54): n is a, c, g, or t
  misc_feature (65)..(65): n is a, c, g, or t
  misc_feature (78)..(78): n is a, c, g, or t
  misc_feature (106)..(106): n is a, c, g, or t
  misc_feature (152)..(152): n is a, c, g, or t
  misc_feature (163)..(163): n is a, c, g, or t
  misc_feature (167)..(167): n is a, c, g, or t
  misc_feature (172)..(172): n is a, c, g, or t
  misc_feature (174)..(174): n is a, c, g, or t
  misc_feature (183)..(183): n is a, c, g, or t
  misc_feature (194)..(194): n is a, c, g, or t
  misc_feature (200)..(200): n is a, c, g, or t
  misc_feature (241)..(241): n is a, c, g, or t
  misc_feature (325)..(325): n is a, c, g, or t
  misc_feature (395)..(395): n is a, c, g, or t
  misc_feature (428)..(428): n is a, c, g, or t
  misc_feature (449)..(449): n is a, c, g, or t
  misc_feature (485)..(485): n is a, c, g, or t
  misc_feature (529)..(529): n is a, c, g, or t
  misc_feature (560)..(560): n is a, c, g, or t
  misc_feature (617)..(617): n is a, c, g, or t
  misc_feature (738)..(738): n is a, c, g, or t
  misc_feature (745)..(745): n is a, c, g, or t
  misc_feature (767)..(767): n is a, c, g, or t
  misc_feature (770)..(770): n is a, c, g, or t
  misc_feature (842)..(842): n is a, c, g, or t
  misc_feature (853)..(853): n is a, c, g, or t
  misc_feature (905)..(905): n is a, c, g, or t
ttatattttatttctaacaaaacgccaggcagacggagtaaaaaagaatccacngcacgaaaggnaaacaaagcagancctcagaaactcacctggcaaggatgtncccctccccagattggcccagtttcaccagcaactggtctaagcanagcctaatgcntatncactnanaccccccanccctccacatnctcgtnattaagaacaggaacttctcggctgattgtgtccgtgtgtntaagggaggggcacgctggaacctgggaacctactgggcacctctaaagcagaagagaaaaacttgagaatgtaaaagtagaanagtacccgctcccacccgaagtgaagagacgcgggaaattaaccagcagcacgcgggggatgaagtaacnaaggcaactatcctccccactgcccagggcganttcacgccccaggacctcctnccaggccccacacccacgaaaggagaaaggaagcancacacgcctgctccatgacgcaacgatgaccgcttatacaagtntgttagcggagggggaaggggagttcctggnattctccgaggttggaaacgcaaaaccaactcttgaaaaaccttgaaagggccagcncagcccacagtacaaaatgaagttcgaccctgaggagatctttaaaaacaaacaaacaaacaaaacaaaaaacacaacacccaagcctcccttctcccagttcagaaggagagcgaaaggntcacgtnccagttcactaagacagcaccngtnggcgcaggtctctgcggaaggcgcccgcgccccggctcagactcctcggtgccgtccctgcacactgaaggngatggctcccnggggacagagtcctcttcgggcctcttagcagcccgggcggcggcttctctncacggttttcgcgggc

SEQ ID NO: 530656 - DNA, 864 bp, Homo sapiens
tgaaaatgtacaaaatatctatcactactgataggaggttaatatttctgtgtaaaaatgaaaatgggttggttttagtatttagtgtaaatgtacacatcccagcaaatgttattggcaattatgtggtggatgcttggtgatataaatgtactttttcaatgtatacttacactttaaaaatgcctgtattggtgcttaacaataaatgatatgaaacctccttgtgtcggtcaagtgggatatgtgggtattaaaaggatacataatttcttagcaatgaataactcacgatacatataccacaaatatataagcttccccatgaaatatggagttttaaaacacgggcatgttattcccccccttgcagtatagcggtagatgggaggatcttttcccatttatggtatgggctcttacagcaacaagtaatcctgatatctacatttttttacctatctgttggataaaaaacctgcatgtgtgtccacttgaaacacaaaaaaaacaacaacagacaaacacaaacaaaacgtgggcgcggcgaagcaacaaagatacaccagcgggaggcgccccacgaagacgccctacgacccggaagttagtagacaacaacgggggtgccccacaatagactgaggctgataacaaaacaaggagccgagcgcagcgacgaatacaacacgctagaggtggaaaaaagctgctcagtgagacacgcttggtcgacaagacctacctagcggcggcgcaaagacaagtgggaacaacgaccccccgaaagttatacagcatcgggcacgaaaacaaacacagatctaggtgaaccaacacagacaagctggggagaaaaaacca

SEQ ID NO: 530657 - DNA, 196 bp, Homo sapiens
ctaatggtatcaaagcgggtttcaatgcaaatggacgaacaaaatacatgatgcaaccatacaaagtatggccggcgtcaggcctgccattccctcaaaccatattgtggggcacaggcatgctctttggcgggatcacccgtggcctcttgcaaggctcctggcctgattctataggcataggagtgcatttgag

SEQ ID NO: 530658 - DNA, 262 bp, Homo sapiens
cacaatacatggcattgattacgtccccctgctgggcgcaagatgatcggaaaatgacaataccatttgtgggcctgcatgggtcactgtgtccatgaagccagcccagtcttggaacagaccaacagagggagaatatagaatcgaccagtattgactagcaaatctctcccaagagaatctctctatccttttacagcactcctaggcattcaagccttcgtatatgatgggagtagttcactccaatggctgggggtca

SEQ ID NO: 530659 - DNA, 262 bp, Homo sapiens
gtctggctgcagccgttggcctgggtcccggccgcggggcgtgccgtgcgtgccatgcggcggccgtcggtggtgtggtacgggccggccgcttctccggtcgtcctcggtcccggtcctggggggccccctgtggtgcccgggccgctggcggttgcgtggcgggcaccggaaactcctgaccaattgacgtctggggagacacggccgccggggtacgggggtgctgacgccggtgcacggggactggctggtccccctg

SEQ ID NO: 530660 - DNA, 140 bp, Homo sapiens
gcgggaaaccgctttcacccttaatacggattccctggccggcggtttacagggagaaaccccttttaccccttatacggatttcggggccggccttttaaagggggaaaccccctttaccccccttaccgcttttgctt

SEQ ID NO: 530661 - DNA, 500 bp, Homo sapiens
caaccttgcttcctataccgggaaatgttgcagcctctgccctgggcccagtcatgctggaagtgagcgtgattgtaacctcaggtagtatcagtcaaaagaaggaaaagaaatggtgggaggtctaagagaagctcaggagacagcatctgtcatatcatattccccagaccatttgtacccctgaccctctagggtacatccagtcagagagcacaaatagtcagtgcaaaaggctcagatatccccatctcctgccaaggtgaacagagtattcatgggcataggtagaagtagggccataggaaaactgcacagttgtagcgtgtcatgcatttaacaactctccccttaatgtagatacgctgggtcttttataaccgcatcctaagaatcggtcacctgcttcaacatcctcttacaacgaaattgcgacttgaccttgttcaaatacctcaatgccacttgagagtctaatgtgaacataattgactctatgg

SEQ ID NO: 530662 - DNA, 377 bp, Homo sapiens
tggtctcccttttgtgacttcagtagcctctggttatctctttctgctaaggcatctgactgtgtttgcgtccctgttagcataatgtgaggtgtgtggattagaccatcccacccccgtgttctactgtgacccctgttcccgtgcttacctgtgtttcctccctagtcatctttcctgttccagagaggtggggctggatgtctccatctctgtctcaactttatgtgcactgagctgcaacttcttacttccctactgaaaatcagactctgatatatcatttgttttctccaatatttgctatgataggttgatggattaattcaatgattcaatacctggaatttgagagagcaaataaagacctgagcaag

SEQ ID NO: 530663 - DNA, 800 bp, Homo sapiens
gtgcttctaaaaatctgagctcaaagcaacgaaaaccaaaacaggaaagctagtatccattatgccatattacgatgaatcataaatggtcttctattaaagtatggcattcacgaaatatgatggaggccaggaagctatttgaaggcttagcatataacactattatgcatcctgtataaatacagaggaatggctgtagaaagtactttgaacaaatatctaattctcttactgtctaaggagaactctttctacttggtcgcaataatctgaaagattctagaaggtcaaaatatgtcacaggaaaatgatcatagacctaaaaatagttgttaaaggaaaccagctacacggggcaaccaaccatcttgctgtttgaagaaaacagttccaaaaaggctaaatcattggcataaaggaaacaaaaacccaaagtatgcgttgtaattcttgagccagtattactgacacagggataagcagttatcaaactctaacataggttaatgcacatgtctcttgcttagtgctaccaagtctaaaataatcctttgtcacaatgctttcagaaatgccagttttaattaccatccagatgtatatgagagatactgcttttatggaatgcaatccggaatcaatacttttcatctgaaatcttgagggctctcattaaatggcgagtccttacattcaaaatgaatccgctaccaacaattgacagtttcgtgaaacttcaatgaggaacatagcagtccggaatattaaattcaaaggggggacacaacatccaaaat

SEQ ID NO: 530664 - DNA, 141 bp, Homo sapiens
ggaggggcacagtggacccagagtgaatctaggacccttctagacatagctgctcggggtcctctcctcctagagtgaaatctagcacacctgcccagacagagcccatctgaggtcgatcactctccacaagcccaagag

SEQ ID NO: 530665 - DNA, 198 bp, Homo sapiens
caacgattggtcctcagctatggccctgtgctgagcactgggcacatcgcttgagagcaaaattgccacatcccggtccttaaggagcttccaggtttagtgggaagacagaactctgtcttgtgcatggactttgagctctcttccagcaccgcaagggcgtgtttattaaaagagctggtgctgttggatctcggc

SEQ ID NO: 530666 - DNA, 151 bp, Homo sapiens
tccgggggatcagacattcatttgactatggccctggctgagaagcgaaattaatggtaaatctatgtaacccttgctgtgcagaactaaagaggaagaaggaattaaagatgaactttcttgacttaatatatacaatctatgtaacagt

SEQ ID NO: 530667 - DNA, 763 bp, Homo sapiens
  misc_feature (62)..(62): n is a, c, g, or t
  misc_feature (70)..(70): n is a, c, g, or t
  misc_feature (75)..(75): n is a, c, g, or t
  misc_feature (79)..(79): n is a, c, g, or t
  misc_feature (83)..(83): n is a, c, g, or t
  misc_feature (86)..(86): n is a, c, g, or t
  misc_feature (88)..(88): n is a, c, g, or t
  misc_feature (98)..(98): n is a, c, g, or t
  misc_feature (104)..(104): n is a, c, g, or t
  misc_feature (115)..(115): n is a, c, g, or t
  misc_feature (122)..(122): n is a, c, g, or t
  misc_feature (134)..(134): n is a, c, g, or t
  misc_feature (139)..(139): n is a, c, g, or t
  misc_feature (148)..(149): n is a, c, g, or t
  misc_feature (162)..(162): n is a, c, g, or t
  misc_feature (169)..(170): n is a, c, g, or t
  misc_feature (174)..(174): n is a, c, g, or t
  misc_feature (615)..(615): n is a, c, g, or t
tcctcaatagtaatccagcttaaatggtagagcattaattcgccttacaaacaaattacagncactacgnttaancagnaagnacngnacgggtttgnggtttnctttgggcaancttggancaaatcagagangaaancataactanncatcatcatgtanaaaaagnnaagnaaatgaacctcaagtatctacctatgtgtcaagtgattcatcctgccagtaaaactaaaatctacacttacagcggagttttaaacatccttagtgcaagaaacataaccaattaatacagatcaacactaattacgttgattagtggaaaattttcctatacagaggtagaactccagggcacaggctaaaacagttatctcagtagttctaaacaagactggaggtcgggtttaagtggaactccacttttaaatttcaggtatcagacggtattgtccatacattacaataaatagactatacaatttttcaaaagataggctttaataaagctccacaaaattaatagcagagtgcttggaaattatttacataatccgatttccaaattctctcattcaaatacaaggggtctacacactaaattttctggccttnacggcagcagaacctctttcctggaagtggctggctaacaataagatacttccgtggagaggacctaatttatgtccaacgaggtctccatatccagctaagaaaatacaaccctttttcagctatatagatagggcactaacactgg

SEQ ID NO: 530668 - DNA, 1689 bp, Homo sapiens
  misc_feature (334)..(334): n is a, c, g, or t
  misc_feature (555)..(555): n is a, c, g, or t
  misc_feature (1590)..(1590): n is a, c, g, or t
gcactgctgtatcatggagagtatggtcgatcactttccagcgcaggccgatggacggacgagcaacgatacatgattccgcggcgctcgtgcgacctctgtgacggcggacgggtctgcgtgtctctgaggaatcgacggtactaaggtgagggtattgtgagttcgagtaaatgagccactagcagatcgaagcgacgagttggcgactaccaatcagggcatccaagcgacgcgaagcatcggatagtgtaggagcagatcgagaatctagtacgtgacaagtctcgatggacgaacccgttgagagcggacgctagcttgtggctacccnagcggccggatcgattccgctcgcgctcgctatggacgctcgcgtggatcgactgggacgtgcacgatgttcctctgtcgagtcccttccgagcgcccacggaatgcctatcacgcgccgcgggaacaaatgcttcaggtgttttcagtgggcttgaaaggtgaggtagtctgttcgcagagcgaaaccttgggggaccccaagggagcggcgtgtaacanacgcgaagacgtgctgctgggtaggccctcgggattgtgtaccatttcgtgctcgcttggcgcactggttgtgggtcgaacgcaggataggggaaggaagaccccgaaaggcaaagtggggctccaagtgtagccaatttgaaacggagctaaactggggggttggaacacgaaccatgacacatagagacgtggagttttgggacgtggaggcgttccattttggaactttcggcgaaaccgcatctggaatagaggctaattctggctgaacacctggcccggaggagaagagacttgagacggaaggcctcaacgagttgtggaacttcccacaaattagaaatccggaaggttagctagagcgtggcctgctttgagaccgaaaggggcgcatagagcccaaggaaattggacttccggcgctggtgtccagggcccgcaatcgaagagaaacgcccccaagtaaaacctcaatcccaaagcctttgaggaaggccccctgcaagtgaagagggtaggcattccaaaggttaagcaggcggacggtttccgtgtaccaaccgggggggccaagggcaaaggcttgaggttggggacactaaacagtgctgcgcgcaaaggacggtatggccaccaggaagggcacggttttaaccgacaggcaggccccaggggtccaggaggccccccggctggccaggcccaccccccagactgcgatacctagcccgggggtgctggggccttcggctggtggtttaaccttccggggggctcccagttgggcttgttgcccagtagacccccaagccttgttttccgcttgcacggcctgggcaatccgggccaggaagactgaaccaggtgggtttgccccaagctgaattaatacggggcgtggtccccttcttgcaaggggggacccccggggggggcataggatagaaaacacagcacaaggacgaccgagaaaagataatacaacacacagccacaggggacgactcacacacacgagtgtgaccacagagngagggagcaacttaatagtgagaacgaacatactggtgataaatgcagcaacgagcaatgagacagagcggacaaacataatgcgcgcacacacaagag

SEQ ID NO: 530669 - DNA, 252 bp, Homo sapiens
caagctgagcccagtgattccggtgaaaccaatgtgggaccatcccacccggagcatcagggaggtcctgaaacgctttgaggaggcagctttcacctgcgaatacaaacatgacgggcagagggcacagatccacgccctggaaggcggggaggtgaaaatcttaatcaggaattatgaagacaacactgtgaagcacccggacatcatcagccggatccacaagattaaactaccatcggtcacatactt

SEQ ID NO: 530670 - DNA, 176 bp, Homo sapiens
cagatataaaatatgtgggtaaacgtctcctttcttctacctaggctctaagttcttggtagacaagactatgtcctggttctctccgaatagctcacccatggtagttgcttcatatatacctgctgcatttgaaattcaaggtggaaaacgaagaattatggttcctttttttt

SEQ ID NO: 530671 - DNA, 240 bp, Homo sapiens
agtatccccgtatagccgatgtatgcggaatcggggcgtatgctgttctgaatcataagaacaggcaggttagaacgtagggtcgtgtgtgttacaaaatatgtcgtgtatagttcaggggagattgcgtcatatgttgttcctaggaagatcgtagtggtgactgtgattatcctaatgatgtgtgtgtattcggctatgaagaatagggcgaaggggcctgcggcgtattcgatgttg

SEQ ID NO: 530672 - DNA, 544 bp, Homo sapiens
tggcagcatctacaaccctgaagggctggatatcacagaggaaactctgcattctcgtttcctgaagggtgtccgcattgttgccagggcctgtctgcaaatgggttacccaactgtggcatcagtaccccattctatcataaacgggtccaaacgagtcctggccttgcctgtggagacggattacaccttccaacttgctgaaaaggtcagggccttcttggctgatccatctgcctttggggctgctgcccctgtggctgttgccaccacagttgctcctgctgctgctgcagccccagttaaggttgaagccaaggaaaagccgaaggagccggccaaggatatggaattgggcctctttgactaatcaccaaaaggcacccaacttagccagtttaattggcaaaccagggaaataaaggctaacttttccaaaaaaaaaaaattaaccacaaataaaaaaccatgtctggccgctttgggccaagtcagactttggactcggccaagtttaagcatgcggccgaaatttaggcttaat

SEQ ID NO: 530673 - DNA, 237 bp, Homo sapiens
gtgtactagaggatcgcgtcataatagtgttatgtcattacggagagaggaatgagaggtaggccgagggcgttattgatgtgtagtatgggtggaaggtgatttatcggaatgggaggtgattcctagggggttgttagactcccgtttcgtgcaagaataggaggtggagtgctggcttgggctgcattaatgaagggcaatgatgaagtgaaaggtaagagaatcgtgtgaggg

SEQ ID NO: 530674 - DNA, 132 bp, Homo sapiens
aatccctatgctattacgctgggaattacatcataaaagcctgattattccaggcttctaatcttgtcatataagaactgccttatgttgcgctgcgtttgttcaacgtgatgaggcccacggaaagcggag

SEQ ID NO: 530675 - DNA, 360 bp, Homo sapiens
tttttttttactagtttatgtaatttattgtactatttgtattattattttagactgtactccttctacttattaaaaaaaaaagtaactgtaaaacagcctcaggatagtccttcaggaggtatccagaagaaggcattgttttcataggcgatgacagctccatgcatatttttaatcctgaagacgacattccagttggacaagatatggcggtaaaagacagacatattgatactctagaccctgtgtaggcccaggctaaagtgtgtttgtgtttaacaagaaagtttagaaagtagcaaacatttttaacacaaaaaaatttttaaatagaaaaaagcctatagaataaggaca

SEQ ID NO: 530676 - DNA, 589 bp, Homo sapiens
gctctttccgccatctttccgcgccgccacaatggtgcgcatgaatgtcctggcagatgctctcaagagtatcaaatcaatgccgacataagagaggcaaacgccaggtgcttattaggccgtgctccaaagtcatcgtccggtttctcactgtgatgatgaagcatggttgacatgtggccgaatttgaaatacattgatgacccactagagctgggaagaagtcgttgtgaacctcagcaggcaggctgaaaacgaaggtgtggggtgatcagccccagattagaccgtgcaagtcagaagacctggaaaaatggccatgaatgaatctgcattggattcccgacgcgagattcgggtttacagttgtacatgagcaaacctgcaggcgtggcgagtcatggaccatgaagaagcaagaggaatatacacacaggagggaaaaatcgtgggatactttgtgtagggatgtaatacatatattgacaaataaaatgcctcatggaactctggtgcttccgaaaaagaaataaatctaaataaaaaaaaaaaagagcggcgggatggagatgttaaaaaagttataaaa

SEQ ID NO: 530677 - DNA, 374 bp, Homo sapiens
ccctagggggctttagaccccgtttgtttttttttgcaagagggtgatttccagtttgtcatcaacctctttatcttataatttaggatagagttgaacgttagtcttgaaagattttttaaagtagtctttccaactgttcctcagaggcctaggattttcccaaagtcccttaggacccttgtaggctccagtgggggtgtggcgataaagcaggaggcagggagacaggggtgcagggcctccccccttcccacagacaggctttgctgtatttgttgtacaaactgggattctgtaaaggccattatttggggggttgtatggatttttgggggttctgctttttttaaataaacttgaaaagctactga

SEQ ID NO: 530678 - DNA, 144 bp, Homo sapiens
gggaaccagagtaggaaccagaggggagagacagagcagcaagcagttggatttctccttgacgacgccagcattagcttccttcttcaccaccaccgttagcgttcttctttacttgcagttcagcttctaggtcagaccaga

SEQ ID NO: 530679 - DNA, 838 bp, Homo sapiens
  misc_feature (730)..(730): n is a, c, g, or t
ggggagaggcagcagccggatggacgtgtcctcatgatccggcgccaaagaccaccatcttcacggacgccaaggagtccagcacggggttcgatacctgaagcgcatcgtcgagggcatcctcaagcggccttcctgacggagcagcggttgtacaatggattgaccactttcttgggattgatgggcagagacacgtggggcgaggtgtggtgcttcacccagtcaaacagcactggccacgatggccccatgcccacatgtgggggcgttggcccttttcccggggcgatgtatgccacctttttgaggccccttgttgctatcggacccggttttttccaagccgtgccaaagagcttgcccctgatttgtgatttgaagggcccccagggactctcgggaaaggccaggtggccaattgaaacaaggcgggtgccaggttgagaaccccaaaggaggcccaatttcccccccaaataaagaggatgctttggccagaaaatatacaacagtacaatcaaacaacagaaaacattattgttgtgggggcgggccgtccgccctagagaaagagggtagtacaagcacccagtgctgtttggtggcgggcggcgcccagaatagttattgacaacatgtgacacatgggtgtttcccacaggacaactcgtgtgcacatcgcacgtttgtgcgtgggtcttccaccacaattaaagaaaggcgcggngggccaccggcgtttctgaaccaactccgatgtagcgtctgggccatgcgtgactcacacacagggcgccgggcagcctaataataggaccgcggcggagttgcgagc

SEQ ID NO: 530680 - DNA, 134 bp, Homo sapiens
cgctgggggttttctttaaagggggggacggattccccggaaacacccccccccgcgtgtgtagaaattttccccatatttgagcaggggctcccatttaaaagggcccacctgtatgggccctatttgaaaaa

SEQ ID NO: 530681 - DNA, 393 bp, Homo sapiens
tcttcatatgatggcaggaactttatatgttatagaagttagccccaagaatgaaatcgtgtcctttgccaaaacatggatggagctagaggcctttatcctaagtgagttaacgcaggaacagaaagccaaatagtgcatgttctcactgataagtgggagctaaactatgggttcataaaggcatgcagagtggtactgtggacattggagactcagaatgggggaggctaggagggaggtaagggatgaaaaagtacctgttgggtacaatgtacactacttgggtgacgatgggtccactaaaatcccagatttaaccactgtacaattcatccatgtaaccaaaacccacctgtaccccaatgctatgaaaataaataaaaccaaatt

SEQ ID NO: 530682 - DNA, 102 bp, Homo sapiens
tcgcaacctaattacgcccaagccaggatacaaccctgctgcagtgacaataccagatccttaacccactggcacactcctttcacaaatcttatctacagt

SEQ ID NO: 530683 - DNA, 430 bp, Homo sapiens
attccccccttttttgggtactccttccgaaattaaggggtggggttttttttggtttttaaaattccggccgggggggttgttttaagggggaggttttttccctccgtttttggtttaaattttccggttttccccgttttttttcccggttttttaattccttaaatttttggaaaggaactttttttggaaggcccaggattattacttttggttaaggtttgttgggccctccggccaaaatttttgtctttttttggcctttttccaaattttttccaatttttccttggtttaaatttccaccccttggtttaacttggttgttaacccggggaaaattattttgtttttttaaaatcctggcctttgtgggtttttaattccctttaccttttccctttttggattaaattttttgccttta

SEQ ID NO: 530684 - DNA, 1005 bp, Homo sapiens
tccgctggtttctccgggcgccactggtgttggcttggccctgttatcgtccctgggggtttgtatatttagtgtgtcgctcccacccgcctgcaaagctttttttggcgccttgggtctctgtccctggtgcgctccctctggttgcggcggtcatatttcgatttgttggtttttgaggaataggaaatatgtttatagagcagccccttggggaaacctgattctgaccccgacagtccctctcccatcccggtccccgaggggcccaactttacggggcttggggatatcgacccttggttaagtaggtcccgatggtagaggcacctgcttgaggacttgggagaagcttgtgccctgccccttccgagtggccatctagggccctggagagtattcccccgcctccctgggctcctcctaggctgcccctccgactgcaaaaggcgggtcaagcgccccaggtaccccttactcatgatccggacccctgagactccccttataggcccagaaaggtgcgcttttccgctgaaggtctcctgtccctttctcctggctttttgggcaagggcccggcccaggccgccctcccagggcccctgggacccagcgttgcttctgggattccagcccgctttctcgcaccgccgcatcacccacggccccggaggagctgaagcccctgcctcaccccctgctgcccgggcccagatccctgggcaccgcctcacgggaccccccttttgccccctcttccctgccctcaccccacgaccttgccttcctcctctgtccctttgtccccacgtccacgaccaccgcccttgaggcccaagctgtggccacacacccttcccgctcgttctgctgctgcaagcggctgccctggagacctccgtgggaggcgctggctgagacccactggtttgcctacacccttattaactatttattttttttaagtgtgggtttaaataaggaattaagccttttgatttg

SEQ ID NO: 530685 - DNA, 301 bp, Homo sapiens
gtcaggtattctctaattcctctataaaattatgcctaactacacttcctccttgagaatagaaatggactctctcatagtctggatgggcagcacaaatgaggtctgacgtgtcaggttctcctgagctcatctacatgatggagaccttccttgataggaaagatgagttttacctctggtacactgtcttggtaagcctggatgtgacagacacctcggctctccttgaataagaaagccagcagaactcttaaagccagttgtagtacggagttgtcagcactcactgaacctcact

SEQ ID NO: 530686 - DNA, 201 bp, Homo sapiens
tcatacggccagccatgagacgctggaacgcacaagtagcacgttgacttccacggatacaagtgaaccacgatttgaaaacacttccatgctaacggggtgtgttatgtttcaaactcaggatgtacgctagctgcccatggaccaggaactcggctccatctgctgctgccccagcccagggagcagcagggaaagaca

SEQ ID NO: 530687 - DNA, 571 bp, Homo sapiens
tcaagaggatccccagagatctttgagcatcagccttacccatctggataggggcaggcccttgcatcacctgaagtcatgaccaggcaaacattattagcttgtccttgctgcaggaatccgttctgtgtcatgctaggagaatgggttcagtatatggggccatcaggcatatataccctcttgaagtgtgtttcattgtggtatttgcttagagtaagctaagcaatgtgtatctttgtaatttatcttttaatccaaagaggaacccttggcttctgataacttggtagtgtggtatctgtagtggcctatagctgtcattacttcctgtagctgttgtacatgattggttacagacctggattaaggcttccaaagacagatggaccttggcacgtaaattggaccagccctgtgatcctgcacccgacaggagtaattcttcaggatttaccaggatggctgctataggggcatcatctgctgggtagtgagtttggttgggccaagagtcttgccaagactttaatctatgcctcttgtgctacatgaattctagggaattact

SEQ ID NO: 530688 - DNA, 165 bp, Homo sapiens
gtgtgtatatatatatagagagagagagagagagagagagagagaaacaggcaggcatggtgctgatgcctgtaaccctaacactttgggagtccaaggtgcgaagactttgagcccaggagtttgagaccagtttggacaacatagcaagacctcgttcctaaa

SEQ ID NO: 530689 - DNA, 1153 bp, Homo sapiens
  misc_feature (1138)..(1138): n is a, c, g, or t
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 530690 - DNA, 962 bp, Homo sapiens
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcacaaaaggtaattgcaagttaaggctttatttaaagc

SEQ ID NO: 530691 - DNA, 509 bp, Homo sapiens
tgttattcttatgtataaccaccttttaaaaatattatgaataatgccacaactaactgcttaaaacaccctttttttcattcttaagaattatgttcttccacccagcaattataattagttcaaacgaaaccagtttaacataatagcctgttagccccataagggcaagtagcttattagataggcctttgtatctctgatgcccaacatgttgtagactataaataaatgatgaatgagtggatggaagaatggaggaaggatcgagtcagtcagtgtttgcctgatgaatcacagggtggaagcataggcggaaggatggattggtgaatgaatgaatgaatttcctttggttaagtctcttgaaagaaagactatggatctttgtatggatgttgaataatttcagtaagcttacagcattttacaatgttcagcaatgtatgaccacttaattaagatatggctagtttgtctctgttataaagtacttttgcattacttta

SEQ ID NO: 530692 - DNA, 187 bp, Homo sapiens
ttcgaccgagcagctaatacttttaacttgtttttatactgttcgttttccaaaatttcttgtttcactgtaacgtttggattttgtttttcaaattctttaataatatcattgacaatcatgttgtgttgcttcgagcttcccgctgtccaaagatgcataaacgtaatcgttacttttttgtctt

SEQ ID NO: 530693 - DNA, 391 bp, Homo sapiens
taactgtataatctctctcctgggcctgacagtttcagaatgctaaggcacgcaggagttgaatccagtgtcaagaggattacagagttctcatacattgctggtgggaatgtaaaatggtgccgctgttttggaaagcagtccagcagtttctcaaaatgctagacatagaattacacagtaactctaagatacatcccacttcaaggattgaaagagaattgaaagcatatgtctacacaaaaacgtgtacataaatgcccataggagcattattcataatagccaaaaagtggaaacaacctaaatgcccatcgatggacaaatggataaacaaaatgtggtatatgcatataatggaatattattcagcccaacattcaagccgtca

SEQ ID NO: 530694 - DNA, 1210 bp, Homo sapiens
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgaggcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcaaaaaaaaaaaaaaacagaaagaagaaggagaggaaagagaaagagagaaaagaagaagaaaaaaaagagaaagaaagagagggggggaaagaaagaaagccgcaaggagggggcccagaatagagagaagacacaggagattggaaaaaagagggcgccacaacaggaggacgcataataaaaaggaaacgcaccgcagccaggcacaaagaagacacagaaagggaggaaagcgagaagagacgactacgacgagccccacacatagctggggagaacacgctggagaacacaacccaagaagagaaggccagcggacagaaacgaaaggagcgcatggagaaacaagcgaatacagagggagagaaagcacgaacacaagacaatcccg

SEQ ID NO: 530695 - DNA, 1169 bp, Homo sapiens
gcccgtctctactaaaaatacaaaaattagcttgggctgtggtggtgggcgcctgtagtcccagctacttgggaggctgagtgcaggagaatcgcctgaacccaggaagcagatgttgtacctgagctgagatcatgccattaccactccatgcctgggacgacagaagcgagacgccatcaactaaataaatacactacaacgctaccaagtaaaacaaccctattacaattgacggctacgagctggagatgtaattcggttctgttgacgaaacattagtaataaagcttgccctctgacggctgtggaccgacaggccagtatttgtactgacttcgcacagttaagaactagatatgctcacgcaacggtgtgtctggtggaccgtcattagcgtactagagtgatcagtcatgtaccacataggttagaccgaacttagactccacatgccttacagaggtacaagacatgtactgtacctgtatccaaaagaagaccaaggcattcgtttaattggcgttaaagcgcagagtaatcgcaatgtgcagcgagttgaccacgctcactgggccttacgacgagctggcatcacctgagctccgctgaaagaccagactatgcagggcccgtgatcaaggagtagagtaggtgacttggtagcataccacgggcaataatcgagggttacgagtcggaaacccaggaggcgcacagggtcgcggcacggcaccgttggggcgcatcacaagcaagtaagcaacagcccgacgaaactgatggagcacacggggacaaaccaacaggatcaatcgcaagcggcagggaaaagcagaacggcacgtcaccacccaaagcggaaatagggagaggaaccctaaagcaggcacccacactggaacgtcagccaaggcgaagcgagcacacaaaagggagggagggacacacgggaagggacaagggtagacaggaagagagagagttagccccaagaaaagaggagacggcgccacaggaacaaacaaaacagcccagagccaacgccgctagatgggcgctgcaaacggaacacacacagagacacttggaacaatcggaacagaacgcacccacggagggcaaggcaacaggccaacgacagggccaagcggacggggagccgaaag

SEQ ID NO: 530696 - DNA, 734 bp, Homo sapiens
  misc_feature (64)..(64): n is a, c, g, or t
ggctcctcgcgctgtttccgcctctgccttcggacgccggatttgacgtgctctcgcgagattngggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 530697 - DNA, 1005 bp, Homo sapiens
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggctgctgagaggggtcacggggacagcaaacagcccagccctgcaaggcccatccggggcaccgcaataggctacggctcagctcatgtgcactgctgccttgcaacagtgacctgcgggacctgctatccagctgagccgccaccctatctccagctgcctttaaagggtaagtggagaaagagttgaagggaaagtgttgggatttggacatggagttcctgaccctggagcctggcctagtgactggaggaggggcccccaagaggctgtggcccgggagaagctgaaattggaccgaaggacgcaagcagaagaaaactagacccgatttacccacgttaccaagactttaaattctggacttacacctggaatgatctagagaaaaaaatcggagctacaacaaaaaggaaaacagcgacctgagcaaccaagtagttcaccaaacacaggcaacgatgcagcaacatgagaaaaagggcaggcagaaccacaccggcgagaagcaggacgcaagagaggacgggggcggatgtccatgaggaggagcacaaggagagaacaggaagcaacagacggacagacaaggccaagacgagaagggaaccaagacgaccaagacacgcagccacagccccgcaacggacggaacagatacagaaggacaacacaagccagaggcaacgaacgcggacagacggcaacaaaagcgcggaccactgcagggcaggctcaaggaaccgcacaacgagacacacagaaaaagaagcggaagcggaccagaaggcaga

SEQ ID NO: 530698 - DNA, 1174 bp, Homo sapiens
  misc_feature (64)..(64): n is a, c, g, or t
ggctcctcgcgctgtttccgcctctgccttcggacgccggatttgacgtgctctcgcgagattngggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtagacaaacatatagccaaagaaacaatagaaccttgggtggtgggcgagcggtgatatgacccctggagggggtgcgccctgaaaaccactgcccactgattgttcttggaaggaatagggggccccgtttgaaaggagtcttgaatccgaacccaatggtatgcggagcccgctcgccatcaaaggggcccggggggcaagcctggcatgctgaacaccccgggagagagcgacccacactcggcgggcgggaaggctcgaacggcggcgcgctgacctgcaatcaggagtaatgcggcctcagggagatactacacctcaagaggggaccgtgcgccaccaatgggaaatatcgccgcaaaaagttgtcagggcactggtaaagcagaacgaggggcaaaaggccaaagaaaaggcgtcggaagtcacagaggactccg

SEQ ID NO: 530699 - DNA, 1317 bp, Homo sapiens
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcaaaaaaaaaaaaaaacagaaagaagaaggagaggaaagagaaagagagaaaagaagaagaaaaaaaagagaaagaaagagagggggggaaagaaagaaagccgcaaggagggggcccagaatagagagaagacacaggagattggaaaaaagagggcgccacaacaggaggacgcataataaaaaggaaacgcaccgcagccaggcacaaagaagacacagaaagggaggaaagcgagaagagacgactacgacgagccccacacatagctggggagaacacgctggagaacacaacccaagaagagaaggccagcggacagaaacgaaaggagcgcatggagaaacaagcgaatacagagggagagaaagcacgaacacaagacaatcccg

SEQ ID NO: 530700 - DNA, 209 bp, Homo sapiens
taactgtcgacaggtaggttacgaactacctgacctcaagtgcatctgccgctacggctcccaaagtgctgggataacaggtgtgagccaccgaacccagacagcataccctctatatagatgagcaagccacaggtcagacagtaccgtggctgtcccaagttcacacacacaactagtaagacatggcacaggaaattcaaacccag

SEQ ID NO: 530701 - DNA, 222 bp, Homo sapiens
ctcaaaaggaggcaaatttggctgcccaaaaaaaagctgccaaaaagtgaccccttgcccccccaaactcccagatttcaaaggaggtagttgcaaaaactgtgcccaaggggaggaagggggtcccccccaaaataatgatggttttcatgcctttgaaaaaaaaatttttggacatctagcggtatcgaggcaccaggcctgaataaacaccctttttta

SEQ ID NO: 530702 - DNA, 540 bp, Homo sapiens
  misc_feature (20)..(20): n is a, c, g, or t
  misc_feature (39)..(39): n is a, c, g, or t
cactaggggaccaaggctgngctccacgcggcgccgctntagactatggatccccggctgcaggaattccgccgcgtcgtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 530703 - DNA, 1322 bp, Homo sapiens
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtaagtggagaaagagttgaagggaaagtgttgggatttggacatggagttcctgaccctggagcctggcctagtgactggaggaggggcccccaagaggctgtggcccgggagaagctgaaattggaccgaaggacgcaagcagaagaaaactagacccgatttacccacgttaccaagactttaaattctggacttacacctggaatgatctagagaaaaaaatcggagctacaacaaaaaggaaaacagcgacctgagcaaccaagtagttcaccaaacacaggcaacgatgcagcaacatgagaaaaagggcaggcagaaccacaccggcgagaagcaggacgcaagagaggacgggggcggatgtccatgaggaggagcacaaggagagaacaggaagcaacagacggacagacaaggccaagacgagaagggaaccaagacgaccaagacacgcagccacagccccgcaacggacggaacagatacagaaggacaacacaagccagaggcaacgaacgcggacagacggcaacaaaagcgcggaccactgcagggcaggctcaaggaaccgcacaacgagacacacagaaaaagaagcggaagcggaccagaaggcaga

SEQ ID NO: 530704 - DNA, 714 bp, Homo sapiens
ggcccggggtgctcggacgcgcgctcagggtcggtcctgctgttcgttgcttcttaggctcttctggagctggagatgaactcggacctcaaggctcagctcagggagctgaatattacggcagctaaggaaattgaagttggtaagctggcgctccctcggctgggagggaggttgcggcgcgtctccccgcgcagtgcctgagagggttggacctgggttacggttgatgatgacttgccgcctggccgcctaacctgaactcaggttcggccgtgttgtttgggagtgataccgcccaggtgcggggagtggggttgcaggtaccctgcggcttaagctgtccacatgcgggcggtggagaaacgtggagtagggagggcctgggcccatttcggaccttatttgcccttacttagttatagatacggcaaagagctgtggggagctcaggatgagattctctctacccttagcccggagttgccgcaagtgggggtgcagaagtggtagtgattggcctcctggcctgaacagtctcccttcctggaataaggaaatgtgaaggttggagagagatgagaacatttccgaaggatgcatttatgattaacacaaaactagtattagtttgtagtgcagctacggtgttagtgataaggtcttcttatcctctaattgaccacacgttactgtctgaagcagtaacactat

SEQ ID NO: 530705 - DNA, 1126 bp, Homo sapiens
  misc_feature (1111)..(1111): n is a, c, g, or t
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcatatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 530706 - DNA, 1166 bp, Homo sapiens
  misc_feature (237)..(237): n is a, c, g, or t
agcgggtcacgtgaggggcgcgcgcgtccccgggagtggcgggtctccgaggccagagagaaaagattgcgaggcggaccgaaagaatgtggcctggtaccagcacgattagaatgaatccatccatgtcggaatgcgtaacatgacctgttaaagcatggacatgtactgctgtgtgacagaataaggtgctttattgatcttagctagtgcaggcgagtcgtgctggcgtactcntcgtcacactcataacactggcgagtacttcatgtagttcataggtcgatgtccctcctcttggtgctctatagtagagttggtgagcccggtgattgacagacatctcacgttgacttacaaagagcaaccttattctctgtccattgtcatcaccactggacgtcttctgctacacctcttgactatagcacggaatggtcttggcctgctggatgaaaggtgactccattacaaataaggcactggctccctctgaaacaaaggctagcgtagaatgactgataacgaagatctcttgttgcctaaagtgacttggcgtccaatctcatttataatacattgattcccatcggatatagttggcccactctcccgttacttgggcaagagaccattagatggttgtcaatccacaagctccgagggggcatgacacccacgataaagcgagaccggtcttgtacatggcgttattcttatctgatgttaaacagggggaagcggcctattcggacccttgggaccactgccgggttgttgcctccggtttgtgtcgcacctatgcattacattccctcagtatgggaattttccctaaggaattaaacgaccaagaccgtcgatttggatcgcgccacagaaaaggaatcggccaaagtggcaagtgcaagaatagaaagggaggattggtggacagtattgtcgttgggtatttcactggaaaggcgaagaagaatgggagtgagtggcaaggtggcagattgacgcggcactaagtggggatgaagggtgtgaaaaactggctggttgtgcactgcggtcaccaattgacactacttgcaaattgttaagtcggccgggttatacgggggtgtccgggagatccttggagagtagattggtgccaatatggagggggaacagga

SEQ ID NO: 530707 - DNA, 675 bp, Homo sapiens
  misc_feature (64)..(64): n is a, c, g, or t
ggctcctcgcgctgtttccgcctctgccttcggacgccggatttgacgtgctctcgcgagattngggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaagtctgcctaagtcatctcgatgagcacgatgtcatgcttgaggacttggacatccaggctaaagtgcctgcaggagacaccgcgtcagactagatggcacacgtatcatacaggtgcattacgacagagcgcagcagaacactgtggcacacacggttgcaactctctctgagtgctatgagacgctcacggtcaacgatgcaaagtttgaattcgcagactttcaactgctgacatgcacgactcactgggtatattctcagtc

SEQ ID NO: 530708 - DNA, 975 bp, Homo sapiens
  misc_feature (960)..(960): n is a, c, g, or t
gagtgtaatggcatgatctactcactgcaacctccgcctcccgggttcaagcgatactcctgtctcagcctcctgagtagctgggatcacaggcacgtgccaccacacttggctaatttttgtatttttagtagagatggggtttcaccatgtcaggctggtcttgaactcttgaccttgtgatccgcctgccttggcctcccaaagtgctgagattacaggcgtgagccactgcgcccagagaggcctcttttttagaaggaagaaccactgaaagtggaacaagagagagcagagcccagtgggggggtatgccctttgattccagcctttctctccacaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 530709 - DNA, 464 bp, Homo sapiens
acagactgaaaaacagcagagtcgaactgcagcaggagactgcagattcctttccattccctaaatagagactctcatgaaaaaagcaaagaagtgagcccctcatggcataatttaacggcaagggtccccaaacccctggccgaggaccagtactggtcagtggcctgttaggaagtgggccgcacagcagaaggtgaatggcggcaagcaagcattaccacctgagctccgcctcctgtcaaatccgtggtggcattatattctcatgggagcaggaaccctattgtgaactgcacatgtggtggtctggttgcatgctacttatgagaatctaatgcctgatgatctgaggtggaacagttttatcttgaaaccatccccatccatccatggaaaaattgtcttcaatgaaactggtccgtggtgccaaaaaatttggggagcactgatttaagcgatac

SEQ ID NO: 530710 - DNA, 650 bp, Homo sapiens
  misc_feature (35)..(35): n is a, c, g, or t
attcgcggccgcgtcgaccgtatctgggagatttngtccactggcgtattagtagaggctgtggattctgaatgatttattcaagaatcaggaagtaactccatagaagggtttgctcagtcaattgttcgtctaagttgtttagccttctcgaactttgaacttaccctgccattcttcttgcttttaaagcagtatggcagttacagctttttgtcaatttaaagtcttttttcattttgttacatgataatttttaccttacagaggagaattctgcctaagccaactcgaaaaagccgtacaaaaaataagcaaaagcgtcccaggaggtgagtattttagtagtttcagaaatgtgtgtacccctcttattaacaactcttaatttgtttaagttgtagtttatgaaaacagatgttcaagtgggaatttttgagtagcagcatttggtttcctgtatagttgcacatgatacgttttagaattctagatgtaaaacatacatgtattcatgtagccattgtttgcctactaggtcagtgctgtcacaagatgagatgatttcctccgattatttgtgcacaggataggaatgataagaaggaaatcattactttaattctgtgatatagcatgctagccacgac

SEQ ID NO: 530711 - DNA, 1004 bp, Homo sapiens
  misc_feature (989)..(989): n is a, c, g, or t
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 530712 - DNA, 181 bp, Homo sapiens
  misc_feature (51)..(51): n is a, c, g, or t
  misc_feature (54)..(54): n is a, c, g, or t
  misc_feature (124)..(124): n is a, c, g, or t
  misc_feature (131)..(131): n is a, c, g, or t
tcttatacaaccagatattccatgaacgaatagggtaagaactcactcatnatnacaaggagggcaccaacccattcataagagatctgctgccatgacccaaacactatccactacaccccanctctcanattgaggatcacacttcaacatgagatttggaggggacaaacatccaaac

SEQ ID NO: 530713 - DNA, 1211 bp, Homo sapiens
  misc_feature (64)..(64): n is a, c, g, or t
  misc_feature (746)..(746): n is a, c, g, or t
ggctcctcgcgctgtttccgcctctgccttcggacgccggatttgacgtgctctcgcgagattngggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctatccaacgctgatggggtcggatgataatttttattctccacatttacaactagcaacagagatgaataatggagaagatttctttattaaccactcctcacatntaacatttgttttcaaagcgaaaattcttctacacacactacgtgaacccctatccatacctgttgatcactacctggctctcgtaattaccttcgctcctccacaccccccaccccccttgaacaccactccttgcgtcccctcgaacgctattatatactatcaactagaccgctcaccgcggccgaaatagcaaatcgtcctcccaccgctgcgtccctctccgtgtctcatcctttattctcacccctcttccttctcccctccctcctgccctgctcataatctaccccgcacactccacccgtttcatcagtacccgcacttcccgccaccagcttagcgtctctcaagcttgcgagaccacgaacctatctcaattacccctatactttttccgccatccacgtacttcacacagtgtatcacgcccgagatcccgtgtcgcccacacacacacaaag

SEQ ID NO: 530714 - DNA, 1076 bp, Homo sapiens
  misc_feature (1061)..(1061): n is a, c, g, or t
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagccctgaaggccatccgggaccgaaaggcacggctagcatgtgacctgcacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 530715 - DNA, 722 bp, Homo sapiens
  misc_feature (48)..(48): n is a, c, g, or t
ggtggagcttgcagtgagccgagatcccgccactgaacttcagcctgngcgacagagcgagactccatctcaaaaaaagaagaaacctgttacagttcggatgggggattggtgcaaactgaagtctatggggaatgaagtgccaggattgatctggaattccactggcgtattagtagaggctgtggattctgaatgatttattcaagaatcaggaagtaactccatagaagggtttgctcagtcaattgttcgtctaagttgtttagccttctcgaactttgaacttaccctgccattcttcttgcttttaaagcagtatggcagttacagctttttgtcaatttaaagtcttttttcattttgttacatgataatttttaccttacagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 530716 - DNA, 598 bp, Homo sapiens
  misc_feature (35)..(35): n is a, c, g, or t
attcgcggccgcgtcgaccgtatctgggagatttngtccactggcgtattagtagaggctgtggattctgaatgatttattcaagaatcaggaagtaactccatagaagggtttgctcagtcaattgttcgtctaagttgtttagccttctcgaactttgaacttaccctgccattcttcttgcttttaaagcagtatggcagttacagctttttgtcaatttaaagtcttttttcattttgttacatgataatttttaccttacagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 530717 - DNA, 1192 bp, Homo sapiens
  misc_feature (2)..(2): n is a, c, g, or t
  misc_feature (84)..(84): n is a, c, g, or t
  misc_feature (88)..(88): n is a, c, g, or t
  misc_feature (101)..(101): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (120)..(120): n is a, c, g, or t
  misc_feature (157)..(157): n is a, c, g, or t
  misc_feature (198)..(198): n is a, c, g, or t
  misc_feature (212)..(212): n is a, c, g, or t
  misc_feature (219)..(219): n is a, c, g, or t
  misc_feature (229)..(229): n is a, c, g, or t
  misc_feature (242)..(242): n is a, c, g, or t
  misc_feature (248)..(248): n is a, c, g, or t
  misc_feature (327)..(327): n is a, c, g, or t
  misc_feature (351)..(351): n is a, c, g, or t
  misc_feature (356)..(357): n is a, c, g, or t
  misc_feature (361)..(361): n is a, c, g, or t
  misc_feature (370)..(370): n is a, c, g, or t
  misc_feature (374)..(374): n is a, c, g, or t
  misc_feature (381)..(381): n is a, c, g, or t
  misc_feature (385)..(385): n is a, c, g, or t
  misc_feature (389)..(389): n is a, c, g, or t
  misc_feature (391)..(391): n is a, c, g, or t
  misc_feature (396)..(396): n is a, c, g, or t
  misc_feature (400)..(400): n is a, c, g, or t
  misc_feature (420)..(420): n is a, c, g, or t
  misc_feature (427)..(427): n is a, c, g, or t
  misc_feature (429)..(429): n is a, c, g, or t
  misc_feature (433)..(433): n is a, c, g, or t
  misc_feature (438)..(438): n is a, c, g, or t
  misc_feature (441)..(441): n is a, c, g, or t
  misc_feature (449)..(449): n is a, c, g, or t
  misc_feature (452)..(452): n is a, c, g, or t
  misc_feature (468)..(468): n is a, c, g, or t
  misc_feature (471)..(471): n is a, c, g, or t
  misc_feature (474)..(474): n is a, c, g, or t
  misc_feature (484)..(484): n is a, c, g, or t
  misc_feature (498)..(498): n is a, c, g, or t
  misc_feature (520)..(520): n is a, c, g, or t
  misc_feature (526)..(526): n is a, c, g, or t
  misc_feature (546)..(546): n is a, c, g, or t
  misc_feature (552)..(552): n is a, c, g, or t
  misc_feature (559)..(559): n is a, c, g, or t
  misc_feature (565)..(565): n is a, c, g, or t
  misc_feature (583)..(583): n is a, c, g, or t
  misc_feature (585)..(585): n is a, c, g, or t
  misc_feature (602)..(602): n is a, c, g, or t
  misc_feature (608)..(608): n is a, c, g, or t
  misc_feature (611)..(612): n is a, c, g, or t
  misc_feature (617)..(619): n is a, c, g, or t
  misc_feature (627)..(627): n is a, c, g, or t
  misc_feature (641)..(641): n is a, c, g, or t
  misc_feature (654)..(654): n is a, c, g, or t
  misc_feature (677)..(677): n is a, c, g, or t
anaactagctaaaattatcatgctaggatattgaaacacagaaattttacatacatttatgaagggtcaatttagtttggacantgangtatttgtcttantggaaaaaangananttantctgatcaaatcgtgaagtaatacagtgaacttgcangtgcacaaaataagagggccacatctatatggtgcagtctngaattctgtttaantttgtangtacctcttngacttctgaattnatccanttgtcatccaccacagacatctcacatcagatacagttccaagattgacaacagagaacaacctgctggaaagacctgngcagaaatggagacgctgcggganccatnntacnttttcatcnaaanagaaatncacntctntnagctnaaanttctttgtgtttaattgtanaatgtantnaatnggttntgnaaaattcntgnttttatttctttgtgnaancangtttaagaantaggggatatatantcataactatttagggtgggangggctntttaagtaattttaagtggntggggntatttanaatgtnagaataatattatgtatnanatatcgctataagtggncaagcntanntactnnnaacccttnaccctataattgcnatccttaaagatntcaaataaactcggagggaactncaagggagaccactttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaaaaaaaaaaaaaaaaaaaaaaaaaaaaaggggggggggtttttagggggggaaaaaaaattgttttgaaaaaaaggggggccggggaaaacccttaagaaacccccttgggggaaaaggaatttttggtcccccccccaatttccttttgtggaagt

SEQ ID NO: 530718 - DNA, 301 bp, Homo sapiens
  misc_feature (64)..(64): n is a, c, g, or t
ggctcctcgcgctgtttccgcctctgccttcggacgccggatttgacgtgctctcgcgagattngggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggaggtgatcttctgaaggtgatcttctgc

SEQ ID NO: 530719 - DNA, 126 bp, Homo sapiens
gaggtgacttagaggatccgatagagctctagaacttgtgtgtgagagtgtgtgtagatgccatgtgtgagaaccaagacacgggtatgtgatactctgtgctatattctgagctctgtgtgagca

SEQ ID NO: 530720 - DNA, 831 bp, Homo sapiens
  misc_feature (72)..(72): n is a, c, g, or t
  misc_feature (88)..(88): n is a, c, g, or t
  misc_feature (129)..(129): n is a, c, g, or t
  misc_feature (173)..(173): n is a, c, g, or t
  misc_feature (235)..(235): n is a, c, g, or t
  misc_feature (237)..(237): n is a, c, g, or t
  misc_feature (275)..(275): n is a, c, g, or t
  misc_feature (309)..(309): n is a, c, g, or t
  misc_feature (362)..(362): n is a, c, g, or t
  misc_feature (372)..(372): n is a, c, g, or t
  misc_feature (384)..(385): n is a, c, g, or t
  misc_feature (431)..(431): n is a, c, g, or t
  misc_feature (533)..(533): n is a, c, g, or t
  misc_feature (639)..(639): n is a, c, g, or t
  misc_feature (669)..(669): n is a, c, g, or t
  misc_feature (675)..(675): n is a, c, g, or t
  misc_feature (690)..(690): n is a, c, g, or t
  misc_feature (701)..(701): n is a, c, g, or t
  misc_feature (707)..(707): n is a, c, g, or t
  misc_feature (746)..(746): n is a, c, g, or t
  misc_feature (753)..(753): n is a, c, g, or t
  misc_feature (757)..(757): n is a, c, g, or t
  misc_feature (759)..(759): n is a, c, g, or t
  misc_feature (801)..(801): n is a, c, g, or t
tgccaggctgcgggcggctgcagacctgggagcggagaccggcccgccgcccccgacgccgccgagcacgtnagcggcgcgcaccggnggctcggagaccgacgggcagaacgacgggcggcgactgcngcgaccgcgggacggcgagaggcacgcggcgggaggggaccggnaatccgcagctccggccgcgccatggacggcaacgacaacgtgacccttctcttcgcccctntnctgcgggacaactacaccctggcgcccaatgccatctncctgggccccggcacgacctcgccctcgcccctncctccagcgccggccccggccctgggctcagcctcgggccgggtccgagcttnggcttcagcnccggccccactnnaccccggagcccacgaccagcggcctcgcgggcggcgcggcgagcnacggcccttccccgttccctcggccctgggcgccccaagcgctcccgttctgggacacgccgctgaaccacgggctgaacgtgttcgtgggcgccgcctgtncatcaccatgctgggcctgggctgcacggtggacgtgaactacttcggggcgcacgttcgttggcccgtgggcgcgctgctggcagccttctgccagttcggcctnctgccgctgctggcctttctgctgggcctngccttnaagctggacgaggtngccgccgtggnggtgcntcctgtttggctcctgtcccggcggcaatttctccaatnttatgtncctncnggttgacggcgacatgaacctcagcatcatcatgaccaactnctccacgcttctggccctcgtcttgatgcc

SEQ ID NO: 530721 - DNA, 273 bp, Homo sapiens
aggctgatctagaggtccctcacgccatgtccacaatggagaaaagcaacacgacaaagacatgaaccaactgtggggagataacatgactctattcttaaaaaaaaaaattatccttgggaaaccaagaaactcaaattgggggggggggtgaaaggttccatgagagatgccgcagtaggttggaggggagaaactcagtacatggcagggtctttcaaagtaaagcatggtgggatgaccgagggtgggttagctggggatgggtgctgg

SEQ ID NO: 530722 - DNA, 781 bp, Homo sapiens
aaaaaaaaaaaaaacaaattgtgctcggcgcgcgcgcctctgggccctcggaaaaacgtttctcttaaacacacaatccggttgggcgcgcgcgcggggcgcccagagtgagaggaaagagggaacaagtgtggccaataaggtggtttccctagagagagaacacccggggcctcagagagacacaagaggggcgtgggaattctcccacacacaaaatcaacaaacagcccccgggggggcaacacgggagagagtgtgttcgtgtgaaacaaattctccagagagagtggagagttctctgagagagagtgtctatatatagagagggactctctctatatcacacagaggaggagagtctcccaagagcgagagagcctctcggagtatatctacaaattatatacacgcgcgcccccgcgggggcgccggcgggggagacgccacacacaccaacccgacgcgacgaccaacaaaacacgagagatcaagcggacaacctcacacctactatacaaacaacggcaacattattctcttgtggccgccgaggaccacccgaggtgacgacggagacaccacaccacaccaaacgaccaacaaaagggaaaggtgggactccaataggcatgcgctgcaccaccgaaccagcagtagtatcagcctgactcggccgcaaaagcggaggctggacgaaccacaacccaccgagaagaaaacactctgatgagggctgcagcacctcgactcatgagggaacaatcactaaaataatcat

SEQ ID NO: 530723 - DNA, 411 bp, Homo sapiens
  misc_feature (303)..(303): n is a, c, g, or t
  misc_feature (321)..(321): n is a, c, g, or t
  misc_feature (332)..(332): n is a, c, g, or t
  misc_feature (407)..(407): n is a, c, g, or t
ggccactgtgcctggcctaaattatcctttttaattatgtatcttaaattctttatagtcacaaattcatatctgaaaaagaaatttaaaatgaagtgaatgaagatgatagtcaaactaatgttttaaaaatctacatcattttctctgtatttacacggataaataagagacattaaattaattaaaaagtcaaacttcagttctttgttacttcttaatttattacttgatcaaatacttgatatctgcagataaaataatgggtatcgagacaggcaagaattttactaagctttaagnttaatttaataatttaancacaaaataanatggcttaaactcaactctaggacttcttttattctctaaaaatgtatgggaacatatcattagagttatttganttaa

SEQ ID NO: 530724 - DNA, 1168 bp, Homo sapiens
gtttgccgccagaacacaggtgtcgtgacaaactacccctaaaagccaaatatgggacaatggaagaagactcatatcaacattgtcgtcattggacacgctagattcgggcaagtccaccacatactggaccactctgatctataaatgcggtggcatcgacgaacaagaaccattgaaaaatattgagaaggaggctgctgagtatgcggcaacacgggctcccttcaccgctactgcctggcgctctctgcgactaacactgcaacagctgcagccgtctgcacacccgctgcgcctcatcagcccattctgcattatcttccctttgcatgacgaacactccagcacgcacccacgccaaagctaccctactgcttgcacctactccacattgcactgggccccccaagttggaaccacccaggccagcaaccatctataactccaaaacacaaaacacttgcacctctaaccaatgggccacaaacatccatcaacggccctgcacacctgcctgccattaggactaccccactgccacctctggactctgggcccttaggccctagagcctgtcctaccgcgcatccgcatacctactcaggcaaacacgcccatttgctggctaacctcctttcccacacaccccacaccgctggcgcgtacacaccaaaatcaccccagccaccccaaccttcctcactttgacccccccactaattcccccttgccgcccaataatcacacccaaccccaaaccactatggtgccacaattagtcattccgccaacacaacaaccaaacacacccctcataaaccttactcggtcatacccaacaagccgagcctttatatacacgccacaaacaatacacaaccttgtccgcaccccttataacacccacacccctatttcccacgcacccccccaaaaccacccccaccttatacccccacactcccccccacaaccctacacattactaacactcacctttaaacattaccccaacgccgcccaaccaaccacctactctcaggcccataacaccaaccacgctgaccacaaaatgactttcctaaacactctcacaactcctctacattaaaccccataaattactctaaccacccgtccactctctaccatcttttctggccta

SEQ ID NO: 530725 - DNA, 411 bp, Homo sapiens
atcagcggtcccatgctgtcttcagatggtaaaagaacaaactctcacacgaattcacagaggagagctcatttactgtctcattaccttggggactgcactccagcctgggcgacagagtgagactccttctcaaaattaaaaaaaaaaaaagaaaaaaaattcagttcgtggtgtaattctgaaacaaaatggaaaacagcccctttccctaagagctaaggtccagtctgccttcacaggactcacaaattagctacaaaattagaaattacagtttagggctcctgcaggagtatgtcactgttgtaaaactaagatcgacgcttgagatgttttgcagagcctgcatctggcggatcggctgacaccacctagactggccatctggcaaaaccagctctgccatcc

SEQ ID NO: 530726 - DNA, 918 bp, Homo sapiens
  misc_feature (222)..(222): n is a, c, g, or t
  misc_feature (239)..(239): n is a, c, g, or t
  misc_feature (245)..(245): n is a, c, g, or t
  misc_feature (690)..(690): n is a, c, g, or t
gaaccaacaaatttacaaaacagaatagcaactaaaagacaaaattaaacaactagaaagtccctccaagtacgggctaaaacgctcaaacctaaggataacagaacagatatacaatagctatacaaataaatatgcacatatatacacatttcttttagacaccaaatttcaaataagccttattagatacaacgcagcacactctgacacaaacgtccnatataaagggtagctgnttgcangcggacaaagcaaagccccccccccaagagcccggtaggctcctaaatttctgcttctatacaatctattacctaaacttattgcttgcactttatactgttcaccaaaattagaaaacacaatgggaatgcatcggattccaaaactttttaacctatggcagcctattaagaaactaaaggaggctggacgcagtggctcacgcctgtaatcccaacactttggaaggctgaggcaggctgatcatgaggtcaggagatcgagaccatcctggctagcacagtgaaaccctgtctctactaaaaatgcgaaagttagccgggcgtggtggtgggcgctgttagtcccggctacttgggaagcttgaggcaggagaatggctgcagcttggggagggcagagttggcagtgagtccgagatcgcgccatggctccagccctggncaacagaatgagatcccgttccaaaaaaaaaaaaaggaattaggcgggaattttttacctttccggtaaatggactctgaaatgtgaaccccggcgttttcaaatccttgcgggtaaaaacggtctggatcccgaattttgaaggggtcaaatctgggcgcgaacgactatctaaaacagcgctcgagacacggcgggatatacgtaagagaaaaagcgggcgaggca

SEQ ID NO: 530727 - DNA, 1033 bp, Homo sapiens
tctctggtgccgctgaagccggaaagatggttgagctcatgttcccgctgttgctcctcctttctgcccttcctatcttgtatatggtctgcgcccaaaatccaggaaaatgctgtccagtggggtgtgtacattcaatgtgtacagcttcctgggacaagctagtggtggtcacaggagctactacagggtatcggggaaggaagcacagccaaaagaagctgtgcatcagacagcgggacgcccagaggatcatataatagcttgagccgggacattgctgcacccacgggggccaattgggggggcccaactgaggatccaaagaccaagggaccacgggaacccagcaacggtgttgtggcggcgcaacaactggcaccatgttctggattaacaaaaggcataactcacgagagcttttgcgccaaggggcctccttcagctgaaggaacaagcaccctcacaggtttggatcaccactggaaggacgttgatgcatggcggtccggaactcgaacacaagacaatgggttggagcatgcaccatcgggagtccaccattggcggtccacttcttcttaaaccatttggtgtaagacgaaataaaaggaattaggccaaaaagggtatgaaattgtgttccctccgcattcaccttgggaggcatccccttcataacctggagggagagcaattaacaacggagcacgcatcgtgaaagcagttggacaaactttttaccaggatggggcctgcggaacaaggtcgctggcacaaattttgagccacgcgagacacggtacccttcgggaggggagagaaaattaccagagacaactagctagctcatcgttttttcttctttctgcttcttccttcctccttcctccccgtctctcgtctatcttacacacaccacccggggtaacgagagtagaacagaccacgaaatgaagagcaacaaaacctagagataaaggaacacgaggaaagatacaaaacaaacagcaaatagcaatacacagaccaa

SEQ ID NO: 530728 - DNA, 132 bp, Homo sapiens
taccagctattgtcgctgtttcatagggaacagtcaagcttagccacatgcagtgtcgcagcccaggaagaggaaggagacgtagcaagcagtgtacaccaggttgacgagcattgccatccggattgcccc

SEQ ID NO: 530729 - DNA, 654 bp, Homo sapiens
  misc_feature (498)..(498): n is a, c, g, or t
  misc_feature (654)..(654): n is a, c, g, or t
accctgcgtggcaatccctgacggcaccggcgtgatgtcccagagaagacagggacgagctgggagtccaactacttccttaagatcatccatgtgatggatgattatccgaaatgtttcattgtgggagcatgacaattgtgggctcctaaggacacgatgcatgtcagtatccgcatgtcccttcgcgagttgaaggctgttgtgtgctgatagggcaagaacaccatgatgcgcaaggccatccgagggcacctggaaaacaacccagctctggagaaactgctgcctcatatccggggcgcaatgtgggctatcagtgttcaccaaggaggacctcactggagatcagaggacatgtttgctgggcaataaggtggccagcttgctagcccgtggctggtggccattgccccatgtgaaggtcactgtgccgagcccagaacacttggtctcggtggcccggagaaagaaccgtccttttttcacaaggggctntataagagctaggtcaacccaggctgtagaaaactccttctccaagggggggtcaatccaagtttggaagacaagtcctttgaaggtggatttgtggcaatgcctgagtcaattgaccttggatgacaacagttgggatgccaggagagcaatgcn

SEQ ID NO: 530730 - DNA, 1713 bp, Homo sapiens
  misc_feature (379)..(379): n is a, c, g, or t
  misc_feature (412)..(412): n is a, c, g, or t
ttcttttgcaggtcacaatcatcgacagcctctaagtctcgcacatgtattctattcactctgactaaagcctagtaaattaaacatagactaatcctttatataacgcgaggattactaatccataattaagtaaacccatctgttaccactaggacagctgccaatcacaggtattaccttcacagcatgacaatcggacattcccatatattccttgcgtagagtagtcctagtgcgctcttctccaagcaatgtatttactcatccgagtatcaaatggagagcgcgagtgaacctcaaatcactatgccaaatctgagatagtgtgcgactcgagtatacactagagtcgagtatatgtgcgccgtatatatgnacaacctacacacagcgtacgtgtatattatgncctccactgtgtgtcaatgatctcttgtagggtgtcgcccagtgagagaatgtacccacgaaaggggccatcctccctcctggacccactcccagagaaccctggtcctatccgtgttcatccaaccaattgcaactacacagagaacctaaatctcacactctaatacatgacaaaatatctagttacttaggcgcgaaccaatacttcttatcccacttcctagtgtaaaacatcggtatagagtgtcgctattacttctcttccaatcgtcatccctacgaatgtgcgtataaatacctactcccattagtataaggggctacggtttggacgtgctggcggagtttgaaaaacccaaaagagcgcccaaagctttatccggcaatatatatggtctttgaggggccaattaaccggtccccttatccaaaaattattaatctctccaatccaagtgagggtgcgaatttgggaagaggtacaccctcactggtccaaggaggggcgctaactccctggtttcacccaatatcggcggcgtgaaaaagtgatgttataagggcgagatagtttccgtttttcgatggttgtcgtcacacccgttgaggtgctgttattctatcctccgagtttccccgttgagaaggcgttacccgataagcgccggcgcgagtttctcctttaaaccgttaagcttttcacagcgttgatgaaagggaggttccctcggagcaccatctccaatcggtgagtcccccctcttagggttaacccttacgtttccttcgggtcccccccgtggttaaggaagcatgatgtcgcctaacaaccagtttgggaacgtaaaataccaaggggcccgttggtgaaagtgttgtctccagattcctcaaagtctcctttctccgttaacaataccccctttatgggggaaagaggccgctgtgttctcaccacgggacttatatatgcggcggagaagtaggcggggcgggcccgccagggggaacaaaccaagccagtggaggcggggagcagggggcgggcgcgctggtagacaagaaataatcactcccacccgaagagggggcgccgcacgctgaagccgcggaaacaccgcagcgcgagacgatggtgcgccacccaaagcggggtggggccccccaaaaagaaggcagcgcggccgacccccacaaagagatagcgccagaacacgcgcagcgaacaaaaaacactggtggaccgcgggcgcagcagaggggccccacatggtgggaccaccctcgccagaggaggcc

SEQ ID NO: 530731 - DNA, 409 bp, Homo sapiens
ctagagtatcccaagcttcgactgtatttaaaaagaaggaagattgtggccaggcgcggtggtttacgccgtgtaatccccatcacttttaagaggccgaggtgggtggatcacctgaggtcaggagtttgagaccagcctcaccaacatagtgaaatcccatctctactaaaaatacaaaaaatttgccaggcgtggtggcagttgcctctagtcctagctacttgggaggctgaggcaggagaatggtgtgaacctgcaacaactatatcctatattcatttgttcatttgtttattcatcaaatgtttctttttaacagctttttgggatacaattcacataccatacacttcactcatttaaagtataaaattcaatggcttttaatatatttccagagttgtgc

SEQ ID NO: 530732 - DNA, 360 bp, Homo sapiens
acccactgatcatggcatgcttcattgaacaatatcagcgtattatacgtgcgttacaaattaagcatttgtgtcatgagctatgccccttagagatggtcagcttttcgtcaataaatgtcctgtatgaccatctggcagcctttccctatttctcgtctctctcatcaggcctcgctgttacctgaggcattacaagcttgaaattaggccaatgatggcacgtacgatggcatctaagtgttcagctaacaggcatagtccccatctctcactcttctttaaatcgagagccagacatgattagcctcagcgagatagtcatgttggaggccacgagagcctgaaatctgggcaggc

SEQ ID NO: 530733 - DNA, 1013 bp, Homo sapiens
  misc_feature (756)..(756): n is a, c, g, or t
ggccaactctcgcaactctgttcttccgacgctccgaccgtcgcgttgctctgccggtcgcaatggaagaagagatcgccgagctggtcatggacaatggctccggcatgtgcaaagctggttgtgctggggacgacgtcctccccgagactcggagtttcctgtccatcgtgcgggcgccccgataacaccagggcgtcgatggtgggcatgggccagcaagggactcctacgtgggcgacgcaggcccagagcgaacgcgtggcatcctgacgccctgaagataccccattgagctatgggcatcgtccgccaacgtgggacgagatggagaagatcggtggctaccacaccttcgtacaactgagctgcgcgtggccgcggaggagcacccggagtgcgtgctgaccgaggccccccctgaaccccaaggccgagcaagagagaagatgactcacgatcttatgtcttgacgaccgtttcgaatggaaccaggtccatgtacagtgtggtcatccaggacgtggctgtaccctctacgacctctgggtcgcacgcaatggacgattgtcatggattctggagaaaggtgtcacccacacggtggcccatctacgagggttatgctcttccccatgcaatactgcgtctggagctggtggcgggactgaccgagtactcgtgaaagattctcactgttcgaggtgccgtttcaccaccaggggtgaggcgggagatcgtgcgcgacgtctaggnagaagctgtggtacgtggcctggtcttcgagcaggagatggccacgcgatctctctgcttggagagactgccagtgccgatgcctgttttgcatgggaaggacgtccggtccgggcgcggcactcttcggtgaactggcggccgaaccctcacccgagggggggaccgaacttccaccggtttggggcccttcccgtttcgagagagacccggccaaaaatcacccaggttgggcccccccaaaaaccctcattttg

SEQ ID NO: 530734 - DNA, 214 bp, Homo sapiens
tagctgggattacaggcacccaccgctacacctggctaatttattgtattttcggtggagacggggtttcaccatgttggccgggctggtcttgaactcttgacgttgtgattcacccacctcggcctcccaaagtgctgggattgcaggcatgggccaccgcgcccggccggagcactgcttttctactgtgaagtttttatttcccattcag

SEQ ID NO: 530735 - DNA, 131 bp, Homo sapiens
ggtttctaatagtcaagtgtggttttaaaccgggtggtcggcccctccaaatggtttttaaaaacccctccaaccaccctgggctttccgaatttgttggtcacccgaaaaaattttcctgaagcttgtaa

SEQ ID NO: 530736 - DNA, 452 bp, Homo sapiens
tttaagtattaccattttacaagtaaatactcactaaatgtgtgtatcatcccacaactagtggaaggtgggattccaaaccacatttgtaacttaggaaacgtgccctttccacctacaataccacaaataaattgctattgtgaataaagaatggaaccagtcatcctaagctcctggctgtaacaatagtgttatgctgaggaaaggctgtttctttttttttttgagaccggagtttcactcgtcggcccaggctggaagtgcagtggcacaatcttcggctcaatgcaacctctgcctcccggggatcaagctattcccctgcctcagcctccccgagtaagccgggatttacaggcacccggccaccaacgcccgggccaatttttaatggtttttagtagagacgtggtttcaccagtttggccaggctggtctcaacctcatga

SEQ ID NO: 530737 - DNA, 248 bp, Homo sapiens
  misc_feature (1)..(1): n is a, c, g, or t
  misc_feature (174)..(174): n is a, c, g, or t
  misc_feature (225)..(225): n is a, c, g, or t
  misc_feature (227)..(227): n is a, c, g, or t
nctgcaggaattcggcacgagaatctgtaaccttagccccaaccctgtgcttgcaaaaacatgtgctgtgttgactcaaggtttaatggatttagggctgtgcaggatgtgctttgttaaaaatgtgtttgcaggcagtatgcttggtaaaaggcatcgccatgctccattctnggttacccagggacacagtgcactgtggaaggccgcagaccctctgcccangnaagcccgggtattgtccaagg

SEQ ID NO: 530738 - DNA, 506 bp, Homo sapiens
acacacggttttgtaaaaaattaaaaaacatataaagagcatagaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaataaataaataaaaaaaaaaataaatagagacaatatacaaatatatcaaaaagaaaatcaacaatcaagttatcttgtttataatatcctaggagtaaaataacctcagatggcagctgaattcaaatttatttaattatgttgacttattattctatttcgcctcaaatcgatatacataatgaaatattggctctaccgatctttgaaattaaattgtggcattgatcaattgatataatcgtgtgaaataagttagttaagtcaattcttttctcattaatgttattcactaattcgatcatatatattaaattgatctactttattatgacttcctataatttttgcacctgaaggatctcttat

SEQ ID NO: 530739 - DNA, 965 bp, Homo sapiens
gcctttgaagtaaagcagacattggtggtcgctatggggattgctggctcagatgtgtccaagcaagctgctgagcatgattcttctggatgacaacttggcctcaattgtgacttggagtgagagcgaaggtcgtctgatcgtttgataacttgaagaaatcctattgcttataccgttaaccagtaacatgcccgaggatcaccccagttccgtgatatttcattgattgcaaacattccactaccatctggggactgtcaccatcctctgcattgacttgggcactgtacatggttcctagccgatcatcccgtggcttatgagcaggctgagagtgacatcatgaagagacaggccagaaatcccaaaacagacacaactcgtgaatgagcggctgatcagcatggcctatgggcagatcggaatgatccaggccctgtggaggcttcgtatacttacttcgtgattctggctgagaacggcttcctcccaattcacctgatagggcctccgagatggactgggatgaccgctggatcaaccgatgtggaagcacagctacgggcagacccgtggcacctatgagcagagcgacaatcgtggagttcacctgccacacagccttcttccgtcagtatcgtggtgcgtgcagctgagccgacttgcgacatctgtaagaccaggaggaactccggacgtaccagccacgcgatgacgaacaagatcttgatatcgggcatctcgaacgagacaccctgactaatttcctttcctactgccctggaatgggacgttagctcctaaggatgtatccccttaaaaacttacatgtggtacatgtgctttccctaatctatctcaatctcggatactaccggaatcagaaaacccatcatcagcagaccctggacagctagatcgaacaacgaacctactaaagcccccgactagacgcaggagcc

SEQ ID NO: 530740 - DNA, 1301 bp, Homo sapiens
gggcggatacgccgtgcagcgtgggtgggccctggggtgccctggtggccctgggatggggaacctgcggtgtgcttcctgcggaggtttcggcagtggcatcctggggccggtggtcagcggcctgtggacggtggcctggaggcctgaggccgctggagcatcgcgggagtgcaaggccgagggataagtgagtggatgcccagtcatccaatgttggtgccggcttgtgtcaagggacagtgaacgatcaaggtccctgtgatggagatcttagtcgtctatcatcacctggcccagttagcgcgacacttcaggaggatcagttgatatgtcatatccttgggcggtgccctcttcttcagagggattgacgcgctctctcgcgacacgaatttattggcacaggatgccacgcaaatgtcatgagcccccgggttgcccgtagtacccaaggtccgatccagcccagagggctttccagaggagccgagctacagagaatagtggcagttaaattacggatgagaatccttaagccactatttgggccccaacccgcttcctcgtgaacaccttgcgggactcgattagaacgcttgtacttcccgagaacggggaaacgggggattcggggtcacgagccgccgtggagcagcaagacgttaccacaggggattgcgagcgagagatcagccagagttccgagattaccacctttagtaaactccgaaagagggaccttcacgttacgccagattactcgggattctcgaccaccggggcttgagcttgcgcagctgcatgtggcgcgtcataaagccctatggtagcgcactctcgaaataatcgctagaggtgcgaacttcaccgtcagtgcacaagaagtgtgctccacaccacgctgcactggcattgggcaatgcccccccttatcgtgcgccaaacaggtggtggtatgggccgaccataggtcttggactcgtcccgcgctttctgcgtgtgtgcgctaccattccctttgtcgatttcggcctcgtttgtgcactcattataaccgcctgacccccaccgtttaccgacatgctttcaccgctccgtattgtggtcgcctgacgtcgcgccccacaaaagtgtgggcgtggtgtcggccccaacaccacttgttgtgcacgatcgcacaggactatccgggcgtgttcgcgaattcaccatcggtagcccagatcccgcgctgttggactctgcgcgtcgcgctttaacgcgcgctcgaactgacgcgggaccccttagcgcccgta

SEQ ID NO: 530741 - DNA, 107 bp, Homo sapiens
  misc_feature (47)..(47): n is a, c, g, or t
tcctgaagtccgaaatcataatggaagtccgtaaagaaggtatcttnactataaaagctattgtgtaagctagtcatattaagtagtagtctcagtcttacctgtaa

SEQ ID NO: 530742 - DNA, 337 bp, Homo sapiens
tacagtggcagtcggataaaggcacagccagtagtaacatcatggcatggatatgaagtgtccgagctggatgcgcgcgtaaagcgagggacccaatcatatgcggggtgtgctagtgtaagagacatcctatctgagtgaggggaagggagctcaggctttggacctagggccagggctgggatcagacatgtatgggatgcggtctgtgctgtccttcgaggcttggggctgagggtcagaggagagcagagctcacatctttggaatctcacttcctttgggtactagacggcttgctttgatcttgcttgcatgatcttattattcatgtcct

SEQ ID NO: 530743 - DNA, 131 bp, Homo sapiens
aattcccgtgttacgctgccctccggctccaagactggttctttcctcagccaacagagctgtggttggtgtggtggctggaggtgtccgacattgacacatccatcttagaggctggccgtccgccccga

SEQ ID NO: 530744 - DNA, 128 bp, Homo sapiens
  misc_feature (10)..(10): n is a, c, g, or t
ctagaggacntctccccggttctgggtagctggggctacagttgcacatcaccataccctgctaatttttattttatttttgtaaaaatgagggttttgctatgttgcccaggctgctctcatactcc

SEQ ID NO: 530745 - DNA, 183 bp, Homo sapiens
  misc_feature (98)..(98): n is a, c, g, or t
  misc_feature (125)..(125): n is a, c, g, or t
  misc_feature (150)..(150): n is a, c, g, or t
  misc_feature (158)..(158): n is a, c, g, or t
aacttgaatttgggtttttaacttaggtttgggtggcggacggggtgagtaacgcgtaaagaacttgcttcacagctagggacaacatttggaaacgnaatgctaatactctaatattatgatanatagggcattcctataattatgaanagctatanagcgctggtgagacagcattataca

SEQ ID NO: 530746 - DNA, 793 bp, Homo sapiens
ggcgggacgacgtcgtcagacgggggtggcccgtgggagctgagcacggagaagactccctctctcggaagcggatccgagccggcaggatggatcaccaccagccgcgactgggcgctaccaggtgcttcttactgaagaggatactcagaatcatcggctatagagcagcacctattcaaacccagcaccgagatggtgcagggctgcgtcttcaagcacaagcattgaaatggatcttcccctccaccatatagtagtatttacttgtggaagtacctaacaatttcagatccagaagttacggggagtttatccggtgccacctccttataagcgtggttacctctctttcctaatacggatgaagctgagaaggggctaaaagtgctgcaatggcagttgcaggagagaaaaatctcaaagaatcaggagggaagagtggtcaccaagagatgactttcagtgatgcagaccagtcaagaggtgggaaatgaatggcatttcaatgctggcattttttcagtgcatttaattttcacaacgttgctggggattgggtgtaaatccgttcttgttatcaccaattacccataagttggaagggtatggctggctattctgcgggagttgtggacctttccgttgattcaaagtggattcttattgtaaggggtgcgtgattattttacgggactatttccaatggagcaagattggcgcttggggggagattccttgtaatttgggccgcgcctttcctgcagaggagttgtgcaatatttacaaagcg

SEQ ID NO: 530747 - DNA, 286 bp, Homo sapiens
gggtcccaccttgtttttatttcttaaacaatttttgtttgccaaagttaaaaaaaattggttgttccatttaatttttttaaggagttccggtttttcccagggccttattttaggtttttttcttttggaatttccttttaaatttttgttttccctccccttttaccctttgttaaggaagttaaattccttaaaaggaaattcttttggggttttttgcctttttttaatttttttctttgggattaccttccaaaattaaaatccggattttttcctttta

SEQ ID NO: 530748 - DNA, 390 bp, Homo sapiens
tcactgacactttttgtatcatctaactaagatagacacgtgtgtaatgcgattccgtcaacatctctgggactactattattcggtataagatatttaccattagcgataaaatcccagaaatggaattgcaaggtataaaagattattaacatttttcaaggctttaagatgcctttacggtgtatctgttacatcctgcttccacacaaattcttctgtatagccagtacccaagctgcagctctcagcacaggtgaagacagccaggatgccccagtcaatgctcttgcccagtctgtcagccttcaggtagtttaggagctgaggcatgacctggaattccaatattctcttggcaccacaggggcaatctggaatatccttttc

SEQ ID NO: 530749 - DNA, 503 bp, Homo sapiens
  misc_feature (415)..(415): n is a, c, g, or t
ctctatggagacggctgggaaagggattccatgtggggaggatcccagcagtgtggagcccagagagctagcgagggagggacttgttgtcatgagaagcagcacttgtctgttattcaaaaaccaaaagaaaatttctggcccagatgttgtggtatcagcttgtggaagcccctggaaactttgctcaggatccacccaccttctctttagagacagtccctttccttcacagagttcactgatgaggtgagtgtggctggcccggaatctctagagctgtctctgcctgcctctgcccctgcccctgcccctgcccctgcccctgcccctgcagcactggctttgtggggtgtgccaccacacctactttgtttttttttttcccatgggtgctaaggtcaaacttggagcncctagttgcgcacctatacttttagcaatcacataggtgctgggcatcaagcaggagttactcagtgaggcttttgtctcagaacaaa

SEQ ID NO: 530750 - DNA, 259 bp, Homo sapiens
gctgatcgcttagaggcgcaaagaaaagaatctcaagtgaaaggacccgttcgaatgcctacccagactttgagaatcactaccagaaaaactccttggtggtgaaggttctaagacgtgggatcgtttcccagatgagaattccaccagcgactccttgacttggcccgtccttctgagattgttaagccgattacttccctcagttattgagcccggagttgaggtggaaggtccacccattgccagatgcttaagc

SEQ ID NO: 530751 - DNA, 160 bp, Homo sapiens
gtgatgggacttcagcccagtacaggagcatcccctgcaggtttctctgctttgatgcttctttgctttatgcttcagttcttcttttcaccttctactatttctcttgctgccttggctttccccaaaggccttttcactgtgtgtgtgtgtgtgtgtg

SEQ ID NO: 530752 - DNA, 199 bp, Homo sapiens
ctgaactttatttgtgcatcatttgtttacttagacactgccagatctctgtgagatctggaatcttctccctccatccctgctgtatcgtactgccccgtgccctagaataagggctcaggactacttgtaaaagaaagcaaggaaggaaagaagagaggagggtgtttgttgagcacctactatgctgtaaaagctt

SEQ ID NO: 530753 - DNA, 92 bp, Homo sapiens
actaaacccaagatcaactccccctgcaagttgaagtcctggcattgaagtttaaaaaaattacagcccccaataaaatttttaaagggtta

SEQ ID NO: 530754 - DNA, 197 bp, Homo sapiens
ccaagtacttccagattggaaccatttttgacaatccagctgatttctaccattaacgaattcccaagaggcaaagaaaaagatctattgtggaggacctctctgtctgattctgaattcagaggatacacccgaggagggtactcagagatcatggctaaaagcagcaattcagcaggaaaaagtccgaagaggag

SEQ ID NO: 530755 - DNA, 497 bp, Homo sapiens
  misc_feature (497)..(497): n is a, c, g, or t
gcttcagtgagctgggcagcaggaacgccaaggagctggccttccgggacagctgggtgtttgtcaggggccaagggtgtgcagtaacaagagcccctttgagcagcacgtgtaagaactagtaagcacgagcaacagaggtacgaagggctggcccgaggcgctggagcatggacaggctggtatcccggcggcagaagtcacggccagctagcacggccagtgccatggaccgggccgagggagtgccatgaccaagggaggcacgctgcgtctgccggagcggacagaggctgaggctcacaccccagaacccgggcaggagcgctccctgtggcccaacacatcggggctccgaggcagtgaccagaacgtggtctcaaggtggctggagggctatagaggggcttgcaaagaaggtaaccacagaacgcagcttacgacaacgggaagcaccagagatacccagaattcctattcgtaacactgatcccccn

SEQ ID NO: 530756 - DNA, 423 bp, Homo sapiens
agtctggacctggctgcagtgggcatattaccgtatggatatctttttctttctttttttaaagtgaggagattcttcagggggtcaggctgagaatgtaataagcctgacattggaacagatttctcccgtgtggtctagctggaccctccgcatggccacactccctgccagtcctgacattgacttcctgaatgtgattaggtggtaatgagcaggaatgtcctaggatgttgagacatcgggatccaggcccccagtgaaatggtgctgaatatggtgagtgtgtgtactccgctcactgtgccagggtgctttcctctaaccgaaatggtacgtgtagccgttgcgaatggtgcaactctcaagtcggagtgggcgccacggtttgagtgaaatggctgtgaaaaccttagagaaggg

SEQ ID NO: 530757 - DNA, 649 bp, Homo sapiens
ggcacacacacacacactgccaggagcgggggagctttcgggccacactcccagacgcctccctgagccctggaaccctggactcgttgctcctggccttccataccccctgggcagatcatcctgcgtgtcccaccccagatcccacgtctcgtccatcgtctcattcctgattgtgacaccgcgtggtcaacgacatggattagaggagaagggatcatgaaggtgttgggagagagaggagggatataaagtccttgtagtatattgtctgagattcaggggatatgtgagtcgaaagggaatgcatgatgtatacgtagatacgtacagcgtatcgtagggatggcataggcagagtgagataaggatcaaatgaagcgtttgtgaacatagtggtaatgcaaacatggtactggagaagtagatcgcggactcaatgcttgccgcttgcgtccatcgcccgccacgggccacaaggcgaccacacgtaacggtagaacccctacgtatggatcactcccgctgccgcaccacagccgccccccaatccgccaacaacgcgtccaaacgcccgacaaccgccgccgacggacagcgcgcacggcggaccacccttggcgaaccgggcgccccgacggggccacac

SEQ ID NO: 530758 - DNA, 337 bp, Homo sapiens
ttttttttattatgtatgtttgtacactttttacattactgaatatcaattacaatgtgccatgttattatttttttcttgtagtatgaaacatccatcttgcacatactctactgttgcaaagcttccttataagggggctcttttatctgggatcttaaccagatggttgctgtctgggtagcactactacaagtttagaactcgcagtgtctttcggaatttacaaaataaactgtatacttataggctgcggtttctgtttcgttatggggttttgtttagtctggttttacacttttagttactgatgccttacgaggtgatgtttgagata

SEQ ID NO: 530759 - DNA, 240 bp, Homo sapiens
  misc_feature (212)..(212): n is a, c, g, or t
aagcagagcatgtgtgctccaatccagaacagtgtctcagctcagaggacaggtctgctgtgtgtgtgggactctcctatggatcctgcatgtctgtgtgtcctgagaggacatgggaatcagggccacctctcctcgaatgcggggcagagagagagccttgacaccaccagcctctcctccctgtgccccaggagttcatcctttgctgnctggcccgggaccctgcccggcggttct

SEQ ID NO: 530760 - DNA, 568 bp, Homo sapiens
  misc_feature (6)..(6): n is a, c, g, or t
gcaaancaagtacaacctcacttgaaataattaagaaccattttactttacctgtccctaaggccagcaaatctccattcagctcatggcttttagggtaacggactggggaaaagagaagcatggaatgtaagtccaacattctgacttttctgagggccacccaagggatgggtttctgtcttgcctggagcactaatggaaacagcacaggttagatttctgggtgccaacaaaagcaaaagagaacagaaacagattgctatggcaccagagggccagcagtaccaaagacagagactgggatgactcagcaccattgggaaaagacatccaacttgtttcttcgtcagaagtgagagagaagagtgaagtacatgcttcaaatattccagcattttggagaggtgccagagggaatgatatctctcacctgctaaatggtgctgatgaggaagctggcatatattgaaaaaagctggttggtgaaggactttccccataagaagccagtccataaagactaggaaaggcagctgttttttaaaattgcataaaaactcagcca

SEQ ID NO: 530761 - DNA, 248 bp, Homo sapiens
ccttttttcctttccttttttcccccctttttctttcgggccttttaaaaacaccctccctttttttacatttttatttacccattgtttcagggggggggggggtgacctttttccgggggggggggcttggtcccccccgggttcccaggggtccgtcccttgggaagtttagcccgaatttttgttttgccccccccagccccgccttggcccctttttttcccttaaggaaggtccccctttta

SEQ ID NO: 530762 - DNA, 439 bp, Homo sapiens
  misc_feature (34)..(34): n is a, c, g, or t
  misc_feature (309)..(309): n is a, c, g, or t
aggaacatgaggccgcctggttttcaactccgcncgggagggcgttgcgccctggcgcgcgtttttggaaaactggcggtgcacggcgcaaagcacggcgtggaggacttttccgtgagccaaacgatgctggaggaggtatttttgtacttttccaaggaccaggggaaggacgaggacccccaaaagcaaaaggaggcaggagtgggagtggaccccgggccaggcctgcagcaccccaaaagggtcagccagttccttgatgaccctagcactgccgagaatgtgtttttagcctccctcccctgnggggccgcggggaggccctgggaatggcaagggcaaggtaaagtgcctaggagccctggactcaggctggcaaagggggtggtgccctggagaaaataaaaaaaaggctggaaagaacccgtgttggtta

SEQ ID NO: 530763 - DNA, 220 bp, Homo sapiens
  misc_feature (129)..(129): n is a, c, g, or t
gtatgatgcatggcacataggagcgaatcattggggcgcatgaaagccataggcagcctggaagagggatgaaggtggtgaagcaggaagccaagtgcaggaagtgtcttcctgcctgcctaggcatgntcattatgatgttgggcagtgttcagaagcccacagaagattctagaagcccagatgccacgagagagaagagaggccaagatctctctta

SEQ ID NO: 530764 - DNA, 738 bp, Homo sapiens
cggggggggtattttccgccgcttttgtgcggtcttttgggggttggtgtcgggggtgtttccgggtgtcgcgtatccgcttactgctctccggggtttgtttgtgttttgagtctttttatgtatggggggcgcgggggtgttctccccacggtgtggtcctccggcggggtgtgttgaagctcctttggccctcacaggttgagttgtggtttgcccggtggcccctcctccagaagtgcttgggggttattaggggcggtggggcgcaccacgcgggtcacagcggctataagctgcacacacctgtttaaagtatagttatagagtgggcaacctatgccacatattttgttgggtattgtttatccacacacaattgtgtaaaaaaaaaaaaaggaaggccacggcaccacgtggctcaacgcctgtaaaccccacgcacgtttgggaaggctcgaggcacaggcaagagtcacacctcgagggtacaaagaagttgagagagaccacagcctgagccacaacactggaggaaacccgtttttattataaaacacccaaattatgccggggaatggtggcacacacacgcctgtaattctcagctaacttcgaagaaggctgaggcacaggagagaaatcgcttgaaacctgggaggcggaggttgcagtaagctgagatcaagcccttgtaactccagcctgggcaaacaaagagcgaaaactcaatttcca

SEQ ID NO: 530765 - DNA, 270 bp, Homo sapiens
  misc_feature (126)..(126): n is a, c, g, or t
ggctgtaatggagctacagctgcggctatgctacagccacagcaacttgggatctgagctgcatctgcaacccacaccacagctcatggcaacgcccgatcctcaacccactgagcacggccaggnatcaaacccgagacctcacagatactagttgggttcgttacagctgggccattacaggaactccacaccaaagatttaagttgcaatgggaatctcattgctgcaagccagcctctctgattaagttgtagcagccacatgtgg

SEQ ID NO: 530766 - DNA, 239 bp, Homo sapiens
acgacatactagtatgaaaataatgatagattgcgattctagacacgctcccgtggataattataccacgcgtattccgaagattgttttatagttaaggtgactcaaaagcattgtcatacacagccgcagaaacaggcttctcgctgactggggtggagtcaactgctctgcactcagcgttggtggtcactttgtgagacacagggcagcacatccacagtgagtgagcgaggcag

SEQ ID NO: 530767 - DNA, 218 bp, Homo sapiens
acccaaactatatcgagatatgtctgtagcagactaaattattctctcttcttttcttttctgcctaaaaaaagaagggtcttactctgtcacccagggctggagtgcagtggtgtgatcatggctcactgcagactcgacctccccagcacaagcaatcctcctgtcccagcctcctgagtaaatgggactatagacatgcaccacggtggttccgc

SEQ ID NO: 530768 - DNA, 196 bp, Homo sapiens
  misc_feature (159)..(159): n is a, c, g, or t
gcggaccatgcttatggatatacaacattcagatgactctcccgaaaattacaccatagctaatcaatttcctcttaataagctcactgaacttctccgacatgacatagcagccgcttggcttcactgaagcacttacctttgccctgtgctcccaangaagatattgctgataaactaggtgtggatatctctg

SEQ ID NO: 530769 - DNA, 208 bp, Homo sapiens
  misc_feature (98)..(98): n is a, c, g, or t
tgggatttttggaaaggaaatggggaaaaaaattggggccccctttgttttttggcaattggggggtccggtccttttttaaagcccttccccataangggggttttccggtttttttttagggaggaccccccaaaccctccctaacgggagggatgtttttgtttcggtttggattcctaaataaaaggtaaccccgcccccttta

SEQ ID NO: 530770 - DNA, 356 bp, Homo sapiens
ttcttttttttagttcgtccatacagggcggctcaatagggggaaacttagagtgtggtcttcgccaggcatggtggcttatgctggaatcccagcactttgggaggccgaggcaggtggctcacttggggtcaggagttcgagaccagcctgactgacatggtgaaacttgtctctactaaaaatacaaaaattagccaggtgtggtggtgggcgcctgtaatcccagctactggagaggttgaggcaggagaatcacttgaacccgggaggtggagactgcagtgagccgagctcacgccactgcactccagcctgggctacaaagcaagaccctgtccgggcctggtggcgca

SEQ ID NO: 530771 - DNA, 388 bp, Homo sapiens
ttagattatactagcgagggtagcttgctattcttcgccgatccaggacaacacttgtgtgtgggaattcttgcagagcttcatgattggatactttatagaaaacgtaacagcgacctttaaggaaggaactttcatccccgttcttctatgtgaggaaagcaatgaccagagcacggctgccttgtattcaactcccaggtgaaaggaggcagcttgctgcatttaaacgtgggtctgcttccaagcccagcaatgatcaagccggctatagtgggcgcagcagagtggcagcatgaatctgagattggtcgcagtgtcttgtgcctactgaggagcaggggccatgttcctccccctacaactagcactgagccacactgagcac

SEQ ID NO: 530772 - DNA, 151 bp, Homo sapiens
caggcagggcggtggccacacccataatcccagcatgtgggaggcagagggtgggcagatcaccgtgaggtcaggaatccgaggccagcctagggagcacggcgaaacgtcatcgccaccaagaagtacaaaaattagctgcggtgtggta

SEQ ID NO: 530773 - DNA, 222 bp, Homo sapiens
gacttgtaatgtgaagtattgtctcacttgtagttagtttgcattttcctaataacaatgatgtttaacttttttgtgtgtgcttattagctgtttcacatgcccttatacttattccattttttacttggctgtttccatacaatcactggcatgtataattcagatgctcctcatctctgtctcacatttctctctttgcttgtattccgctggtcatgt

SEQ ID NO: 530774 - DNA, 475 bp, Homo sapiens
ggtcacccagttcctgatcctgatgttaaattgttaatggatgctgcggatgttgatggaagcggcactctaaactgtgaggagtttgtcacgatgtccattcacatgaaaaggattagcagtgaggagcatctcactcaagcttttggttacttcgacaaggacaaaagcgggtatattgaatttgaagagttgagagaagccttgctagatgagaaccttggtcccaacaatgagcaggtgatccaagatatcatatttgatgctgacttggataaggacggtcgaatctgctttgaagagtttcaagcaatgatgaaaagtggcatcgattggaagatggcttctcgccaatactctagagcaatgcttaatgcactcagcctcaaattgttcaaagacaaatctatgtaatggagaaaccaagttttcttcagcggtaatccgatccaaaataagtgctatattataaatt

SEQ ID NO: 530775 - DNA, 831 bp, Homo sapiens
ccaggcgtggtggcatgtgcctatagccccgtctctaccaaaaataaaaataaaaattatccaggcgtggtggcatgtgcctatagccccagctactcaggaagctaaagcacgagaattatgtgcatcctggaggtgaaggttgcagtgagccaagatcacaccactccactccagctctggacaacagagtgagaccctgtgtcaaaaaaaaaaaaaaaaaaagaaagaaagaaaaaatgctttaatggcccagtgtgcaggtggctcacacctattaattcctagcacttgggaaggctaaggcggaggatggctgtgaggccaagagttctcaagacaagcccgtgggcaacattgtgcaagaccccaacttctacaaaaaaccgaaaaattagccgggagcggatgagtgtgtgcctgtagtccccagctactcaggagactgaggtgggagaactcactttgagcctgggaggtaagaggctcgcagtagagctgtagtttatacccattggcatctcccagcctgcctgaggagtaacagagcaaagactcccatctcaaaaacgacaaggaaacaaaatgcattggcctaccaataatgagggccagggacaaaaagaaagcaagagtcccgtgtgtgacactctctgtgaggcggaacttttggcaacagcgtgctacgggccatgggtcccaggtgttaaacagaggtgtgccacccgtgcaatatctataaacgggaatataatgacaccgcatttcaatattggtacccatcggacaccccggagaggcatggggtccttagcacaataacatgcccgg

SEQ ID NO: 530776 - DNA, 478 bp, Homo sapiens
  misc_feature (18)..(18): n is a, c, g, or t
  misc_feature (23)..(23): n is a, c, g, or t
  misc_feature (25)..(25): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 530777 - DNA, 241 bp, Homo sapiens
  misc_feature (20)..(21): n is a, c, g, or t
  misc_feature (27)..(27): n is a, c, g, or t
  misc_feature (46)..(46): n is a, c, g, or t
  misc_feature (50)..(50): n is a, c, g, or t
  misc_feature (54)..(55): n is a, c, g, or t
  misc_feature (84)..(84): n is a, c, g, or t
  misc_feature (86)..(86): n is a, c, g, or t
  misc_feature (121)..(125): n is a, c, g, or t
  misc_feature (165)..(166): n is a, c, g, or t
  misc_feature (168)..(169): n is a, c, g, or t
  misc_feature (188)..(188): n is a, c, g, or t
  misc_feature (197)..(197): n is a, c, g, or t
caaccctcctgtattattgnngcaganaaactgtgctgttaacgcnagcngcgnnacaagatgcctttggaaacttaatagtancncaatgctgtttatggaatattctgaactcctaggnnnnncctgttctatattttaaagcattatttggttttcattagnngnnaacataattagctcaggcntatcaggcnctcagatgagtcatattttttcttggatacacctgaggacatat

SEQ ID NO: 530778 - DNA, 457 bp, Homo sapiens
  misc_feature (25)..(25): n is a, c, g, or t
gcggccgactactactactaaattngcggccgcgtcggcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 530779 - DNA, 620 bp, Homo sapiens
acgtcggcatgacaccatgaactcccattggatctgttagcctctggcataagaacaaagcaagcttggtagtccacggacagtatctgcattctcccaggaccagggctaatcccagcaaacatggatggtcccttaaaggtggagtccttatttcacagatgggagattgaggcccctcgtgccgaattcggcacgaggcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 530780 - DNA, 302 bp, Homo sapiens
ggccttctaagcagcttactttcttttgtaaaatcaatcaccaggaaagggaaaaaaaaaaaaaggagctccaagggaccaaaccaaaaacttttaacacctttgacacaggggctcagcccctttatttgagccccaggggcccaggctgggccacggttggagggcctttctttacgggaagggcctttgctcccaagggcaggaggagggctaaagagaaccctgccctttaacagggctgaggcacacagacctgctgatgtctgaggcccagaggttatgtgggcatggcccaccct

SEQ ID NO: 530781 - DNA, 467 bp, Homo sapiens
cccgaaaattcggccattatggtcggggcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 530782 - DNA, 191 bp, Homo sapiens
attaacgggttggtggtaggttacgacacagatctgtcctgtccccacatatgtgccctaacctaccaccagacccgtttattagcagagtactgagctatgggctcagcatattccagctaaacagtgtgaagaaaacgtccgtggcctaggacaagaatgatcaaataagtgtttaaagggatgcaggc

SEQ ID NO: 530783 - DNA, 704 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (525)..(525): n is a, c, g, or t
  misc_feature (527)..(527): n is a, c, g, or t
  misc_feature (532)..(532): n is a, c, g, or t
  misc_feature (534)..(534): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaaaaaaaaaaaaaaaaaaaccggggggncnatatngngggggggggaaaaaggggcagaaaggggcaaggggccaaaggggagtcctggagacacagattttttgtgcaaaggggggaaaagatggcgggaggcacccataaaggggaggcgaattgaaatttcagaaaaccggggattacccgggttaaaaatataaaaaatcagc

SEQ ID NO: 530784 - DNA, 112 bp, Homo sapiens
cagcctgtcagcaggagcggttctaccattaagttgagatagttgaatcgttcgggccagactctaatcatctgttacggataaactgcgtggggggtgcgcggtctggaga

SEQ ID NO: 530785 - DNA, 696 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (507)..(507): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaaaaaaaatngccccgtttatttttgatttagacaggtttatgattgcggcccaatttggggttttttggcaatttccccttagggaggggttttaaaataacgtgggcggggtttaacacggggggatgggccgggggtacacacaataaatcgtgtggaagcaatcccttttgcaagggggattagcggcccccccc

SEQ ID NO: 530786 - DNA, 407 bp, Homo sapiens
catattatttacatataatattccatatggaggaataatattcaattttttgtgtacaccacatcttgtttatccattcatctggtgaaaaataatttgggcctaggcacagtagctcacgtctctaatcccagcacattgggaagctgaggtgggtggattgcctgagcccagaagatcaggaccagcctgggcaacatggcgagaccccatgtctataaaaaatttaaaaattagttgggcgtggtggtgtgcgcctgtggttctagctactcaggaggctgagatgagaggatcacctgagcttgggagatggaggttgcagtgagctgagattgcaccatgcactccaacccgggcaacagagaccctgtctcaaaaaaagttgatgaacgcatacatattaa

SEQ ID NO: 530787 - DNA, 2398 bp, Homo sapiens
gagacggtgttttgctcttcttgcccaggctggagtgccacggcgcgatcttggctctacacaacctccacctcccaggttcaagtgattctcctgcctcagccttccaagtagctgggactacaggcatgcgccaacacaccccgttaattttgtagttttagtagagacggggtttctccatattggtcaggctggtctcgaactccaggtcaggaagatctcaggtgatcttcccgtctcggcctcccaaagtgctgggattacaggcatgagccactgcgcctgtccattccttattcttaatcagataagagttgctggttttcacaactaattactccacctcaaaccaagatgccaccacacgcttaaagctcaaaatttctctaaatatgcatccattttattgtgtttttctactatctcaaaggaagagagatctgatttcctattttattctctcctttctcctttattgggagaaatactataactatttctttcatgtaaacttcaaatctttcccggtttccttcaaatctttcctcattgattccttcgtgtttcaacagagactgggtcatagagccctagaaattcttcctaaaactagagcagtctctaaccttatttaacttactttactactgctaccaccatgatatactgaacattgtttccattttctcatttgacacttacggttttcacccctaccatgtgattaaaaccatacatgaatcatctctttttttcatctatatccttcttccattagcaatattatgtgattctttctgaagaagtcctggtgaagtatctgaaaactacaactatttttgtgtggcccatgagctaagaatagtttctatatttcaaaaagtttttttcaagataaaaaaaaacagtattctgtgacacatgaaaattatataaaattcatatttgagtgatcataaagttcaccagcagaaggtgatgttgccgcactagataaagaaaagcctctggtggccacagcaatgaccacttcttctctactgtccaacaggtagcttgctctgcagagaaaaggcgtgaaaaaaattattctaccagttgacagaaaaaaaccagctgagaaataaaacctgattgttcacttttaaaaatcacacccccaacgtgggcccactagaatggctcccacaaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgccaaaaaaaaacataaaaaaataagaaatcacacctcatcctcagaaagaaaactgactccttcaacttccacaaacacatacacacttcttttcaacttatttatacactttataaatgtgaataaagtgatacttcctgctgttgcaaacagggtatatgtgctgttctccaaatagttcaaatggttttattatcacaacctgagaaatatttcaagaagcaatggatcctgttgtctaactagtaagagaaggaaaagctcatcatcaaatatatccaaattcaaaattttttggcagctattttctagtttacacaaggtaaataccaaacaaagtcagttcagcagggcaattcctggaggaacatatttttacccaattccttctgctaggcccaataggacatgatattatttcaactcaactattgtgaagaattcagtcaccttagaattgatatggacaactggtggcactttccacattttcctgttacagggatccctgccatcttgcgtggcatgaaattctagggtatcaacagagtacttactcaggaacgtagactgtttcttgaaaaatattttgcctctgcctagagataccgctatagtcacacccatggaagaacacatcccagtaagaatataagtcagtattttggtatgtcatgatgaaatgctactgccttgacataaccgttttactagctaaaatatgaatcagctctattagtaaaaatttagtgagcttctgctatgtgcctagatgaaatgcacagcctctgctttcaaagaaaaaaatatttagata

SEQ ID NO: 530788 - DNA, 264 bp, Homo sapiens
tgaggctcaagacggagaatgcttgaacccaggaggcgaaggttgcattgagccatgatcacaccagttgcactccagctgggtgacaagagcaagaccctgtctcaaaaaaaaaaaaagaaaaagaaaagttaaaaaggaaagtcaccgttcgtggatgaaaccaaacttaggggagagtagtctcggtttgagaccctcattgaaaagtggtctatgttcctggtagaggtacctgcattgttgtaaccagggccggcaatt

SEQ ID NO: 530789 - DNA, 766 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (566)..(566): n is a, c, g, or t
  misc_feature (568)..(568): n is a, c, g, or t
  misc_feature (573)..(573): n is a, c, g, or t
  misc_feature (580)..(580): n is a, c, g, or t
  misc_feature (583)..(584): n is a, c, g, or t
  misc_feature (594)..(594): n is a, c, g, or t
  misc_feature (596)..(596): n is a, c, g, or t
  misc_feature (602)..(602): n is a, c, g, or t
  misc_feature (604)..(604): n is a, c, g, or t
  misc_feature (606)..(606): n is a, c, g, or t
  misc_feature (609)..(609): n is a, c, g, or t
  misc_feature (611)..(611): n is a, c, g, or t
  misc_feature (629)..(629): n is a, c, g, or t
  misc_feature (632)..(632): n is a, c, g, or t
  misc_feature (637)..(637): n is a, c, g, or t
  misc_feature (641)..(641): n is a, c, g, or t
  misc_feature (648)..(648): n is a, c, g, or t
  misc_feature (652)..(652): n is a, c, g, or t
  misc_feature (656)..(656): n is a, c, g, or t
  misc_feature (658)..(658): n is a, c, g, or t
  misc_feature (661)..(662): n is a, c, g, or t
  misc_feature (673)..(673): n is a, c, g, or t
  misc_feature (676)..(676): n is a, c, g, or t
  misc_feature (680)..(680): n is a, c, g, or t
  misc_feature (688)..(688): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaacaacaacaattattctacaatttccatttcaacaaaaaacctaaatcactaccatataattcattatttttgttaatttccttgtngnccgcntgggccnagnngattttagantngggcangntnatncntgcggccgaatttcgggntanttggnccanttggccntatngggngnggnnttacaattaantgnccgnggttttanacgggggggtttggaaaaacctgggcgttaccacatttaaacgccttgagaaaaatcccccttttggcaggtgggggt

SEQ ID NO: 530790 - DNA, 1158 bp, Homo sapiens
  misc_feature (1)..(1): n is a, c, g, or t
  misc_feature (1102)..(1102): n is a, c, g, or t
ntactcgtcctcgcactagcttcttgactagtcggtggtctgtctcgctcttgtgtaccccgccgttgtcgcgtcctgcgtgttgctctctcgcagtcgctttgtttcgtgacgcgcctgtgtgctcttgtgtcgctgtgtttatccagtgttcggccgaccccctttgggaggaggggaacgtgttttttctgcacggtatggcgcccctgtggcccgcccttttttttatcccgccccccgggtctggagtccgccagttgccgagccattttaataaccgggccgcccctgtgtttttgcccactccagtgctttttacccgggcgcatccgtggttccacggttcccctccaaccatgtgccggcgaacaccgcccctgttcagctttcccgtcgtttttcagctgtgtaacacaactgcgcctagggcaccagatcccattagagcagaggatttagaattggtgtttggatacaccatcctgtcaagaatccatgctgtgtcaccggaaaagtctttaaaccaatttgggttcagattaccccttagatgctgaaggtaaagtaacagagaccagatgttacccccacttttgtaggtttttaattttaaggaatgtaagccaatgccgagtccatctcttgaccgctttaggctgtgtgtaatggctgcacccggcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcnaaaaaaaacaattgaagcaccaattcctttaaggaattcaagcacaagacatcttg

SEQ ID NO: 530791 - DNA, 536 bp, Homo sapiens
cccgaaaattcggccattatggtcggggcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaacatacaaattacattagattatataattaatgccctaatcaaggacttcaacttctctttta

SEQ ID NO: 530792 - DNA, 279 bp, Homo sapiens
tggggggacagggtctgactctgttcccaggctagagtgcagtggctcatccctataatcccagtacttttggacgctggggcgggcagactgcttgagctcaagagtttgagaccagcctgtgcaacgtggcaaaaccctgtctctacaaaaaaaatacaaaaattggccaggtgtggtggcatgcacctgtagtcccagctactcaggaggctgaggtgggaggatggcttgatcccaggctggggggtgttgaggctgcagtaagccgagatcgtg

SEQ ID NO: 530793 - DNA, 780 bp, Homo sapiens
  misc_feature (11)..(11): n is a, c, g, or t
  misc_feature (63)..(63): n is a, c, g, or t
  misc_feature (121)..(121): n is a, c, g, or t
  misc_feature (161)..(161): n is a, c, g, or t
  misc_feature (167)..(167): n is a, c, g, or t
  misc_feature (169)..(169): n is a, c, g, or t
  misc_feature (267)..(267): n is a, c, g, or t
  misc_feature (285)..(285): n is a, c, g, or t
  misc_feature (291)..(291): n is a, c, g, or t
  misc_feature (298)..(298): n is a, c, g, or t
  misc_feature (327)..(327): n is a, c, g, or t
  misc_feature (477)..(477): n is a, c, g, or t
  misc_feature (555)..(555): n is a, c, g, or t
  misc_feature (574)..(574): n is a, c, g, or t
  misc_feature (578)..(578): n is a, c, g, or t
  misc_feature (605)..(605): n is a, c, g, or t
  misc_feature (659)..(659): n is a, c, g, or t
  misc_feature (677)..(677): n is a, c, g, or t
tggcgcgggcngtgacgctggcccggagggacgacgacccctctctaaggcacgcgtggcgcngctgcagtttggtggccccggcgagcagcaggtggccttcccgctgagccacaacctnacggccatccacgaggcgctggagaccacacaatacctgnactccntntcgaacgtgggggaaggcgtggtgcacgccataaatgccatcgtgcgcagccgcgtggcggggcccgaaggcacgaagggctgtccttcgtgtacctnacggacggcgtaacgggnaacaanagtctgnacgagtcgggaactccatgcgcaagcagnacgtggtacccaccgggctggccttgggcagcgacgtggacatggacgtgctcaccacgctcagcctgggtgaccgcgccgccgtgttccacgagaaggactatgacagcctggcgcaacccggcttcttcgaccgcttcatccgctggntctgtagcgccgccgcccgggccccgcagtcgagggtcgtgagcccaccccgtccatggtgctaagcgggcccgggtnccacacggccagcaccgcngctnactcggacgacgccctgggcctgcacntctccagctcctcccacggggtccccgtagccccggcccccgcccagccccagntctccccaggccctccgnaggctgccgggcctccctccccctgcagcccctccaaaggctcctgacctacctggcccttgagttctggagcacggccctgacccattaaaggctttgaacc

SEQ ID NO: 530794 - DNA, 934 bp, Homo sapiens
cgagcggcggcggcggcgacagcgtgcgagccctggtcgctctggagaaccccgcaggtgcggcccgcaggcggcggagggcgccccggtcgggcggcggctggtgccccttcccagctgcctgccgtgccctaaccagctctccaggtgaagagacgtctcggccttcgcaggacggtagatacatgccagcttcatcaacacatggcagctgcggaagctcagaacctctgtgcccaatggccatatggtggcgcgaagagcctccagcgtcctggagaacatcccagtacctcctgaccctgctggagacagacgggggcccgcctggccttggaggattggggacttggtaccccctgtcatctaccatggtcatctttgccgaggcctgcaacaacgccacactatgtggaggcctggaagcgactttcatgaatccgctccggtggaggagcacggagcgggttcttcgctagcctggaggatgagggcaggagcaaggcgcggaggaggggccctggccgtggggaggaccggaggagagaggaccccgcctatacaaccccgcgagtgcttccagcgcatcagccggcgtctggcgagccgtcctcaagcgcagtcgtatccccattggaaacgctggagacctgggaggagcggctgcttcggttcttctccgtgtccgcccaggccgtgtacacagcaatgctaagacaacagcttcgagaggcttctgctgcacgctgtctgccagtacattgacctcaatctcgtgccagtgctgaacctggagggggtaagcggccgattgaagggtcaggtaatcggcagcttggatttcctgtctgccgggctgctcctggccggctacctggagcagcaccggtgatgtgggcccggcgtaacccggtgcaccttgccagctcagcct

SEQ ID NO: 530795 - DNA, 245 bp, Homo sapiens
  misc_feature (8)..(8): n is a, c, g, or t
ccaagccngacgcagtgcagcctgacagcctcccctacccccagtacctgggggtcatcaaagcccaaatttcctgtgccaaggacattcaccccgccctgttggattgtgccaacaaggtcacgggcaaaacacccgccccccctgttggccctgggggccctttttaaagtgggggacagggagtggggcagccagtggttggtgggtggtgtgcaaacggaataaaaagcgtcctgggccta

SEQ ID NO: 530796 - DNA, 113 bp, Homo sapiens
aaatccgctctctactaaaaatacaaaaattagctgggcatggtggagggatgccgtgtaactcccagcgtactcaggagtctgtagacagtgaggaatcgtcttgatacctc

SEQ ID NO: 530797 - DNA, 793 bp, Homo sapiens
cggcaccccgtgggcccccgctcgacttccttgagtcgttgttcccgccagcaccttcttctgggcacgtgacgtgcccttctggtcgcttcagctgctgccttccagggtcttctgctgctgtagaccgccaccgaccatctgtacccacaggggagtgagggatcaggcctccaggtgggagccccaggagcagaggaagaggtggaagacttcctcatcgcactgcaagatgccaccaagccaggcagcaggtaccacccctggtccagaccctaaggcctatcagcttctatcagtcccgcagtgcctgcctgctgggcctgttggccgcacacaacgcgctgaccaatggcgtgctgcctgcccgtgcagcagctttttccgtgcttaccctacgggcgtctggcctaccacctggctgtgtgtgcttgggcaggtgctgccaatccccttggcctgctttcctgggccatggttgtgctgtgcaggtccttggccaagggctgggggggctcgtctctgctgggcgtgtctgtgggggctacctgatggcgctggcggtcctgaggcccctgcccgccctggtgtgcacctcggggggggttggcctcggggtgctgtcggtggggtgctgtgatcttggggtgttctccctacgtgaaggtggcagcagtcctgctgcatggggggggccggccggcattgctgggcagccgggtggccttcagggtggctcctggcggcgcctgtggtttttccccccgacaggattattcacgtgttcccagcg

SEQ ID NO: 530798 - DNA, 146 bp, Homo sapiens
cacagctcatttgaacgctgggtaaaaatccacagctgtattcttcaggatcactttgcagagtcttcaagactcagcatacaggggaagcttcaattcaaacctttccagaaaaagattcccagctcgcatgattctcatcaacc

SEQ ID NO: 530799 - DNA, 120 bp, Homo sapiens
  misc_feature (117)..(117): n is a, c, g, or t
cagggtctagctgttcaatggaatgccctttgaaagggaacagctagaccctgatgagttagaaaccatcacaatgcataaaatcctggagaccaccaccttcttccaaagagcggngtg

SEQ ID NO: 530800 - DNA, 1689 bp, Homo sapiens
aattaccagcactggtctctgctgagcctctgctcgttcctggcaaatcctgcaggacccgagtgtcagccagccagcagcatggctacaaaatgcacaaagtgtggtccaggttactccacccctctggaggccatgaaaggaccccgagaggagattgtctacttgccctgcatttaccggaacacaggcaccgaagccccggattatttggccactgtggatgtagaccctaagtctccccagtatagccaggtcatccacaggttgcccatgccctacctgaaggacgagctgcaccactcaggatggaacacctgcagcagctgctttggggacagcacgaagtcacgcaacaagctgatactgcctggtctcatctcctcccgcatctacgtggtggatgtgggctctgagcctcgtgccccgaagttgcacaaggtcattgaagccagtgaaatccaagccaagtgcaacgtgagcagtttgcacaccagccactgcctggccagtggagaagtcatggtcagcaccttgggggatctccagggtaatggcaaagggagttttgtgctgctggatggggagaccttcgaggtgaaagggacatgggagaagcctggggatgcagctccaatgggctacgacttctggtaccagcctcgacacaatgtcatggtcagcactgaatgggcagctcctaatgtcttcaaagatggcttcaacccggctgatgtggaggctgggctgtacgggagccgcatatttgtgtgggactggcagcgccatgagattatccagaccctgcaaatgacagatgggctgatacccctggagatccgattcctgcacgacccaagtgccacccagggttttgtaggctgtgccctcagctccaacatccagcgcttctacaagaatgcggaaggcacttggtcagtggagaaggtgatccaagtgccctccaagaaagtgaagggctggatgttgccagaaatgcctggtttgatcaccgacatcctgctgtccctggatgaccgcttcctttacttcagcaactggctgcatggggacattcggcagtatgacatctctaacccacagaagccccgcctcgctgggcagatcttccttgggggcagcattgttagaggaggctctgtgcaagtgctggaggaccaagagttaacctgtcagccggagcccctagtggtcaagggaaaacgaattcctggaggccctcagatgatccagctcagcttagatggcaagcgtctttacgccactacatcactatacagcgcctgggacaagcagttttaccctgacctcattagggaaggctccatgatgcttcaaattgatgtagacacagtaaatggagggctgaagttgaaccccaactttctggtggactttgggaaggagccccttgggccagcactggctcacgagcttcgttacccaggaggtgactgcagttctgacatctggatctgaaggctcgcactaggggcccccctccacattctgagcctgcctggcttcactctgctctcagccccaactctccaaggccactctgagaccagcgagatctgtagagcagcatctctgtaccgttgcttgttgtttgtgcttttcttaagtgagctcctggaagcaccaagaaataaaatgctgaaactt

SEQ ID NO: 530801 - DNA, 786 bp, Homo sapiens
taaagaaaagaacacttcacagataaagaagaggttctcttttaacctgtccctgattctgttccttttccttctttcaccctcttcttcttctcagaggcagttgggtctctaggccatgccttgatgatttaacggggtatatatatatatataattagtatgtggcttagttggtgtttcaaatttcacgtaaatttaatttataatattaaaaataactggtatggtacatatttggcaacttatttctcagtttggtttctgcgtgttattccacatagatcgggattattcatttcaagggtaatatccttttattggaatatatggtaccttatttatcctatggatagacatttttattcttttacaaacaataccaaatgtctccaggttctctaactaggaagtatacgtaaagggaggaatgctagggcatgggatgggcataattcacccttttctagatttggccaatcgttgcccacagtgcacatacttttccaccagtcacttgtgagagggcagattttccaaatgctcatcaccatttggcactgtgttggactataattggcccagttaggaaatggactctcatggtgtcatctaaattgggtaagcttgatcactcatggaaacctggtgaaggtggagaacctttgttaaagcttatgtgagcatcaagttcctcttttatgaatggtggcatgttattggcacctttattataagatgggttttttttaccggggcttgatagactcacatttatcaatataa

SEQ ID NO: 530802 - DNA, 281 bp, Homo sapiens
agatttccggagtttcttctttttcttttttcttgagacagggccttgttctttcacccaggctggagtgcagtggggcgaatcacggctcactgcagtctcaacctcccaggctcaagtaatcctttcacctcagccacccaagtagctgagacatgccaccaggcctggctaactttttttttttttatttctttttcttttaaaaaaaaaaaggccccgggggttttgcccccattaaaagttttttggggggggggcggtttaaataaaatttcccg

SEQ ID NO: 530803 - DNA, 700 bp, Homo sapiens
tagaggtgtgagccgtgcaccctgccccagtacaatctttttggaactcaaattttggccgacatctgagtgcacacaccacagtgtaaattatgccttatcagaatctaaatgaaaatagcgaacatttaaaagctatcaccatgtgtagtagaatcatccttcttttttgaaattttgaagcatcccaggcttaaaatctgtgtgtttcagaaagacagtttataccatgactgcttaattatccccccaaaagaccttctgattgaagtcatgtacagttcagtggcctaaattctctgccttttaaactgtgcttggaaagcctaactctgaaaataagtattcagtcaagttattctcaaagatgtcccagttgcctagaacggatcaaatggaacatttgacacacatactcaaaaaaatgtacctgatataaacattaaacctaatcatctgtatcaaatttctaaaaatcaaatctcaggatggtcccacttttcgaggattcctactgtaaaaggtttatattaaatctataactgtgtcaaaaataagcacctaatctatgcctttaaaaaattgcatttaatatctaagcataaaaatgtgttaattttataacacacacgaataatcatacataggaggaggagatttcgggaatgttgcaaggtatttttccgattaaattatttcc

SEQ ID NO: 530804 - DNA, 7432 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 530805 - DNA, 203 bp, Homo sapiens
  misc_feature (87)..(87): n is a, c, g, or t
tagaggatcccttaggcggttgaaggtagcagtgacggtgtagattagttcctgtgaactctgcgttggtgaaagtcacggtggccncttcataatccagagggatagccactctccgggggcgcagtgctgggaaaagctcaagctcggggctaggtgttgggccacgatgccgtgagagagggtacccgaggctccgaaat

SEQ ID NO: 530806 - DNA, 4041 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggtgcctcgggaccggctcaattcaaacatgtggtgctgaagacgggttctgtctgaacatgtcagggggcccctccggattgtgctttact

SEQ ID NO: 530807 - DNA, 190 bp, Homo sapiens
  misc_feature (100)..(100): n is a, c, g, or t
tcattgcagccctgagttcctgggctcaagtgatcctccacctcagccgtgagtagctgggcttacaggcacaagccactacacccatccagtgcctctngtgtgacccaagagaaatgagaccaagtaatgttgcaaaacaagttttgagagtttgagtgatgactgtgtgcctgtattttgatgtttg

SEQ ID NO: 530808 - DNA, 822 bp, Homo sapiens
  misc_feature (136)..(136): n is a, c, g, or t
  misc_feature (139)..(139): n is a, c, g, or t
  misc_feature (144)..(144): n is a, c, g, or t
  misc_feature (147)..(147): n is a, c, g, or t
  misc_feature (157)..(158): n is a, c, g, or t
  misc_feature (162)..(162): n is a, c, g, or t
ggcactcacctatagttccacctactcgggaggagaatcgcttgaaccgggtaggtggaggttgcggagggaggagaatcgcttgaaccgggtaggtggaggttgcggtgagctgagatcgccccactccatctanccngggtnacnaaaatgaaanncgtntcaaaaaaaaaaagcccacccgcagtgtagcacagggcaggccggtgctgtgggtgctgccagcacctgctcagagcccgaccccacacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggtccattctacgagcgatgccaccgagtgagggtcactccaatcgcatcctcgactccacctaccctctatctccctcataccgacactcacgactatcactcaccctatcacccatcgaggaccatctcttaggttcacaaccaaactctcacttgcacac

SEQ ID NO: 530809 - DNA, 323 bp, Homo sapiens
  misc_feature (4)..(4): n is a, c, g, or t
gtantgagatacgaaaggagcacagaagtcaaaggcatgcctctcacaaagtttcatccccagaggacgaagaggtcatgaaccttgcagaaagttggtcaggttcatagctggacggtgggtaccgaggtggaaaccattgccctccagaacaaccgtgagaaccatgcattcagcttactgtatgagcccaatagccaatgggtacaagtactaccgacagaagctggaggagtttcggaaagccaaggccagctccacaggcagcttcacagcacctgatcccggactgaagcgcaagtcccctcctgaggccctgtcag

SEQ ID NO: 530810 - DNA, 689 bp, Homo sapiens
ctcacagatgctgaccacggagagcccacggaccaaccatcagagagagctcgtggctgatctgaacggggtcgagccatcgtactgtaaccgggcgcgtactctacatagtgtaccggtacataattaaggcgagagctgtgagggtgaggatggagacgaaggccatatgtcttcttcgggcagcacggttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcaccgagtgagcacagacaggacaacaggagggtcaagtcgaaccaatagacaaaaaaaaacacagaagagaggagaaaagag

SEQ ID NO: 530811 - DNA, 744 bp, Homo sapiens
  misc_feature (107)..(107): n is a, c, g, or t
  misc_feature (113)..(113): n is a, c, g, or t
  misc_feature (177)..(178): n is a, c, g, or t
  misc_feature (325)..(325): n is a, c, g, or t
  misc_feature (626)..(626): n is a, c, g, or t
  misc_feature (672)..(672): n is a, c, g, or t
  misc_feature (677)..(677): n is a, c, g, or t
  misc_feature (695)..(696): n is a, c, g, or t
  misc_feature (699)..(699): n is a, c, g, or t
  misc_feature (701)..(701): n is a, c, g, or t
  misc_feature (712)..(712): n is a, c, g, or t
  misc_feature (716)..(716): n is a, c, g, or t
  misc_feature (740)..(740): n is a, c, g, or t
gtcgaggtctgggcttgggaatgggtcagcgggaggcctgaggtgcgccgggcgctgcggcaggcgggcccggggtccagccgagaggctcccctgggacctgtggncgccgnccacagaccatgctcctggggcgcctgacttcccagctgttgagggccgttccttgggcaggcnngcgtccgccttggcccgtctctggagtgctgggcagccgggtctgcgggcccctttacagcacatcgccggccggcccaggtagggcggctctctccctcgcaagggggcccagctggagctggaggagatgctggtccccaggaangatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaatccaccacaagtaccggaagctggtgaagaagacgcggttcctgcggaggaaggtccaggagggacgcctgagacgcaagcagatcangttcgagaaagacctgaggcgcatctggctggaaggcggggctaanggaangcccccgaaggctggcannacncncaagatctacntggngggcaaactgagtccttggcgccngccc

SEQ ID NO: 530812 - DNA, 8045 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 530813 - DNA, 740 bp, Homo sapiens
  misc_feature (103)..(103): n is a, c, g, or t
  misc_feature (109)..(109): n is a, c, g, or t
  misc_feature (173)..(174): n is a, c, g, or t
  misc_feature (321)..(321): n is a, c, g, or t
  misc_feature (622)..(622): n is a, c, g, or t
  misc_feature (668)..(668): n is a, c, g, or t
  misc_feature (673)..(673): n is a, c, g, or t
  misc_feature (691)..(692): n is a, c, g, or t
  misc_feature (695)..(695): n is a, c, g, or t
  misc_feature (697)..(697): n is a, c, g, or t
  misc_feature (708)..(708): n is a, c, g, or t
  misc_feature (712)..(712): n is a, c, g, or t
  misc_feature (736)..(736): n is a, c, g, or t
gggaccagacgccccagtcccggcccgcaccgcgactactgaaggcgctgaccgctctgacctgaacgggcacttgtgttccagctcccctgggacctgtggncgccgnccacagaccatgctcctggggcgcctgacttcccagctgttgagggccgttccttgggcaggcnngcgtccgccttggcccgtctctggagtgctgggcagccgggtctgcgggcccctttacagcacatcgccggccggcccaggtagggcggctctctccctcgcaagggggcccagctggagctggaggagatgctggtccccaggaangatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaatccaccacaagtaccggaagctggtgaagaagacgcggttcctgcggaggaaggtccaggagggacgcctgagacgcaagcagatcangttcgagaaagacctgaggcgcatctggctggaaggcggggctaanggaangcccccgaaggctggcannacncncaagatctacntggngggcaaactgagtccttggcgccngccc

SEQ ID NO: 530814 - DNA, 148 bp, Homo sapiens
  misc_feature (31)..(31): n is a, c, g, or t
atgggacgaatatgcgcatcttgctcccatnagacgttcctcctccagatactgtgccattttctctgaatgctgtaactgagcagctctcagttgcttcttcagccgttccacttcattctttaaaaacctgctggagaagactgcg

SEQ ID NO: 530815 - DNA, 7876 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtgctacgcactctgcggctattacggaaactcggagacactagaattgacgacttgaagactacttgatggtgacaactcacaggtgcctatcgcctaagaacatgtaatgggccctttgcgccacgagatgcttgcgctaggactttgtgatctggccaatcgataattatagcagttgattgaggtg

SEQ ID NO: 530816 - DNA, 8309 bp, Homo sapiens
  misc_feature (7594)..(7594): n is a, c, g, or t
  misc_feature (7633)..(7633): n is a, c, g, or t
  misc_feature (7637)..(7637): n is a, c, g, or t
  misc_feature (7647)..(7647): n is a, c, g, or t
  misc_feature (7651)..(7651): n is a, c, g, or t
  misc_feature (7653)..(7653): n is a, c, g, or t
  misc_feature (7655)..(7655): n is a, c, g, or t
  misc_feature (7664)..(7664): n is a, c, g, or t
  misc_feature (8308)..(8309): n is a, c, g, or t
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatcccacaaacgagaaagagagaaaaanaaagaagaaaagaagaaaagaaaagagaaaaagaaaagncganggaaaaaganaganananaaaaggaanagaaagaagaagaagacaggaaaaaaacagaaagaaaagaaaagaggacggggcgcgggggagcgaggcgagagggaggaagagggggagaagcggcaggagaaggagagtgggtgagacgagcgaggaggggcggcgggggtagagcgggggggagacggggaaaaggaggaagaggagcgaggggagagaggggggacaagagaggagaggagacgggggggaaggggcgaggagggggacgggggcagggggacagcgggggaggagagggagggaggagggagcggaaggaggagaggcgagcaccggggcacgcgcgagagccgacaggcgcgaggaggacaaacggagagaagaagagcccagaacgacaagaagagaaagacaggaacaggacagacacggcagccagaaaaggaagcgaaacgaaacggcagaagccaagaagacgagggaacgagacgatggagacggaagagggcaggaagccagaagagggagagaaagggagagcagaaaagacggacaacgagagaagagacagacggaaggggacggcagcacgaaggaggaaaaacagagcaggataagaaccgaagcccgcacgcacgtagagagggccgtgtcggctgcctgggggnn

SEQ ID NO: 530817 - DNA, 7630 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatcccaagggaaggacagaccgggaggaccgatggaaaaggacggaggcagagagggaacagtg

SEQ ID NO: 530818 - DNA, 8986 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaacacacatagggagcacttggagggaaggtggggaaggtatgataagggcatccttcgacgaggatagctccgaggagacgagccaggccttgagacgaaagcgagaggggaaaagaggacaacagtagcagagcacaaactagggaagagagaagagaagagaaaagcaagcaataacaaaaaccacaaaagagaacgcaaaacacacaactgacaacaccgcggagcctcaccagaaaccgctgctccaccaccagacaacgagaccaagacgagaacaacgactaggacaccaaagacacacagagaaccagcaccacacatcgacgaacacactcaagaaaacgaatgcagacacaaaccagacaccacacgagccacaaaaacacaccaccaaaaacgaacaagctgacgcaagcatagggagacgcccacccgcgacacacagacaggggaacaaaataaccgggggaaaaaacgacaaaccaacaaacaggcgagaggagacgcgcaagaaagacggcaagaacaaccgaaaagaagagaagagaagcgaccaggacagcccacctgaggagagacacaaagagacaacggggagccaccaagaatcgtacgacaagggagagccaccggagaggcaacacagagaaaacaccacaacgaaccacgagggagggaagcagaaaccaaagagagcgcgggcgacaccagatacaggagggcgcaccgaagaaacgcagaaaaagacgactagagcaaatgcacagcgacccaggccacaccacacgcgcgacacaaacaacaagggaggacaacaatggcggcagaccaagaatcgaggcgcaccacaaacaacgcaaagcctcagcgcgaaaccaagtcagaaaaagaaggatgcaaaccaggacaaagagcaaggccaccccaaccccagacaaacgcgcaagaacacacatgaacatcccgcagaagcacaagacaacaccgaaccagcaaaaacccaaagcgggagcacaacacggacacacacaaaacccagggaaaaaacgggaccaaaacagcgctaaaaaaacaagcaaagagagacatacagacccggaaagataggtgacgaccacaaaagagaaggagcaaaaagcaagggcaaggacagaagacaagcccagaccaacaaacgaaacaagcgacaacaggggaggcgagagcgaagcagaccaacgggacgacccccggaagaacaacaaccaacagaaaaagagcagacgaagtgcagaaaaagagagaagacacataggcgagaagagagaaaacgaacaacgaaggaaacactaacaagggtaagacacaacagtcagcataaaaagggcagacacgacaaggaccacgaggaaggaggaagaacag

SEQ ID NO: 530819 - DNA, 266 bp, Homo sapiens
gtagctggggactacaggtgtgtgtctctatacctgctcatttttctatttcttttgtagagacagggtttcatcatgttgctcaggctggtctcaaactcctgagctcaagcagtctgcccaccttggactcccaaagcactgggattacaggcatgagctaccatgcccgaccagtatcagttcttttatggcatttattagctgtaaatgctattgatcctatatgtaatcaattaggattggactttgtggtttgaataatc

SEQ ID NO: 530820 - DNA, 8419 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatcccaccggagtggcagtgcaagtgaaggaagaagtagcagaggctgcaggtccagggtggacctgctggaggagaacgctgcagctggtgactggcccccactgcacaggccggggccgacgcagggcactggagcatgggctccccggaaccccaggcagccgtccatggatgcacatccatatccagaaagactcaggaacgcaatcagactaccctgagacagagcaagcatgcctatcacaagcgagggagcagcatggggtacctagcatcacacgcacacacacaagacgtcgcacgacatggacccaaggcgcgacacacaggcgcatgagaacactggacgccccccctacagcgaccggaacccatgacaagcaccaccaattcgcccccctagcgcacaacacgaatagacacgaggagcgaaaccacagaaacagcccaaccccaccagagcggattcgacccctagaacccggcgcacacgaggcacacaaacgaacggaaacacgaaccacagacctactacccacaccgataacaccaagacataccaacgaaagcaagagcaccacccacaccgaaaaacaccctgacgacaatggcgcgaacgaccgacgagagcgcaacacaacaaaccagagagaaaacttaccaccgaccaacggagcagacaaaacacaaacaacaaccaagcaacctacagacccacaagcggtcaagccagccaaaacgacacaagagacagagcgcgcaaacctgagaaaccagaccgcgcgaaacgagagaacacgaaagggacgacagacaggctacgggaagacacaccgaggaagaacacccac

SEQ ID NO: 530821 - DNA, 400 bp, Homo sapiens
ttggggttcctggataccagtcaagcattccacagtccaatgacgtcagtcgcagagcacagtaggtataaaagacaatgtgtgaggtacactggcaattggaattccgactattttccataaggattcatgaaactacactattctatttaaaatgattaacttactttaacaatccttctgaagatgtactaaggatgacctgcattctcttctgtttctctttatctttcagattgaacagtacgtgacatccgatctacgcttaccttctttttcctctggcagctttagtaggttctgaaggatagttcatcaagcttagtatctgatgctggacactaaagtcagtacagactgataactcttattcagtgtctgcttcttaaatagcatcctg

SEQ ID NO: 530822 - DNA, 274 bp, Homo sapiens
ggtataactaaccacagcttacaaggcactggttgtggcacaatgatttactcaaagcgaagtgaccacgcacgagcagggcaggtaagcggcgaattttgaccccgcttgcgcttgggatacagggcgaaacgagttcaccatggcaagttgtcattatcatctcgtttcgcaatatttatcacgccgattatgtaatatctaacacccataatcagatatagggtaaccagtatcttgaatgtaaatagggtcatatgtaaatcactccttt

SEQ ID NO: 530823 - DNA, 244 bp, Homo sapiens
tttgattacatttttatcacacttgatttactgaagaaaaatggtttggattttgattgtactaaccacacatgtaatgaattaacaataattataagtggcacaagtgcatattatgatgtgatattttctgtatggtgttttaaatggaagttttggattacacacagttatttttgttacattttaaaacccgttgcttttaacctacctaataaaagttgctcctccacaaaaaaaaaaa

SEQ ID NO: 530824 - DNA, 497 bp, Homo sapiens
tgacggtaccaacagatcaggaaggtgaagagattgctaatgagatgatgaggcagcaaggcgtctatacccaggatggcccccttggagcagcgaaagccatccaggcctacgggctgtgttggatgagacctatcctgaccctgtgcgagtcgtctccatgggggtcccggtgtccgagtggctggatgacccctctgggcctgctggctccctgacttctgtcgagttctgtgggggaacgcacctgcggaactcgagtcatgcaggagctttggtgatcgtgacggaagaagccattgccaagggtatccggaggattgtggctgtcacaggtgccgaggcccagaaaggccctcaggaaagcagagagcttgaagaaatgtctctctgtcatggaagccaaagtgacggctcagattgctccaaacaaggatgtgcaaagggagatcgctgaccttggagaggccttggcattgtagtcaatccccagtggc

SEQ ID NO: 530825 - DNA, 780 bp, Homo sapiens
tttttttggaggggggcagctatttaatttacaagtatacttttaacacaatgaaataaacacggatatactgaagcctagttaatagtagtggtaacaatatgcatcatttggatgatccccattatttaaaacaacaaactacccctgaaaaatgaaggccgataaaatcctgggccataatatcaagaacatacaatatataaatggaacaatatgatggcttcacaattggaaaagggaagtgaactcattgggacagactcagagttacacataatctgaagggaggggagctctggacccaaagtgatatcttccaggttaacagaagaaaaaagaacgcatagtttatctccagggagaacgggcagttggcttcttcaggtagaatatattcccagggtcctcaggcttcggcagcagaatcacatcaccgagcatgaagactcgcctggtagaagctgccccgtccatttctcctggcctccaaaattatccttcgaaaaacatccacgagccagtcggatttctcttatagcagaagatccccaaaaaagcggtcatcccaagatctcgggcaaagcttccgcttcttcataacggatcaccctttccatatgcgggtctttcttatcacaaccaacataataggtatggtccttcccccccacatatccaacaatttgccctggctcacttaatccctccacacttcgcttggtgctcccgaataccaagatttacgctatatcacggcgctctgctcgggaccaacca

SEQ ID NO: 530826 - DNA, 242 bp, Homo sapiens
ggctgactagaggactcgcaaaacccgtctctactaaaaatacaaaaaattagctggatgtggtggcgggcacctgtaatctcagctacatgggaggctgaggcaggagaatgtctgaacccgggaggcagagcttgcagtgagccgagatcacgcactgcactccagcctgggcgacagagcaagactgtgtctcaaaaaaaataataaaattagaaaatgttaaaataagaaatctaccg

SEQ ID NO: 530827 - DNA, 152 bp, Homo sapiens
tggaaagaatcttaagcgggtaacagtatacagacgcagcctacacacgatactgtacctttcacttcatcttgcccttcattattgcagacctagctagcactccagctcctattcttgcacgacacgggatcaaacaaccccctaggaat

SEQ ID NO: 530828 - DNA, 284 bp, Homo sapiens
atagtcacgtgtgggttagtatcaaaactcacctaaccagaatacagagggaggtaatgactgcctacaagttcggcatgatagaggcctacagaaatgtctccaacctcatctcctatcactctcccccactcactcactccagcaatccagaattatctgctgtttgtttctttccttccttccttccttccttccttcctatccttgcttccttccttaccttacctttcttcctttctatatctattctttcttattagagacagagtactccctctata

SEQ ID NO: 530829 - DNA, 884 bp, Homo sapiens
  misc_feature (1)..(1): n is a, c, g, or t
nggcgtgtcttggctgcgcccccctctttctcacctgtcgcgtgtccgggtgtacctcgcgccggagcttgttcgctcgattttcgcgcttgctgttatgcgagagtttctgccctaaccgaccctggggtggttgccagccacccccgcccccccgggggtccacccataccgggcccgggcattttatccctctccgcccagggacttattatgtcccgcgccctcggtggggagcaccttctcgaagaaggcgggccacccctctttaccggggggtggctccccactcggcggaatccgggggcccatttcagctttctcttccccaggcgcccatcattcatgatcttacagccccgttcgttttccaaaggacccactccgccgcggccttcacgttccgcccccgagtaattcctcctcgctcgttcttcttcctcctgggggatctccccgcagtgtttttccccgccctcctctccgccgtatgtagcccccgcgagtactttattataaccggtggccctttgtcacccaacccccgggcaccacgagttccccactgttgtcccccggggtgagtcgggcaccacgcaagtctccccaagtcgggggccacctcggtgtccccccccgtcttgggcaccctcaaggcttgcacagaacgcgtttcgtgaacgccaatccgtgtgtttacagagtttgcttgtggaacgctcagcgtcgcccgcttccccctgttgcctgatcggcttgcgccctctgttcagaagccggggtgtgctgggggcacagcttttacatgtgggtcctgcctccgtacctccaatccctgaaccccgggcccgggttcccccgcaaccgaccccctcccacaagca

SEQ ID NO: 530830 - DNA, 156 bp, Homo sapiens
gcctgcattgcccctagttgatcccccagacacaataggcgagttgaacagtgttgagacaccacggtctcctcccagctggcaagagccacccccgaaaccacctccatagctggcagaggagctctgcaggcgtggggccgctggctcgagggg

SEQ ID NO: 530831 - DNA, 248 bp, Homo sapiens
gtacaatccagccacggttctgatctccaggaaagcattgctgtggtacaaaaggacaagggttaaaagggaacagtgggagctctctttcccaacgaagtcacgcagtgtgacgcacaggctttcagcacagcccaggaagcaagtgggcacactccaagtggggcagctctccgtacatgcgccccacccccgtgagccagttcagccctactgagggctgagcgggggcatcccctcctttgttg

SEQ ID NO: 530832 - DNA, 111 bp, Homo sapiens
gcatttgcttggagcgatttggcctgcctcactgtcggaggctgaggggaaggcgaatcgcttgaaccggaggcagaggtttcagtgagtcaaaatcgcaccgattcactc

SEQ ID NO: 530833 - DNA, 565 bp, Homo sapiens
gaggagacacaggcgctggctgccccgtccgctctccgcctccgccgcgccctcctcgcccgggatgggcccccccgccgccgccggatccctcgcctcccggccgccgccgttgcgctcgccggctcgcactgaagcccgggccctcgcgcgccgcggttcgccccgcagcctcgccccctgcccaccccgggcggcgtagggcggtcacgagtgcttgccgcccttaccctcccgcctcgggctgcgtgctgctgctgctcctgtgcccggcgcacgtcggctgtgactgtggtgggctgtgggcagcccttggttatggaccctaccagcatcttgcaggaaggtgcactggctgagcatggaaccgggctggcatgagccagagttgttgccatggcttgagcctgcgaaagtgcgtggcagaagctacgctccggggcgcccgagctcggggtgcgatgagtgccagttccaagttccgcttcctgccgcttggaaatttgtccaggcatcagcaaaggcttttggactgcatcctgcaacacggacaatcgggagaccg

SEQ ID NO: 530834 - DNA, 435 bp, Homo sapiens
  misc_feature (138)..(139): n is a, c, g, or t
  misc_feature (145)..(145): n is a, c, g, or t
  misc_feature (148)..(148): n is a, c, g, or t
  misc_feature (151)..(151): n is a, c, g, or t
gcatgctcacgcccgagatccagtacctgatggacctcggcgccaacctgtgggtcaccaagctctggaagttcattcgcgatttcctgcggtggtgacgtcccaccgcccagcggcttgcctgcctttttggggggnncctttnccnggnctcccctgcagaggggctgagcaggacgccgctggtgctggccgcccccagccccctcctggtgccacctcagaccccggggtgagggggggctccctggggggaggcagccagccaagactgggcccatgaacacagagagggcctaaccgagatcagtatttaactaattataccagtttttattaaacccctttccctccccgataaagaatgttctatttctgcctccccttaaaggggagacctcagaagtaaaggaatttgatgttgtgtttttgtta

SEQ ID NO: 530835 - DNA, 816 bp, Homo sapiens
  misc_feature (413)..(413): n is a, c, g, or t
  misc_feature (417)..(417): n is a, c, g, or t
  misc_feature (460)..(461): n is a, c, g, or t
  misc_feature (472)..(472): n is a, c, g, or t
  misc_feature (475)..(475): n is a, c, g, or t
  misc_feature (483)..(483): n is a, c, g, or t
  misc_feature (485)..(486): n is a, c, g, or t
agtctgggatcaatcatttttactagaaggcttcgttccttttttttatttttatcttttgagacagcgtttcactcttgctgcccaggctggagtgcaatggcacgatctcggctcaccgcaacctccgcctcccaggttcaaggtgattctcctccatcctttatatcacgtcttgcacaagagtgtatatagtcaaatactgtgcttataaatcacttgaattagttctttttctcttcacggctttttttcccccccttatctttcaataactttggtatcagggtagttattatagtaatatgaaatacaattggggccgggcgcggtggctcaggcctgcagtctcagcactttgggaggccgaggtgggcggatcatccatctgaggtcgggaatttgagaccagnctgnccaacacagcgaaaccccatctctactaaatatacaacaattnnctgggtgtggnggnagacaccngnnatcctggctacttgggaggctgagacaggagatcacttgaacctgggaggcggagggtgcagggagccaagattgcagaattgcacttcagcctgggcaacgagagtgaaactctgtcttatggttcagggttaaaaaaaaaaaaaaaaaaatctaagtcccaagcccgtatgggggaattgaccagtggccaatgaatatcttctgaaatactaaaccgaattggttgggactgtgaaataatttccatgtctttatttcaacaaccgcacactgtattggctttttaggattgacaattccatgtgtgtgcctgtcttcctgccttaa

SEQ ID NO: 530836 - DNA, 761 bp, Homo sapiens
  misc_feature (307)..(307): n is a, c, g, or t
  misc_feature (321)..(321): n is a, c, g, or t
  misc_feature (350)..(350): n is a, c, g, or t
  misc_feature (368)..(368): n is a, c, g, or t
  misc_feature (551)..(551): n is a, c, g, or t
  misc_feature (608)..(610): n is a, c, g, or t
  misc_feature (644)..(644): n is a, c, g, or t
  misc_feature (646)..(647): n is a, c, g, or t
acaaaatggcgcctacagcctactggtgactcggctgcagaaagctctgggtgtgcggcagtaccatgtggcctcagtcctgtgccaacgggccaaggtggcgatgagccactttgatgcccaacgagtacatccattatgacctgctagagaagaacattaacattgttcgcaaacgactgaaccggccgctgactactctcggagaagatttgtgtatggacacctggatgaccccgccagccaggaaattgagctgaggcaagtctgtacctgcggtctgcggccgggaccgtgtggccatgcnaggatgcgactggnccagagtggccatgctccagttcatcagncagcgggcttgtccaagngtggctgtgccatccaccatccactgtgaccatctgattgaatgcccaggtatgggggcgatgaaagacctgcgccggagccaaggacatcaaccaggaaagtttataatttcctggcaactgcaaggtgccaaatatggcgtgggcttctggaagcctggatctggaaatcattcaccaganttattctggaaaactatgcgtaccctggtgtacttctgattggcactgactcccaannncccaatggtggcggccttgggggcatctgcattngnngttgggggtgccgagtgctgtggatgtcagtggctgggatcccctgcgaggttgaagtgccccacggtgattggcgtgaaggctgacgggctctctctccggtaggtcctcacc

SEQ ID NO: 530837 - DNA, 561 bp, Homo sapiens
  misc_feature (38)..(38): n is a, c, g, or t
  misc_feature (83)..(83): n is a, c, g, or t
  misc_feature (101)..(101): n is a, c, g, or t
  misc_feature (106)..(106): n is a, c, g, or t
  misc_feature (141)..(141): n is a, c, g, or t
  misc_feature (156)..(156): n is a, c, g, or t
  misc_feature (175)..(175): n is a, c, g, or t
  misc_feature (186)..(186): n is a, c, g, or t
  misc_feature (206)..(206): n is a, c, g, or t
  misc_feature (221)..(222): n is a, c, g, or t
  misc_feature (232)..(232): n is a, c, g, or t
  misc_feature (261)..(261): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (342)..(342): n is a, c, g, or t
  misc_feature (351)..(351): n is a, c, g, or t
  misc_feature (369)..(369): n is a, c, g, or t
  misc_feature (398)..(398): n is a, c, g, or t
  misc_feature (497)..(497): n is a, c, g, or t
  misc_feature (520)..(522): n is a, c, g, or t
  misc_feature (526)..(526): n is a, c, g, or t
tttattagtgtgtgtggttgacccttggcgtataccantgtcagtctgagtggtctctcactcctttgtttataagtgaatgnttgtgcatgttttgtctntcatngtatgtcctcacataaaagggggggagcgaaaaancattacattaagatnatattggaccacaccactnacttgctctanacagtacttgtaccccttancctgtcttcaaaagnngcatatagtnacagtagtgtataaattaaatattgtggnaaacagtcttgtattttctgtatgtgngnanatatatataattatgtacttctggcaattctatctgtatttaaagatgtnacaatcttnacaccaattttaagaatngctgtgagaccgaattaagataatccctnccaagtgaaaattgatgtgtgttaagagggtacagaattatcaactgatttggtcagttgcttccaatgctggttgatttccctcattgtgtaacattnacaggtatgtgacaaatgggaannnaaanccaaataataaagtgacatattggtgttcagcaat

SEQ ID NO: 530838 - DNA, 196 bp, Homo sapiens
  misc_feature (184)..(184): n is a, c, g, or t
  misc_feature (192)..(192): n is a, c, g, or t
tatcgagctggtaccgcgggactgccctcgcaggctgctggcatcaggtatacgggactcatccctccctttcctgccagctcccaccattgccctgatgggggctccagctcctgcccccagcatggggagtctggcccaaaggaccatctgtaaacacttgttccgaatccaatggctgccnctccccangaag

SEQ ID NO: 530839 - DNA, 200 bp, Homo sapiens
  misc_feature (14)..(14): n is a, c, g, or t
  misc_feature (21)..(21): n is a, c, g, or t
  misc_feature (153)..(154): n is a, c, g, or t
  misc_feature (179)..(179): n is a, c, g, or t
  misc_feature (195)..(195): n is a, c, g, or t
gtgacagaagaagnctccgtntccaaaaaaaagacaaaaaaaaaaaaaaaaaaaaaaagacccaaatagaggctgggcacggtggctcactcctgtaaccccagcactttgagaagctgagatgggaggatcgcttaaggccaggagttcgannccagcctggtccatatagtgagacngcccatctctgttganagaaa

SEQ ID NO: 530840 - DNA, 417 bp, Homo sapiens
gcgtcgacccacagaatgtcccaaatgactctcgggaagccatgcccatctctcttcagtgctttttggacttgggatgaatcgtgtgagttttcagtctccctcagttgccccgtgtggcggcacatctgcattgctgcaggggagcagttttgcttcatgcaggcctgggctgggcctacctccctcccgaaccttgagcttgctcatggaagctctttctcctccaggtccccccagcggcttcccatgcacttgcccctggggagaattgcatgaaacacacacatcgagtgccgggcgcagggtcagaaccaggatcggtcccgctccggggtctgagatggagagctggttcttctttcagaactgcttccctttactggggtgtggtggctcacgcctgtaacccagcac

SEQ ID NO: 530841 - DNA, 165 bp, Homo sapiens
aattcatctttaggattgttggaaaacatctttcaaaaaggcatcttcttcggccaaatgtagtgatttgctaccggcagcaacagcaccacttgggtttctaccacagtatctgaccttgaaatccttatatttatcccgttcttttaatgttgtgtgtaagcg

SEQ ID NO: 530842 - DNA, 934 bp, Homo sapiens
  misc_feature (26)..(26): n is a, c, g, or t
  misc_feature (155)..(155): n is a, c, g, or t
  misc_feature (169)..(169): n is a, c, g, or t
  misc_feature (175)..(175): n is a, c, g, or t
  misc_feature (270)..(270): n is a, c, g, or t
  misc_feature (329)..(329): n is a, c, g, or t
  misc_feature (332)..(332): n is a, c, g, or t
  misc_feature (524)..(524): n is a, c, g, or t
  misc_feature (609)..(609): n is a, c, g, or t
  misc_feature (615)..(615): n is a, c, g, or t
  misc_feature (706)..(706): n is a, c, g, or t
  misc_feature (728)..(728): n is a, c, g, or t
  misc_feature (870)..(870): n is a, c, g, or t
  misc_feature (874)..(874): n is a, c, g, or t
gatgaagtagaattgcacgcatcaanaatgctgtggcaaggtcaccatggatggcgagtcaacggggcctcaacctctccagagccattgggaccacttctataagagaaacaagaacctgccacctgaggaacagatgatttcagcccttcctnacatcaaggtgctnactctnactgacgaccatgaattcatggtcattgcctgtgatggcatctggaatgtgatgagcagccaggaagttgtagatttcattcaatcaaagatcanccagcgtgatgaaaatggggagcttcggttattgtcatccattgtggaagagctgctgnatnagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcganaatagcagtcatccagacccctgcccacctagactgttttctgagccctccggacctgagactgagttttgtctttttcctttanccttancagtgggtataaggtgtgcagggggagctgggtggcttcactccgcccattccaaagagggctctccctccacactgcagccgggagcctntgctgtccttcccagccgcctntgctcctcgggctcatccccggttctgtgcctgtgctctgttgtgttggagggaaggactggcggttctggtttttactctgtgaactttatttaaggacattcttttttattggcggctccatggccctcggccgcttgcncccnctctctgttgtacactttcaatcaacactttttcagactaaaggccaaaacctaatcgta

SEQ ID NO: 530843 - DNA, 140 bp, Homo sapiens
  misc_feature (44)..(44): n is a, c, g, or t
cgtccttctgcagtggcgaagacatttgttgccctgtttactancacaaccaaagtgaaggagttggaattgccctcaaaacatgttcgagttctgggattgggtagggaggacgctactcgctgtcgggctagtcgggg

SEQ ID NO: 530844 - DNA, 956 bp, Homo sapiens
  misc_feature (26)..(26): n is a, c, g, or t
  misc_feature (155)..(155): n is a, c, g, or t
  misc_feature (169)..(169): n is a, c, g, or t
  misc_feature (175)..(175): n is a, c, g, or t
  misc_feature (270)..(270): n is a, c, g, or t
  misc_feature (329)..(329): n is a, c, g, or t
  misc_feature (332)..(332): n is a, c, g, or t
  misc_feature (524)..(524): n is a, c, g, or t
  misc_feature (609)..(609): n is a, c, g, or t
  misc_feature (615)..(615): n is a, c, g, or t
  misc_feature (679)..(679): n is a, c, g, or t
  misc_feature (685)..(685): n is a, c, g, or t
  misc_feature (728)..(728): n is a, c, g, or t
  misc_feature (750)..(750): n is a, c, g, or t
  misc_feature (892)..(892): n is a, c, g, or t
  misc_feature (896)..(896): n is a, c, g, or t
gatgaagtagaattgcacgcatcaanaatgctgtggcaaggtcaccatggatggcgagtcaacggggcctcaacctctccagagccattgggaccacttctataagagaaacaagaacctgccacctgaggaacagatgatttcagcccttcctnacatcaaggtgctnactctnactgacgaccatgaattcatggtcattgcctgtgatggcatctggaatgtgatgagcagccaggaagttgtagatttcattcaatcaaagatcanccagcgtgatgaaaatggggagcttcggttattgtcatccattgtggaagagctgctgnatnagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcganaatagcagtcatccagacccctgcccacctagactgttttctgagccctccggacctgagactgagttttgtctttttcctttanccttancagtgggtataaggtgtgcagggggagctgggtggcttcactccgcccattccaaagagggggntccctncttccctttccccctctccctccacactgcagccgggagcctntgctgtccttcccagccgcctntgctcctcgggctcatccccggttctgtgcctgtgctctgttgtgttggagggaaggactggcggttctggtttttactctgtgaactttatttaaggacattcttttttattggcggctccatggccctcggccgcttgcncccnctctctgttgtacactttcaatcaacactttttcagactaaaggccaaaacctaatcgta

SEQ ID NO: 530845 - DNA, 175 bp, Homo sapiens
gggagcccaggaaaacccccaagggcccatggttctttcccccttgttgggggttcaggcaactcccataaatttttgagtttcaatttgtttttttttcctgggggggtgaaatgtcccttcccccctgtttcccagtgtggtttttgggcccaaaagttgtgttttattccca

SEQ ID NO: 530846 - DNA, 222 bp, Homo sapiens
gtcggtaatcttctgagcaggtgtggagggtagtgttgtgtgtagcgagccagtgctgtgtgggtgggtgtagatgcctccagaggctgaggttatggtgtcgtcaggtaagagtgtggtttcagtgtcgcctgggctgctgtggaaggttgtagattgttgaccaagggatgaggctgtggtactgccagggaatgctgttgtgtgcgttgagcctggtcg

SEQ ID NO: 530847 - DNA, 163 bp, Homo sapiens
taaaagagcacaatgtaggtgtattggagtatttcaagaaaagaataaaaacattaatgcagtattaggttaactggatatcaacgtaagccctggtgaacagtgaaagtattataacctttttttaacgttctgaaaattaaaaataaaatttatttcgtgc

SEQ ID NO: 530848 - DNA, 314 bp, Homo sapiens
gcacgagccaaagagcagctccatattaaaaatgatttttgagggatagctcacacctgtaatcacagcattgtggaagccaaaacaggaggattgcttgaggccaggagtttgaaaccggcctgggcaacatagtgagactccatctttgcaaaaaataaaaaattagccaggtatggtgtcgtgtacctgtggtcccggctgctcggaaggctgaggtgagagaatcgcttgagcccaagaggtcaaggctgcagtgacctgtgatcgtgccactccattccagcctgggtgacagaatgagacccgtctca

SEQ ID NO: 530849 - DNA, 238 bp, Homo sapiens
aatataagttttttttaaagtgcaagaaaaatgaaaaaaccctcgatggaactacggtgcctcttactgccggaagcagatatcaaaggatgataaaataactagacaatgatgggtaggagtgataggaagttcactgtaagctcctataaccccccaacaccatcaccacatgcctaatacaacctgcagacacacttactcgcaacagacttgcaatctgggctctcttttcctt

SEQ ID NO: 530850 - DNA, 379 bp, Homo sapiens
tctacaaatagagaattcacaaaagcaagaagcagaatggtggttaccagaggctggaggatgggaatggggagatggggagatgatggtcaaaaggtacaaaggcacagttagacaagaggaataagtttttcttaatccactgcagtgtggtaaatatagttaataacattatattatacatttcaaaatcgctgaaagtacatttcgaatgctctcaccacaaaaaaataagtatttgatgtgatgggtatgttaattcacttgattaattattccacattttactcatgaatcataatttcactttgtaccccataaatatacactataatttgtcaatttacaataagaaaagtaaataaaatagaaacaagta

SEQ ID NO: 530851 - DNA, 410 bp, Homo sapiens
aaaaatgcaaaaaattggccgagcccggtggtgcatgcctgtagtcccaactgcttgggagggttaggcccgagattccttgaaccccaaaggttgagggtatgttgagctgagatcccccccctgtactccagcctggatgacagagtggaggctctgtttccaaaaaaccgaaaagaaaatataggttggttcttccttttttttaatttgccaatccccgggataaagtttgctaagtaaattaggaatggcctatagatataactggcccaaaattgttccacctaaaaccatctggaattgctttttgttttattggatactctttgtctttttaagacccctaatagccctttgtaacttgatggctttaaaaaacttaattaatttgccctttccaatttcca

SEQ ID NO: 530852 - DNA, 826 bp, Homo sapiens
gagcgggagggttcgagacaacctaccctccttccccattttcttgtggtccaactaccctcggcgatcccaggcttggcggggcaccgctctgtgcctactcccgtgtcctattagtgcctgccgtccgactgaccaatgccgctcgatgagcacgaggtttgaggccatacaatagagcacctatctaaatatgcaagttgagtgtaccttatatgcgtttggctcgtatcaaagagaggcttgagactcaaaactgtagattcctgcttccaagacctcaaggagagcaggctggctggaggacaccttcaccatagatgaacgtctctgaagtcctcaactggcttacaagctgtggttcatagtgaggtggacatctgagctcatcaacactgcctataccaatgtgttacttctgcgacagctgtctgcacaagctgagaagtggtatcttaaaggctacagacagacatctctgacacttgaaacaaccgcgcaactcattagaacaaagttgcccgactctcgacaacagcacgagattacatcttcaaaccacaccagccccatctttcaccatgctcaccaaagccaaacacttgcctaccaccttcaatgcacgcgtgcaacccagcagaccctccctcacaccaagcgacaactcggcaacgcccgcccccgcccgacacctggccgaacatccgcccgccacacggtcgacgaaccacccacactaccaggtccccaaccgccactggactgcacacgcccccaccacgaccaccgccctgcccacacccacaccctcgaccacgcaccccac

SEQ ID NO: 530853 - DNA, 239 bp, Homo sapiens
  misc_feature (228)..(228): n is a, c, g, or t
  misc_feature (239)..(239): n is a, c, g, or t
gcgacaaacctaccgagcctggtgatagctggtttgtccaagatagaatcttagtttcaacttttaaaatttgccccacagaaccctctaaaatcccttgtaaatttaactgttagtccaagagacagctctttgacactaggaaaaacctttgtagagagagttaaaaatttaaccacccatagtaggcctgcagccaccaatttaagcgcgttccaaggttcaacncccccaccttn

SEQ ID NO: 530854 - DNA, 201 bp, Homo sapiens
ttgctggagcggatcagcctgcccgactgacactctgccacttatcctctaccgtgcatttcttctgaaaatggatcgtgtccacataaaaaaaatccgcgttgcactggaccgacgatcatccaatgaatactggctgccgtcagcagcctgctgaacagcaccgcccactacgaggatggtggcggcagtcaactaccc

SEQ ID NO: 530855 - DNA, 256 bp, Homo sapiens
actaatctagagattactatagagtggatttgcagatataattgaagtcccagttgactgtaaaactatccaagatgagcataacatcaatacggggagccctattaaaagcagataatttttcatctcatcattccagatgcttatgggaggccaacggcaggaggattgcattgaggccagcaagttctgcagacctagccatggcctaaaatcagtgcagaccctagtctcatattcaaaacacaacaacaca

SEQ ID NO: 530856 - DNA, 143 bp, Homo sapiens
cgggctggtgagcactctcgcgagtattgaaggagcggcggatgccagagggagtgagacgtaccggaatgtccttcatctcaaagcatcaatgtctgaaattcggcctgattttcatctatccggcaatgcccttttccagt

SEQ ID NO: 530857 - DNA, 482 bp, Homo sapiens
atggatgtcactcctctttcccttggtattgtggaaactgcttgggaggtcaatgacttttcctcaatcaaggcgtaatacccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaggttcaccaagatcatttcgtcctttcctcaacatgaacactttggggtt

SEQ ID NO: 530858 - DNA, 1493 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaat

SEQ ID NO: 530859 - DNA, 1493 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
tggtcatttcggtcacgagggactggacgttgtcagctgataattactgtgcccttggctctgtcacattcaccagagaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaat

SEQ ID NO: 530860 - DNA, 1068 bp, Homo sapiens
cgtctcctatttaggatgggatactaatgccacatataaccgcaatcttgatttttaaaataaaactggaattaaattgttgtggttggggacagagggagagaaaagactagataatcaaattgctttttcccaaggacttctctcttccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaat

SEQ ID NO: 530861 - DNA, 2040 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaatggcaccataaaaaaaaaaaaaaaaaaaaaaaaaaaaaaaaaaaaaaaaaaaaaaaaaaaaaaaaaaagcaacaaaaaaatcaaaaacaccacacaaaaacaacaccaggctcccagcgacacacacgcaccaaaaaccactaccagcggaagcgaacccacagaacccccgacacaacgacacgccaaccacgacccccaacgaacccccagagcgcggcccgacggcgcccccgcgcccaccaccgcgcccccccgccgacccgccccacgctccgcgccaaccacttcaccgcaggccaccagcaacaaacccgccaaacacgagaacgccccgaacccaccaaccacccagcgaaccaacacacacaccacacaggacacaagaaccaccccaacgaaccggcagacgaacacaagatcgacaccacaacaccagcagtaccgaagcagaacagaaacaccacaaaccgcccacagaacgcgcctcgcacaccagcccctaccaacccgccacagcaggcgacacaacaacccaacgacacaag

SEQ ID NO: 530862 - DNA, 158 bp, Homo sapiens
atactacagatattagcaagcactacctccatgagaattcagtggtatagggtggatcgggtgtctagggtggtatagtcagtatcagaaaagcactacctccatgtagaattcacgtgtggggtaggtatagcttgggtaccgagactcgcaattcg

SEQ ID NO: 530863 - DNA, 830 bp, Homo sapiens
gactcgagaagatagcatctgaacatgcagacggaacagagttggagcaagcttgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaat

SEQ ID NO: 530864 - DNA, 1510 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
  misc_feature (1394)..(1394): n is a, c, g, or t
  misc_feature (1402)..(1402): n is a, c, g, or t
  misc_feature (1410)..(1410): n is a, c, g, or t
  misc_feature (1441)..(1442): n is a, c, g, or t
  misc_feature (1454)..(1454): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatattttnggagtaanaaattcanacaggggaaggcaataacaatgcacatgatnnacactgtcgttntaagtggaaaatgcaactgtcttaaatactaattaagatcgcccctatcgagggca

SEQ ID NO: 530865 - DNA, 1203 bp, Homo sapiens
cgccgttatctctgcccatcgcagcttgcgtgaccaactgtctacgagggtgcccgcagagctgcgcacacagttccggctctagcgctttcccactgtgggtcccttgcccagcacgggtaacgcgtaaggctacacgccggagcggtaaatctgttcccatacggtggtacccccgacggggggaccccccttggaagtcggaaccagtaggaagtttattcgggcagtcgaaacctccaccccttttgggcccatctgaagggtgacctccctgggccctcccagtgcgtgatatattgtactttctctcatgtatataggtcactgctcctgtgctcttccctctgtacacgggttgtaatggtccctttcgcaaggttggaggctcccccttgctccatcaggccaagccccttgccacgtgggccccaagcccagagagtgttactcgaaaactggtacaaaaatcggacagggaaagtctactatttctagtactagttgagcctgagccaaggcccgggcaaatgacgtagcaacacggtactctactgtctgctcagtccccgcgtacagtggccctgcgtcccaattggcatctcccccaatgtcctgcgctctcagggtagaccaggtcaggtgaggggcattggcggtcgtgcacccctcactatcacctctcctagcgcagtaacgcacacctcactgggagtaggctggttgcgtgctacgccgggtcccccgtgcccagtagtaagagcaccttttgcgcaaggctcatcacccatctcggcctccatccctgctgtgaccacagcttcgccacagcttgccttgagggtctaatatctgggaagggagagttctttagctgcccctgtctggaagacgtggctctgggtgaggtagcgcgggaaacggatggatgtgatattagttcttggagggaggccacgccctaagccgccagccacgcaagctctcaggggcacctactgacgattggccagtgctcaaccccgcatcccagacaggccctccctgtctccagggcccccaccgaggttacccagggctggagacttcctctggtaaacattcctccagcctccccgtcacctgggacgccaagagaggtgggcacacccaggaagggaaagcaggcagccccgttttgggagtaactgcttggatattttg

SEQ ID NO: 530866 - DNA, 1505 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatactttaatatggcccataggctcaggggaagggaatacctttgcactttattatctgtgtattggaagtggaaaagccattgtctttgattgacccctttctttttggcaaacaaac

SEQ ID NO: 530867 - DNA, 2076 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
  misc_feature (1335)..(1335): n is a, c, g, or t
  misc_feature (1337)..(1337): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgctacgaatttaggtccttcaaatgtntnaaatatgtaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaatggcaccataaaaaaaaaaaaaaaaaaaaaaaaaaaaaaaaaaaaaaaaaaaaaaaaaaaaaaaaaaagcaacaaaaaaatcaaaaacaccacacaaaaacaacaccaggctcccagcgacacacacgcaccaaaaaccactaccagcggaagcgaacccacagaacccccgacacaacgacacgccaaccacgacccccaacgaacccccagagcgcggcccgacggcgcccccgcgcccaccaccgcgcccccccgccgacccgccccacgctccgcgccaaccacttcaccgcaggccaccagcaacaaacccgccaaacacgagaacgccccgaacccaccaaccacccagcgaaccaacacacacaccacacaggacacaagaaccaccccaacgaaccggcagacgaacacaagatcgacaccacaacaccagcagtaccgaagcagaacagaaacaccacaaaccgcccacagaacgcgcctcgcacaccagcccctaccaacccgccacagcaggcgacacaacaacccaacgacacaag

SEQ ID NO: 530868 - DNA, 458 bp, Homo sapiens
  misc_feature (26)..(26): n is a, c, g, or t
  misc_feature (33)..(33): n is a, c, g, or t
atcccaaagtccgggaaataagggtntgaagcnactgcccccgggcccttataagagtatttataatatgggcatgccatagtttatttacctgggcccttttgctcttttggttttatatttgagacagagtctcactctgtcaccaaggctggagtacagtggcgtgatctcgctcactgcaccctccgcctcctggaattaagcaattcttctgcctcagcctcctgagtagctggcactacaggcacactccactgctctctacccagacccttttgaggaaattttagttctttctgtttaggttgcttctaagctttttaaaacattgaccatccctgaatgaacatatttgtgcccttgtccaattatttagtagaataaattcctaaaagcaggcttctgggctataaggtttgattttttttaaagtagataaagatatgaggttccta

SEQ ID NO: 530869 - DNA, 280 bp, Homo sapiens
aactggtaaggttcctcattgctgacagaagtaaaaactgctataacctgccaggcttggtggctcatgcctgtaatcccagcactttgtgaggccgaggtgggcagatcacttgaggtcgggagtttgagaccagcctgggcaacatggtgaaacctgtctctactaaaaaatatgtataaaacttagcctggagtggtggcacatgcctgtagtcccagctatttgggaggctgaggcacgagaatctcttgaacccaggaggcagaggctgcagtga

SEQ ID NO: 530870 - DNA, 1923 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccacccattgaagaggttgattaagccaaccaagtgtagatgtagcattgttccacacatttaaaacatttgaagaacctaaatttgaagcaaaattgtaagtggaaaatgcaatgtcttaaataaaactatttaaaatggcaccataaaaaaaaaaaaaaaaaaaaaaaaaaaaaaaaaaaaaaaaaaaaaaaaaaaaaaaaaaagcaacaaaaaaatcaaaaacaccacacaaaaacaacaccaggctcccagcgacacacacgcaccaaaaaccactaccagcggaagcgaacccacagaacccccgacacaacgacacgccaaccacgacccccaacgaacccccagagcgcggcccgacggcgcccccgcgcccaccaccgcgcccccccgccgacccgccccacgctccgcgccaaccacttcaccgcaggccaccagcaacaaacccgccaaacacgagaacgccccgaacccaccaaccacccagcgaaccaacacacacaccacacaggacacaagaaccaccccaacgaaccggcagacgaacacaagatcgacaccacaacaccagcagtaccgaagcagaacagaaacaccacaaaccgcccacagaacgcgcctcgcacaccagcccctaccaacccgccacagcaggcgacacaacaacccaacgacacaag

SEQ ID NO: 530871 - DNA, 192 bp, Homo sapiens
  misc_feature (6)..(6): n is a, c, g, or t
tcgaantcgacggtttctcttctgatacctctatcatatgctatagtgtattttttttttttaaacaccagaatctctttaagtcttaaacaaaggggtagtccggcccggggcatacatggggtccggcgtccctagaaccacaaccaaccacagaatcacaccattttggagggaaaacaaaaaaattcc

SEQ ID NO: 530872 - DNA, 222 bp, Homo sapiens
  misc_feature (51)..(51): n is a, c, g, or t
  misc_feature (83)..(83): n is a, c, g, or t
  misc_feature (114)..(114): n is a, c, g, or t
  misc_feature (146)..(146): n is a, c, g, or t
  misc_feature (186)..(186): n is a, c, g, or t
  misc_feature (205)..(205): n is a, c, g, or t
  misc_feature (213)..(213): n is a, c, g, or t
cggtaagtgacctccgcttccacgcgtccattccccgccgctccggcgctntctcgcccgcccctaccccgaggccaggccgnattccccgaggaaagagcctgtcgccgcggngggacaggagggggctggacgcttccaggganactgaggccctggcgcgcccaggtccgcgcgtcctgggcnagaggggcaaggctggctnaagctccnggctgccag

SEQ ID NO: 530873 - DNA, 719 bp, Homo sapiens
  misc_feature (460)..(460): n is a, c, g, or t
  misc_feature (474)..(474): n is a, c, g, or t
ctctggtcttttgctactacgtgtgagtcccacagcgactctttagtgaccagcaccctcgcttctgatcatcatctgaaggtgacttctccgccgatacctccgagataattctcaccgtgacccgtgttacaccgttcttcgttgcttatgaatggtctccagaaataatccaagggaggcccaaagatctttggccaccccagatgttgaccctcctgaccatgaagacaccaagtatactgtggaccagaggtttggcctggattttaaagaaatagaattaattggctcaggtggatttggcccagttttccaacgccaaacaaccagaattgagccgggaagacttacgttattaaaccgtgttaaatataataacgagaaggccggagccgtgaagtataaagcacttggccaaaacttgatcactgtaaataattgttcaataccaatggcntgttgggatggatnttgattatgatcctcgagagcccgtgatgatttcttcttgagagcccgtgattatgatcctcgagagaccagcccacaaatagttccaggtccaagaactaagtgccttttcatcccaatggaattctgtgataaagggaccttggaaccatggattgaaaaaagaagaggcgagaaactagaccaagttttggctttggaactctttgaaccaataaccaaaggggtgcattatataccttcca

SEQ ID NO: 530874 - DNA, 184 bp, Homo sapiens
  misc_feature (9)..(9): n is a, c, g, or t
cagggcggngatgacccgcttgatcgcgaaccgggcggtctcgatgcccgccttgatcgcggggtccacgttgtccatgtcgcttcctcgcctccgtggacctcatccgggattaccagcgatacagagatgcgctggtcgccatcggtggtgcggggcagtccctggacagcaacggcatcca

SEQ ID NO: 530875 - DNA, 169 bp, Homo sapiens
gtctacagcaataaatgccgtctagctcagaagaggcccagatgtaggtacccatggagcactccgcagatcacatacccctgaaaacttaatactaacataaccacttatcagagacataagtactagtactttacctcatacctaatcaatactctagaaaggaagg

SEQ ID NO: 530876 - DNA, 962 bp, Homo sapiens
gatttgtgagtcgggtgctgaatggttatccggattcatgtctggtggctccgggtgcaataataacagagaaacatggacgatccacagggaatgtaccccgatggtgtcatcgaggagtcagacctgtcacattgatggcatttgtattgaataacctatcgaattgatactgaactttaaatgcgagatctctccttgcagaggccatctactgtcttagcgtgttgggagtacagccttccgactaattacagtagaggagcctatatatttccttctgtatcacaacggggtatgatcgtgacttgcttcaatgactcaaatgcatgggtaactggacacataacaagcgcagaattttggctatcttccaatcctgcatacatgcttgagagattgagttcacacggcagacccaatcactaatattggcgccccaaccagaagtacactggcgtcatacacggatccaattagggtaacttctggtgacctcggaagcactactattggtgagaccatcttgtgcatgctcttgcaattggtgggaaccaacagtgtttctacacttgtaactttttgccagaaaaaacctgacaggcttgcatagtctacccaaccaatatgtggttggcttggagctagccgccccgtgcgaggagtcgtcccttgcatacctgtttaaaaaccagaaagatactcctttttctcgcaataatcttggagtcaccacaatggtgtcgattcagaggcattgaaaagcaccgactgacacactggtttgactcccgttgggatttcaacaggcgacttccatatcttggtgaacaatgtttcccaccctagctcactgaactagaagtaatttcagggctggtgttggcctaattctaggcacaaaatagccaaacgtgtagttctttttggaaactctgaccaaaaacatttcactgcgacat

SEQ ID NO: 530877 - DNA, 220 bp, Homo sapiens
ccactgattttcgtattattacgtggagactgggtaacactctgttggccaggatggtccccatctcttgaccttgtgatccgcccgccttggcctcccaaagtgctgggataacaagcctgagccatcgctcccagcccattcattcgtacttacaggctgaataatattctatcgtgtctatataccataattccttattcattcatccagtgataac

SEQ ID NO: 530878 - DNA, 567 bp, Homo sapiens
  misc_feature (118)..(118): n is a, c, g, or t
  misc_feature (211)..(211): n is a, c, g, or t
gctcaaatgtaaaatgccccttcaattgagatcccccccccaggaaggtgggtggaagcaggggaagcaggatttttggcccttcttccaaactttccctccccggaccctgaggganaattattttggtttcccccccttgggttgaaaccccccaaaaaggccccttctgattaagccggttgaaacaaaaaagggcccggttatccangaatcttccgcgcctccggatgcccttgaataaaaatggcccccccccggggccccaatattttcccccccagaataaaaaagaaaccccttttttaaaaaacccgcttccaaggcccctttcccggtttttcgggggccccaaaaaaatttggaaagggaaaaagctctggtttttacccccccccccccccccaaggtttaggaaaagggttcccccccaattggggtccccgaaaatttttggggaagaaacctttttaaaggggtttttgaacccccttaaaaccgcttttttttttccccccagggacccccccccctgggtttggcccccaaaaatttttggaaaaccca

SEQ ID NO: 530879 - DNA, 510 bp, Homo sapiens
ctcacaatcatggcagaaggcaaaaggcatgtctcacatggtggcagacaagagaagagagcttgtgcagggaaagtcccgtttttaaaaccatcagatctcatgagactcattcactatcatgagaacagcatgggaaagacccgcccccatgacttgtctcccatcgggttcctcccacaacacatgggaactatgggagctacaagatgagatttgggtgggaacacagagccaaactgtatcagggtggtacaagtgtttcacatgagctgactggcagtcagtaactgatttcagttttccagataattgacatactgtgttatatactgcttttttttcctacttaatagtgcttttttaaaaatagaagttgtggctgggcatagtggttcacacctgtaatcccagcactttgtgagccaggatgattgctcagggccaggactttgaaaccagcctgggtaacagcaagacctgcatcagtataaaaagtagaaaaaaaaa

SEQ ID NO: 530880 - DNA, 269 bp, Homo sapiens
agaatgatcttggcttgggtaagttttcctgcttgtgtactttttgataaataagacgttaatactgttttaatgaaaacagttaaatattgaattatttagtaaaataaccatatatttaatcttaaggttctactcacctaaatatctgaaattcacaggctataaaatggttgacagggaaataactttacatgatgactcacagttttcataaataatgcaggtaaactattaatataaaataattaggtgttggggataacata

SEQ ID NO: 530881 - DNA, 378 bp, Homo sapiens
ggcacagggtggtgtcgtgcatctctgagccaatgctggtgttggtggcctgccgtcgcggctgagctctcctcctgcacgccactgtcctgccgtgcgccttcctctggaacagatctggaccctgggtgtcatccactgcgcagccgtgctgcccaactgttcgctcttgccccgaggccggagccaagggcggcccgcggggctggggcctaccccgagcgcctggaagcccagctcgctgcgcagctcccggcacaccggcctcagccccttttaagccacccagaggcccaacgactaaaccagcccaccctgggctgggcccaggtgcccggcccaaaacctttgggaattaaaaacccattatcgaggccc

SEQ ID NO: 530882 - DNA, 453 bp, Homo sapiens
  misc_feature (395)..(396): n is a, c, g, or t
gtggcgaggcagtctcgggggatggaaacgcgggcgtttccgcggcagctcagcacctgtcagagagcgaatttcttgggtgacttgtatgctcagaaaaactctggagtgacagcaaacggtgggccggggagcaaatttgcaggctactgtcggaatttggtgtctgatattcccaatcttgcaaaccataagatgccaccagctgctgctgaagagactcctccgtacggtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaagnngccactaccgacacggacctcctgtccaggcgatctaatgccaccaactccagctac

SEQ ID NO: 530883 - DNA, 103 bp, Homo sapiens
cgacacttgtgcagcaggaagtaatcttcaaattatggtaggggttgtgaacaaaaccttttcctttattactcttaactggctgaatggctctacaagaagc

SEQ ID NO: 530884 - DNA, 161 bp, Homo sapiens
gagagcttgctttgcataactttcatgtagttgtctagagtcctttcatgtcacttgcaggactctctttagcatttttgtaagccaggtctagttgtgatgaactcccttaggttttgtttgcccgggcaaagtctttctatttttcattttctgaaagg

SEQ ID NO: 530885 - DNA, 437 bp, Homo sapiens
ggcacgaggaaaaagcttgtggcgaaggggggcaaaaaaaagaagcaggttttgaagttcaccctggactgcactcaccctgtagaagatggaatcatggatgctgccaattttgagcagttcctccaggagagaatcaaggtgaatgggaaagctggcaacctcggcggaggagtcgtgaccatcgaacgcagcaagagcaagatcactgtcacttcagaggtgcctttctccaaaaggtatttgaaatatctcaccaaaaaatatttgaagaagaacaacctcccgagactggctgcgtgttgtcgccaacagcaaagagagttacgagctgcgttacttccagattaaccaggatgaagaggaggaggaagacgaggattaggacacattggtctgcaatgttttgtattaattcataaataaaatttaggaac

SEQ ID NO: 530886 - DNA, 425 bp, Homo sapiens
  misc_feature (6)..(6): n is a, c, g, or t
  misc_feature (33)..(33): n is a, c, g, or t
  misc_feature (341)..(341): n is a, c, g, or t
ggccgngccagctgcagctttccgccgcttggnccttgtccggagctgcggccttagcttcgcttcctacggggcgcacggcgccaaatctcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttgggccctccgggagggaccctgctactcttgggctggcttgccttggctctttgagcncccttttgcttaattactgggttttctgggcagtttttttttaaagagttggagtaagaagaggattaaaaaggaaaggcaaat

SEQ ID NO: 530887 - DNA, 349 bp, Homo sapiens
tttttttttttccccacccccccttagtttttaggaaattaattttgggggttttttacaaatggctttttccctgccgggattttaaaaaacttttttaaaaaccttttttatttttgggtttttttttgggatggtttttcctggggcccttgggggtttttttgggtagcccccccttgggtttggtgaaacccctttccaaatttattcccccgggtttttcccctaaaaaaaaaccagttttttcccccttttaaatttttttggaaaaagggggttttttttcccttttgggggttaaagggggggggggtaacggggggaaaattaaactttgggggcccca

SEQ ID NO: 530888 - DNA, 512 bp, Homo sapiens
  misc_feature (6)..(6): n is a, c, g, or t
  misc_feature (33)..(33): n is a, c, g, or t
  misc_feature (84)..(84): n is a, c, g, or t
  misc_feature (86)..(86): n is a, c, g, or t
  misc_feature (428)..(428): n is a, c, g, or t
ggccgngccagctgcagctttccgccgcttggnccttgtccggagctgcggccttagcttcgcttcctacggggcgcacgcaantntcccagatgcctacgggaaggagctgtttgacaaggccaacagctccttcccttaggcttcgcttcctacggggcgcacgggcgccaaatctcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttgggccctccgggagggaccctgctactcttgggctggcttgccttggctctttgagcncccttttgcttaattactgggttttctgggcagtttttttttaaagagttggagtaagaagaggattaaaaaggaaaggcaaat

SEQ ID NO: 530889 - DNA, 895 bp, Homo sapiens
  misc_feature (38)..(38): n is a, c, g, or t
  misc_feature (78)..(78): n is a, c, g, or t
  misc_feature (89)..(89): n is a, c, g, or t
  misc_feature (94)..(94): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (124)..(126): n is a, c, g, or t
  misc_feature (134)..(134): n is a, c, g, or t
  misc_feature (140)..(140): n is a, c, g, or t
  misc_feature (145)..(145): n is a, c, g, or t
  misc_feature (149)..(152): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (163)..(164): n is a, c, g, or t
  misc_feature (167)..(168): n is a, c, g, or t
  misc_feature (176)..(176): n is a, c, g, or t
  misc_feature (184)..(184): n is a, c, g, or t
  misc_feature (188)..(188): n is a, c, g, or t
  misc_feature (199)..(199): n is a, c, g, or t
  misc_feature (202)..(202): n is a, c, g, or t
  misc_feature (229)..(229): n is a, c, g, or t
  misc_feature (262)..(262): n is a, c, g, or t
  misc_feature (278)..(278): n is a, c, g, or t
  misc_feature (284)..(284): n is a, c, g, or t
  misc_feature (290)..(290): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (328)..(328): n is a, c, g, or t
  misc_feature (733)..(733): n is a, c, g, or t
  misc_feature (885)..(885): n is a, c, g, or t
tctaggctctacataccatttcttttctacctggacangaccccataaaaacctccaagccacgtgtagatgtgaganacatttgaaanaacanttcaactcatagcttanaangangccattnnnccagccgngcaagnccctnaccnnnnctntncngggnnttnncgtggggntgggttgnttgnttggtgttttntgngccccacaatactgaagctccttttcnaggggcttgggataggcagtcaattccaggttngggggggggggtgggngggggngggtgngagggagtgggatcgaggngngngggtgcggtgggtgnagagcgatgtgtggggggaggatgatttaaaaagtacatctctctccctcctcccccacatgcacaaggctcacatctcattatggtgcggcccatgtacattaaagtgtgatacttggttttgaaaacattcaaacagtctctgtggaaatctgagagaaattggcggagagctgccgtggtgcattcctcctgtagtgcttcaagctaatgcttcatcctctctaataacttttgatagacaggggctagtcgcacagacctctgggaagccctggaaaacgctgatgcttgtttgaagatctcaagcgcagagtctgcaagttcatcccctctttcctgaggtctgttggctgaagaggaaagaaaaggcaggtttgaccagagtgaaaccattagcatgtnattcataacaaccgtgactgaggggcactggtgggctttctggctcacatttccaaagacatgttttctccataatgtttcataactcatggtagaacttggcccatggggagagagcgccaagaaaggtgaatgcacacatgaggagaggnaggactgagg

SEQ ID NO: 530890 - DNA, 1466 bp, Homo sapiens
gggcagctctgctggtgcgggggcgggagcccgggatcgagctaccgctggccgagcgcgccggccaccgacatgcaccgaccttccgcaccgccctccgcgacaggcgcagccctgcgaggtctccgctccagacacacacaacgagacaaacagagagacgatctgaccagccacaaggtaccaggagaaaccaggatagcccgcagacgcggacgaacagaagaccagatgaacgaacccagacgaacggcggacacacagacgaacggcaacggccagagcgggacaacagcacgaacgcacaagaagcacaccagagaagaaacgacaagggaagggcggcagaaagcagacggacggaaaagagagccaagaggaagagagaagcaggaacgaagagcgcgagaagaaagaaggagagagagcgacgaagggagcaagaggccaggggaacagagaggcgggagaggcgcgggcaggcagaagaccgcacagaggaaagagagggcgagcggcagaagaggagcgacgggagggaggaaagagagagggagaagaaaagaggaggggaggaggaggaaaaagagagaagacaaggagaagaagagaagagcgaaagagaagaaaaaagcaaaaagagagagagggagagagggagaagagaggaaggaggaaaggagaggaaagaaacagaaaaagaaaaaagggagaagagaaaagaagagaagagagaagcaagaggagaagggcagaggggaagggccacggagggggaggggaggggaagagaggaggggaaggaaggacgaagagaggaacgagagagaggaggaggggaaggaagaggaggagagaggaggagggaagagggcggtggagagaagagagagagggcaggagaggaagaaaaagagagaagaggacaggagggagagaggaggggagggaggggaggagagaagggaggggacgaaggagagaggcgaggcagagagagaaaaaaagaaagagaaggagacgggagagagagaagaggagaggaggagagaacgaacgaggaggcaagagagagaagcgacaaggaaggagcgggaggaaacgaagagagaagagaaggagagaaagagaagaagaaacaaggagaacgcgagaggagagagagagagggaggaacgagagagaacagaaagagagacaagagagcggagaagaagaggagaagaagaaaatgcaagaggaagagcgggacgacacacggccggagagagagaagaagagagcaggggagagaagaaggagagagaagagcgagaaggagaaggagagccgcaagctgaggacggagacaaacgacggaaggaagaggaggagaggagcgagcgagggagagaaggggacgacacgagacacgagagggagacacggagaggacgaccgcgacggacgagcgcagagcgaggagc

SEQ ID NO: 530891 - DNA, 138 bp, Homo sapiens
ggaggtgggagggaagaaattgcaaatggtgtttgccattgtttattagaaaaaaaaaccccattaaaaagtgggcaaaggacatgaacagacacttctcaaaagaagacatttatgctggcaaaaaaatatgaaaaa

SEQ ID NO: 530892 - DNA, 420 bp, Homo sapiens
ttaatccccatgctttctacactaattaacagctaataattatcattttaaagtaataaatttgcattctggtttatatatcagtagctatgagcttgattactaagtttgtccctaataggacatctagtctcagtatgcttacaaaatcagatatctgagtttgtaatattaagaattagactatatatatctttgtcattttatgagaataaaggccacctatgatggctttaggtagatagccagctgacagtaaaaatgtatgtttggtttgtatgaagcaagctaaggatttcatgactccagcaatttacaatttaactcaaaatctagctgaaagctagttcaagttctgtcttttctattaaatgttttctgattagacttacatgcagtgactacccagtataaaccacc

SEQ ID NO: 530893 - DNA, 844 bp, Homo sapiens
gataagacctagccccaaaaccactccaccttactaccagacaaccttagccaaaccatttaccgcaatataatagtataggcgatagaaattgaaacctggacgcagaatagatatagatacctgcaaggggaaagatgaacaaagttataaccaagcataatatagcgagaggacgtaaccccatataccttctgcgactaatgaagttaacctcagaaatatacgtttgcataggcatgaaagctcatacgctcaagacccccgataaccagacgagctacctaagaacagcgtagaaagagcacatccgtctatgtagcagaaatagtagggaagatttactaggatagcagcgcgacaagacctaccgaacctggtgatagcatggttgtccaagatagaatcttagttcaactttacatttgcccagcagaaccctctaaatccccttgtacaatgtaactgttagtcccaagagagcgaccagcatctttggacactaggcagagaaagcttgtcatcagagagtcaagaactttcagcagccatagtaggcctaaggagcagacaccgaattcaggacagcgttacaagctcgaagagccactacctaagcatatcccaaaagcatataactgaactcctcacagccaatgtggaccaatctatcaccctatagaagaactactgtcaggaataggttaacattgatgaacaattctcctccggcataagcctgcgtacacaattacaaacactgaactgacgaatcaacacgccaataattaccaatcaaccaagcacgctcaaattatcctcagcggtcacccagacaggcatg

SEQ ID NO: 530894 - DNA, 255 bp, Homo sapiens
gggcagtacggtggagctcagtgagtttgagacggctggccaacatggtgaaaccctgtctatactagaaatacaaaaaaatttagctgggcgtggtggcgcacacctgtaatcccagctactcaggagcctgaggagcagaatcgcttgaacctggttcagggattcagcggaggttgcagtgagtcaggatcggagccgactgcactcgcagcctgggctgagagcagtgagactcgtgtctccaaacaaaaa

SEQ ID NO: 530895 - DNA, 835 bp, Homo sapiens
tggagtgagccctaatgagctgagcgctgcagcactgaagctcgcatgccgcctccgcctgtgctgatcccacctcgtgcctgccgcctgcctgctgcctgcgaagatcctgcgcccggtctaccctcgagaagcggagcccctgtaactgcctgctgacacacgcaggcctgcagcctaacctgatctgacacaaacctgcgcacctgatggcgccttgagcgatgagacaggcaggaggacggagtgtattgagtgagtgctgggctgacgtgccgatgacatctcaacgcaggacagccaacgcaggctcgtaccgcggacatgtggcttcgcgacctgagcaggggccggaccctgctcgtggagaattcgccgcaatggaagcttctcgatggccgccaaacatgcccccgagttggcggccatggcggctagcgcgcccctagggaccctgacacacacccccgtggagggaaacagcccagaaaccaacagagcaacagggaagagaccaacaccaacctggactagggcgcacctggacagagctcccgcagacacacacaacaaggcgaaacaacacaggagctgccccggacaggaaccagtacattcacgcccaacacggcgccgcagcggcgagacgcagcaggagacgcgagccacccacaacacacaggatatcatccacgccacgccacaaacgactcccttctgagccccacaagcgcaccaagcaagtgcgcctcacaagccccgctccacctcccgcacctgccccctcacctcggcgtcaacactacgtctcggaacaccttgacaccgcctccaa

SEQ ID NO: 530896 - DNA, 267 bp, Homo sapiens
ggctgaccctgtgtctcccatggcccctgcgaggcccctaccatggcctgcctgggagacacataactatgacaggaacacacgtggactgatacagaatgaggccagacacacccatgcctgtgcctccctaatgagcgatccccaggagcagttggggctagacagatggtgtctacagctggcacgaaacatagggctgtgagccacacagtgaatgctcaggacacaatacggcgacgcagctactgcagacctggtccacac

SEQ ID NO: 530897 - DNA, 735 bp, Homo sapiens
  misc_feature (142)..(142): n is a, c, g, or t
  misc_feature (156)..(156): n is a, c, g, or t
tcttccatattcacaagcttatttaacctatccaaacgtatttattgcccaactatgcctttttttgttaatgtttgtgtcacactttatcgggatgacaaatccatagatatattcttttatgttaaattatgatcttcanattaatcttaaaantttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaagggggaaaaaaaaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttc

SEQ ID NO: 530898 - DNA, 1095 bp, Homo sapiens
  misc_feature (142)..(142): n is a, c, g, or t
  misc_feature (156)..(156): n is a, c, g, or t
  misc_feature (817)..(817): n is a, c, g, or t
tcttccatattcacaagcttatttaacctatccaaacgtatttattgcccaactatgcctttttttgttaatgtttgtgtcacactttatcgggatgacaaatccatagatatattcttttatgttaaattatgatcttcanattaatcttaaaantttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaagggggaaaaaaaaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttctccaagaaacaacaaaaaacaacaaaaaacaacaaaaaacaaaaagggggggcgcccgctaataaaagatctccccctagangggcggcgacagttttcgcgcttctacccggtttttctgggccacaaggggggcgccccaaaagagaggcgacgtcgattataataaccgccgaagcgccacgtgcgccgccgctttaaccacgagctgctagcgtggggaacacactggtgcgcgcgggagaaaccctggaggaagaaacccccaacaactcagggggcggcgcagcacaagctgccgcaacacactacccacagacgaactatttcaagcctctagtgaggaaaatcaacaaccct

SEQ ID NO: 530899 - DNA, 213 bp, Homo sapiens
ggttcacgccactctcctgcctcagcctcacaagtagctgggactatcatgtgtgccctgccacgcacgctgggctaattttttgtattttttggtagaggcgtgggtttcacctgttgttggccagtgatggtctcagatctccttgacctctgtgatcctgcctgctcttggccatcccagtagtgcttgggattacgagacatgaagcca

SEQ ID NO: 530900 - DNA, 730 bp, Homo sapiens
gtgaatatgtattaacaaatatatacatttctatttttataaatatagtttgagaggacagcaacaaaggttttaactagaagctgtcctctcaacactatatttataaaaatttgctagggccaaatccatacttgcagaataattcatcaaattttatttttaagtgaaaagtaacctttcaggcatttcagcagcatacattgacaatctagggtatatatgctatgtatgtttcttattgctatgtctatatatgtatgtggggaggacacggagtgaactgttcacacgactctcttcttgccgtacctcacactaacacttggacgaactgtctctgacagacaaactcggatgaacattagctgctgagacttgagtttctgccttacaaactctgaaacaaacaaacagggacaaattgctggctagatctactgactgtagccatcaccagaacacttagtttcttcccagacatgaactttcctgacaggctctgagccagaaacacactgtgggcgtgcatctggcttcagccctggcatatgcctccactgtggacgggaacgcattggaactggagttgtgcacagcaccgacacctagtgcggcctggctgaagaggtgcacaaagggcaagcggtagttctttccaatgtcacccattgcagctacacttaactttctcactgactaccaaatggaagtgaccggttgcaccgaa

SEQ ID NO: 530901 - DNA, 270 bp, Homo sapiens
  misc_feature (20)..(20): n is a, c, g, or t
  misc_feature (105)..(105): n is a, c, g, or t
  misc_feature (178)..(178): n is a, c, g, or t
ctttggaaaacaaacatttnttattactgaaatagcaaaaatcattctacactcctcctaagcatgttcaattagcatacattccaacaatgcatgaaaaaattnctagccagaggcatttaagtgatttcttcctaagtgtttgctaattcaatgccaagaactatgatgtttatcnttctgatggacaaatcaagaaacaaaacagatataataccaagggtaaagctgatatgacccacaacattgtcattactctaactgttaatc

SEQ ID NO: 530902 - DNA, 524 bp, Homo sapiens
ccagatgatgcagagacgatgccgtaccgctgcactccagccggtgacaatgaactctcaaaaacaaacaaacaaacaaaaagaatctttgacaggtgctctcaaatgtaggttgctaagaactttggagattgtaacattggaataaagaaaaaatgtacaggactcatgaagagctaaaatgttcacaaatatcaaggaaaacaacagttaactgaatggactgaatgaatagacaactgaaataattttttgaactttttcttggaacattattgattcttgttttgtttttcagagtcaaatttttagctacttacagcatttaataattcagtaacgtatacttctgtgaataaaattttaagtatatttgtctctctcattcttcctggcttctccagaatctggaaactaattgtgagtattttaacttatggcaatatagttgtttgcctccgtgcattaagagtctgttttcttcttcaacaggatgccattggagaaactgggtgttttaccaa

SEQ ID NO: 530903 - DNA, 186 bp, Homo sapiens
gcaactcctatttcctccgacctcccagcccttgcaaatcatgattctgtctgtgtgttgtgttgtgttgtgttgttttgagatggggtcggtctctgtcacccaggctggagtccagtggcagaatctcagctcactgcaacttccacctcccaggcttcagcaatcctcccatctcagcctctg

SEQ ID NO: 530904 - DNA, 495 bp, Homo sapiens
ctttacgcattgcactaagacttattcattcttccttcgaacagaaccacttagaattaaaacataattctgtaaaaaactcatgagccctgcaatgagtgggctgggtagactgtgctccttccttctgtgcgtgttcgggaggcttcacgttctcgtcccgtggtccctgggtggcctgcaggcaccaggtgttgaaaccaatgccaggcataattcctgtcacatcgaacaggaacattaactggattcctcttccagggaaaggagctgggggtggaagtgtggaaggactgagtgtagtttcttttccaactccaggcagtgactccggctgccaatcatgactgtcaatcatcgtagtaaataatctaacttggtgaacacccgttttgcagcctttatctgagaaaactctctcctctttggggaaaaatgtcattctcctcagccactctgctttacaatgtcttcatcaatctcataggcggtaaa

SEQ ID NO: 530905 - DNA, 750 bp, Homo sapiens
ggagagagagaactagtctggaattatattgtgtatcttttaggttgagaggccacaggatacttccatccgatggtccatgcagcaatggtgcggttccactaggcccctcccctcttcaaggggtctacatggcaactgtcgaggagggtgaaattcagcatgtgttgggagagactagacgtgtggcagggactcacccagactaggtgaggagctctgcttctaattacgcatcttgtggctactctgctgcaggctggctggcccaggggtcatagacatccttgagagcccaattgttggcccactaaggtccacccaaccctaggtgagctgttacgcgcaaaaatctcggatgcgtcatatcacgcagggacaaactaggcccctgagacaaacaccgtgggctccgttagcagcgggcaaatcagccaccagcccccaaggccgctcacaaacggctcgcaagagacgtggcattgtcacactgtgacgaaaccgtcaaccatgggaagaaacccagcccagcgggtactccacccacgttggatacgccaccagagagcaactgcccccctttgaacagagggacggcaccctccaaagacggccccatggagtctccaagcgcacactatccgttagaccagctctactccaccacttctgggcacggaggtctatccttcacaatcgggcacgagtcacgcgtccgccagccacgggacccggttttgccaagcagag

SEQ ID NO: 530906 - DNA, 841 bp, Homo sapiens
gtgcgcgcgggcgggcgggctatggcgcaggcgggttgtggggccggcgctggtgcgcggtggcgccggttgcatggcgtgtctgtctggcggagtcgtccctcgggggctgtcagatttgtgacccatgaagtgaaatctctgagcctcagctgtggtctcttggtgtctggtccaggaagccaacttcatgtcttgagtgcacgagcagcagtttgccatggcagagcttggggctgcacactggtgacccttagtgatgggacaacagcctacgtccagcgagctgtcaaacggagatgaacgcttcttgaagtggcaggtgatccagctctgaggatgggaccaccgtatacattcacctaggtgcacggtacagcaaatgaagctctctcctttgagtgattggtcatgcctgttgcatgctggacgatggcagtagtggtttacatacaccgtagcacccagagaaggctatgaccccaggagccctggaagccgtccaactggaagatggctccacttgctacattcaccaccctgtggctgtgccatcggagagcaccatcctggccgtacagacagaggtgggcttggaggacctggtcagcagaggatgatgagggcttcagtgcagacgcagtggtggccctggagcagtctgccagcaaggttcttcatgacatccagattccccggtaatgtaaaagggcagcaagttggagacagagcattccgactgtgggtaccaggggtgtgggcgtatcttaccgcaccgttcatcagttacaggtggttgaacgaactctacaggttagcgtccataccgaatgtgattccc

SEQ ID NO: 530907 - DNA, 328 bp, Homo sapiens
gtgatgttatcgcccaacactttggaagcaaggtgcaaggatcacttgaggccaggcatttgagaccagcctgggcaacataggagaccctatccctacaaaaatttttttttaattagctaaggatggtggtgcgcacatatggtcccagctactcaggaggctgagatgtaaggattgcttgaacccaagaagttgaggttggactgagccatgattgtgccactgcgctccagcctgggagacaaagtgagatcctgtcaaaaaaaagtaaaaaattttagaaaaggaacatctactatgtgctaattgtgcgtgttggggataa

SEQ ID NO: 530908 - DNA, 429 bp, Homo sapiens
  misc_feature (269)..(269): n is a, c, g, or t
gctagtactgtgcctggtgtggtgcactgtaggactcagataaatgctcgtaagtgcgtggcaagggaggtgttctgggaggtcagaagtgcaatcccaaaataaggctcctgcaagctttctcctccttccttccagacatgcatgtccctgactccgtgacccgagactgataagagcaagttgacctggttccataacagggtactcataaaagcatcgtgtggaaaccaagattacttcgaatccggccctcacccacgatattntttaaacccaaatggcaagatatgttgaatccaagaatgtctcacaaacgtggacgcgcaagtgttctagtgtcataaataccaacgcaacgcactattgaaatattcttgacaaaactaacaatcgaagagtgttgaagttgccaaataaataaaaaaa

SEQ ID NO: 530909 - DNA, 844 bp, Homo sapiens
cgcgagatgtcttggtggtaggcaattcctgtcaggaactcttggaaacaatcgccaaatgccctctttgttcgaaaactctcctcgtggtcataccggccaagtggatcaagatggctcgatctgaactctcccctcaattctggaatacatcccgtggttagtatccaacctttggtggcccagcgcttttactctcatggggggaaacaccacaaggtggagcgcccgagttatcaccctggcagctcctggtaatctgttcccactttgcaaaacgttgtttttcaaaagtcgatattccccaaggggaatttcacttctccccctcaactcgtgggacccttatttgtgggtcttattaaatacagcggcttccctcacaccctgtagttattgaaagcccgaggagtgcacgaaaagactttcggtttaacaaagaggatcttcttaaccgactaaaagatgggtccgagacacagactgtcatgcatgccctctttatatgtgagatatccccccgcggggggctcattgcattctaaaacatccttagatataaagtgggcacccccgcgacccctctgatacatgagtcttcacccagtatgccaaagaatggtccgtccggcgtcaatgttaaatccgtggtaccaaaaggtggttttcgtaaaaacaggcaccgcatgaaaaagtttgcatccaatcagaccccgcttttacacactgtgggcacaacactgtgtttaggtaagaaaccagtttgtcctgttgcacgcttctctatagtgttgttacccgcgggaactaaaatacaatttgtaaaaaaccccacaacataaca

SEQ ID NO: 530910 - DNA, 306 bp, Homo sapiens
  misc_feature (38)..(38): n is a, c, g, or t
  misc_feature (41)..(41): n is a, c, g, or t
  misc_feature (105)..(105): n is a, c, g, or t
ctcttttttttcccccccggggggagggggggggaaanaanccttttttccccccgcccccccccccggttttttttatgggggggtgggggggccccctttttnggggggggttccccctgggggggccctgggggccccccggggagggggacacctttggggcccccccccggggggggggtttttttttttttttttttttccccggggggggaagggggggtttttttttttttttttcccccccccccccccaaattttggggggttttttttaaaaaaaaaaaaaaatgtgccccccca

SEQ ID NO: 530911 - DNA, 297 bp, Homo sapiens
  misc_feature (54)..(54): n is a, c, g, or t
cggcacgagaaatttgcccacagaaccctctaaatccccttgtaaatttaactnttagtccaaagaggaacagctcttttggacactaggaaaaacccttgtagagagagtaaaaaattgaacacccatagtaggcctaaaagcagccaccatttaagaaagcgttcaagtgcaacacccatacctaaaagatcgcaaccatttactggactgatcaaacagatggaccatctatcacctttgaagactaatgttgttagtgactagaaaccatctctcgctaagcctccgtcgata

SEQ ID NO: 530912 - DNA, 1019 bp, Homo sapiens
  misc_feature (59)..(59): n is a, c, g, or t
  misc_feature (93)..(93): n is a, c, g, or t
  misc_feature (96)..(96): n is a, c, g, or t
  misc_feature (145)..(145): n is a, c, g, or t
  misc_feature (153)..(153): n is a, c, g, or t
  misc_feature (159)..(159): n is a, c, g, or t
  misc_feature (194)..(194): n is a, c, g, or t
  misc_feature (205)..(205): n is a, c, g, or t
  misc_feature (207)..(207): n is a, c, g, or t
  misc_feature (242)..(242): n is a, c, g, or t
  misc_feature (285)..(285): n is a, c, g, or t
  misc_feature (360)..(360): n is a, c, g, or t
  misc_feature (383)..(383): n is a, c, g, or t
  misc_feature (393)..(393): n is a, c, g, or t
  misc_feature (396)..(396): n is a, c, g, or t
  misc_feature (425)..(425): n is a, c, g, or t
  misc_feature (428)..(428): n is a, c, g, or t
  misc_feature (437)..(437): n is a, c, g, or t
  misc_feature (445)..(445): n is a, c, g, or t
  misc_feature (456)..(456): n is a, c, g, or t
  misc_feature (470)..(471): n is a, c, g, or t
  misc_feature (486)..(487): n is a, c, g, or t
  misc_feature (494)..(494): n is a, c, g, or t
  misc_feature (498)..(498): n is a, c, g, or t
  misc_feature (503)..(503): n is a, c, g, or t
  misc_feature (521)..(522): n is a, c, g, or t
  misc_feature (530)..(530): n is a, c, g, or t
  misc_feature (568)..(568): n is a, c, g, or t
  misc_feature (581)..(581): n is a, c, g, or t
  misc_feature (592)..(592): n is a, c, g, or t
  misc_feature (596)..(596): n is a, c, g, or t
  misc_feature (622)..(622): n is a, c, g, or t
  misc_feature (625)..(625): n is a, c, g, or t
  misc_feature (633)..(633): n is a, c, g, or t
  misc_feature (637)..(637): n is a, c, g, or t
  misc_feature (642)..(642): n is a, c, g, or t
  misc_feature (653)..(654): n is a, c, g, or t
  misc_feature (671)..(671): n is a, c, g, or t
  misc_feature (694)..(694): n is a, c, g, or t
  misc_feature (709)..(710): n is a, c, g, or t
  misc_feature (734)..(734): n is a, c, g, or t
  misc_feature (737)..(737): n is a, c, g, or t
  misc_feature (762)..(762): n is a, c, g, or t
  misc_feature (821)..(821): n is a, c, g, or t
  misc_feature (928)..(928): n is a, c, g, or t
  misc_feature (938)..(938): n is a, c, g, or t
  misc_feature (941)..(941): n is a, c, g, or t
  misc_feature (1004)..(1004): n is a, c, g, or t
ccggggcgggaaaggagggggaggggataggcctgagagaagaaaggcggggcagaatnggacgacggggaaaagggcctagagggggggaangcnagtaaggcaaataagacaaattatcatgttggtttactacatcaccagngaacaggngagagngggatgggtaaaaaagaaaaagggagaccgcaaangtgtagggtangntacaatcagcgggggggtatgggggggggaggggngaaggggggggggggggagggcaggggtaggcaccagagccgnggagaagaagcggcaaaaaaatggcggaggatgcgcactgggaaaggggggcggcggggggccagggtgctgggnacgagcaggaacacagacagtgnactcgtgtgnatnacggaaggtgtgagggcgggagtcgtgtncanaaggtatgngcaagttntacaaaagcanatatctataatctnntgtatctatttgtgnntatttgnggantaaantggtgtatgttatactgnntgcgaatnggattctggtaaaatataaagggattacacttaaaatntttggtatttaanagtaagaaaangatnacatttttacctgttagatgaactgncantgtgtacntcantagangttaatcccanncaaatcagattggaganaataaattgggggaatgtggganagatgtccaaaaagnnggtcaggaattttggagtaggtantgngcctgtctgggacaacattttaganccctctgacagattatttttcattgaagtctgatttcctacatcctggaatattcatgnttttctcattctacagatattttgtcttcccccaaactaaaaggaaaaaaaactaccctttactctcttttctactcagttactcttttgtgctatgttagaaactngaaatatatnggngatggggggatttgtccctgactgcccactgtacaggacagagagtacagtgttcagttggantcaggactccggttt

SEQ ID NO: 530913 - DNA, 744 bp, Homo sapiens
tgtcttgactctttcacagctggcatgaaggtcaggcagggaaatctcaaaaacacaacctgtgtattcccagactattaatcatagaaaatcacttcaactggattacggtcttgtacctggcagaaaggctgttatgaacattggaattggatttttacacttgatatgacacttccttgagtcagatcagattcgtgtttgatagactcttgccaaaaaattgctccagggtctgtgcagtagctaaagcctttttgttgttgttgttgttttaaaagcagcattaaatgttttcatgaagaccttcccagtcgtgattttattgggaatatggtctttatctctggtcctgaataactcacactgaggaaacctctaacaagtgttgtattggaagatgtctgatggatggttggttttaataacaaatctcttccctttttctgtcccctgtgttctattctcttttctctacacattattctgggaggattcacctattcccaaagtcctttcctctttatttccatttcagagctctctgtataactccaggctgacgaatccaacggcccagtttttatctccacttggctgtctttcttgcattgacctcatcttaccttgcctctcatgatttcctcttctgcctgggctcatcacatcagattcacaccacatccacccagcttccaaaacacctgggcctcctccttcattcctccctctgtctcagtcaag

SEQ ID NO: 530914 - DNA, 338 bp, Homo sapiens
  misc_feature (10)..(10): n is a, c, g, or t
acttccttgnacctctcagcagcatttgacacaattgatcatcttctctttattgaaccattctttgtcttgacattttaacctcaactttttttcatacatttttgcaccctactcagtacttcacctccttttgctagttctttctactctcacctcagaatttaactcatcggatttctttaatttgctcagtcctcattcccattttcttttcccattcataagtttctgcctcatcatccagcaagtccatatttccctttttgttccttaaaattcgtttctttgtgccctttccctcccatccaccaacaggcaaaacactcatttcattg

SEQ ID NO: 530915 - DNA, 105 bp, Homo sapiens
tcccggagtgcagcgacggaattggcattgaattcttctgaactgagatcgtctgagtgtatcgctgagtccactactgatggagctgctttcatcccagccgga

SEQ ID NO: 530916 - DNA, 542 bp, Homo sapiens
cccataaactgccccaaagtgcaagcggtacagactcactatgaaagtacacgtaaaagaggcaaatatcaaactagaattaaaactcaccatgaaacagcacaaggaacctatacaagtaaactcactatgaaatagcacaataaacctaaaaggaccccagaatagcacaatgaacgcataaggaccccagaaataaacctaactactaaactctaaataaaacctaaacctgaagtcgaagtaaacgctaaatcgctgaccgaactaggacctaaacaatgaacctatacaactaataataaaaactgaacaaattaacctgaaaacgaagacccaagtcaataccacaaaactaaattcgggaaatgtaagagacctgatggtgatatatagtctcatccatgatagtgaaaacgggcccctatggtgagcgaatctatcacccttgatggtacgggacctaatggtacctataacccttgacgggaggagaagaaaaagcgcgaaaaaacgaaccagggccgcgggcagtctaccaa

SEQ ID NO: 530917 - DNA, 559 bp, Homo sapiens
ctctatctctgttctcaggaatccagttctcaaggttaatagaattggactatcccataattaccatttgtttgatctcgttacacaggcagcactaacaccagaataacactgatgttgccatcagcagtcacacgactgaaacatgaggactgccctgcacgtgctgctccgcagcctgctgatctaacggccgcgcccgcgtctgttgcttgagtcaccacggctgttacatcccgtgctctcccttctctgccttcttggtgttggttctgcgggcgactgcccatgtggccctcagccccatcctctgttcatggctctctgccactcttgttgtccaaagctctttctctgtaggttccatgggaagagctcatgggaacatgatcttcgacctcatgcttgctgatcatagtttattgtgccttttatcgttgatggttttgctggttacaggattcttggctgacatttccttgagtgtcttaagttattccatattcttctggcagagagttgccagatttagcaaaaacaaataaacaggatgccccga

SEQ ID NO: 530918 - DNA, 412 bp, Homo sapiens
  misc_feature (5)..(5): n is a, c, g, or t
  misc_feature (137)..(137): n is a, c, g, or t
ttaantaactatcctcgggaaactgattccctcccatccctgaaacaccttaaacaaccggaaaaatagcccaagacccagacaagtcctgcctgtggggacaattagataaaaggaggcctgcacagtggcctcanacctgtaaacccagtgcctctgggaggcccaaggtggaaggactgcttgagccccaggagtttgagaccagccctgggtaacacagcaagaccccatctctacaaaacatttttaaaaattagttgggcatggtggtatgtgcctatagtcctggctactcaagaatctgaggcaggaggatcactggagcccaggagtttgaagttgcagtgaactataatcatgccactgtactttagcctggacgacaaaggggactctgtctctttttaga

SEQ ID NO: 530919 - DNA, 1060 bp, Homo sapiens
ctctatctctgttctcaggaatccagttctcaaggttaatagaattggactatcccataattaccatttgtttgatctcgttacacaggcagcactaacaccagaataacactgatgttgccatcagcagtcacacgactgaaacatgaggactgccctgcacgtgctgctccgcagcctgctgatctaacggccgcgcccgcgtctgttgcttgagtcaccacggctgttacatcccgtgctctcccttctctgccttcttggtgttggttctgcgggcgactgcccatgtggccctcagccccatcctctgttcatggctctctgccactcttgttgtccaaagctctttctctgtaggttccatgggaagagctcatgggaacatgatcttcgacctcatgcttgctgatcatagtttattgtgccttttatcgttgatggttttgctggttacaggattcttggctgacatttccttgagtgtcttaagttattccatattcttctggcagagagttgccagatttagcaaaaacaaataaacaggatgccccgaaaaaaaaaagaaaaaaaaaaaaaaaaaaaaaagaaaaaaaaaaaaaaaaaaaaaaaaaaaaaaaaaaaaaaaaaaaagaaaaaaaaaaaaaagaaaaaaaaaaaaaaaaacaaagaaaaagaataaagagtggggcgcgcgcgcggggcgccagccgagagaagaaccagctccagaaagcacactcggtggtgcggcgggcgcgcggcccgaccacatgcttagaagacaaggacaggtccgtcgaactcgggcgggcatagagcaaagtatgcgcgtctcgagaaatgacagtcggggtgggggcgtacctcgcccgggcaaaaaaaagaagccgcgcgcggtggagggagggagccaaaaaggcctgtggcaagaaaaacctaccacgccggaagtgggtggtcgtcagggaggagggacgcgatgcgtgggaagtccacatacgaggggggaacgcggtggtcgaagcccaattgcaattcaaaaaagcaacccggg

SEQ ID NO: 530920 - DNA, 318 bp, Homo sapiens
  misc_feature (239)..(239): n is a, c, g, or t
aggattatatggacgcgcggcgtgagggctggacgttcagcaagatcccggggcgtgcagacagtgtggtaggctatgatcatgagcgctgtcccagccaacagggcgaagagcgtgaagaacatgacctggtaggaatcccaggaagtgctggaacgaggctggtctccactaggggaccggtgcccacgtgcgagtccagtcacataaagccactggtcactggcgatggcaatggncttggattggtcacgcgggctggagacaggtcagggatagttgtgacagaggcccttggtctgccagccgcgcgtccat

SEQ ID NO: 530921 - DNA, 492 bp, Homo sapiens
gtatgtagtcctgttgcagactcagaatatggtcattctgttatcttagagccttgtaaggatggttatcttcagagagtgaacctgtaagttactaaacttcattctttcccaggaatgtgcaggtgggtactctggtttccacttcttcccttcacacccaagctatgttcactagcattactctgtttggatccccgctgaatgatttgagatgtgctctacaacatctaatcagtaactctctgtaacacagatggctcatacagggtaatcctaccaccttcgcttacttctgtgatttaggctgacatcacttatcaattacctcacttttctatctctttatgacaatgcctcatttactttttgttgtcatgcttcatgctgcacaaccaattaatcagagttgacacatgtaataatacttatttgttatcctcctctttttatgtattttttaaaaaacaacaacagctaaagaaaaaaaaa

SEQ ID NO: 530922 - DNA, 940 bp, Homo sapiens
cactacgtatgccactacgagttgcgctagaaatacacggaacgaagatagtgtgcgcgatatacttgtccagagacagttcattaggattatgcgtgctgagcgaaacagattacgcccagtggtacaatgcaccagggtgaccgacccggttagcttgcgtcgtgtgaccgtagttctgtctcgaatacatgcgcatgaaagacctgaatacagataggcgcgacgtagaactagcatcgctagtaactgccattgcatgtttagtccagcacctttgtgacaggactggactgcgtttcatcgctcttctcggactcagccgatgtcgagtctgcaaggagatctcactgctcaacgaagctaaggagtccctatgaatttgacgatcaattgaagacgcgatggctcataggtgactacgtataaaaggaatagagaagacaaaagaaagacaaagcggtccctaaggcgcagcgtagagtaccttgtgaaccacactcgcaaggcatacgctgccagaaaacagaactcatgtagaaagacggccacagagtactaggcacaactgattttacaggggaacacagcgagataatgcacactgggacactaggatgatacaaaacgttgtacttagagtgaggacaccttttacaggtcgatacacaagtaaggtggggcataagagtagatacacaaaaaggaacatcaagatagagacaacatgaaacaggatgaagaaagcagggtcgaaaaacggattgggggttgctatagattactagaggaaagaggacaaaattaatctgatcgttagataagaggaccgatgtagtgtcaaggtataaaaaagttgaaagaaaaaagtatatagtaaattagactataagttgagatacttaaggattatgaaaacaacgttgaacaaatttttcga

SEQ ID NO: 530923 - DNA, 412 bp, Homo sapiens
ttaatttttcccaattttaaaatgaattaaaaaaagaaaattgaaaaagttgggatgtttttccccccccaaatgtcctgttaaaatgtgacccccgtgttggggggggggctagtgggaggaacttgggtcatggggggggacccttcaaaaaggggtttggggggcccccccagtaaacagggggttccccctttatgggttcccatgagattggggggtttaaaaaacccccgcccacccccccttttttttgttcccttttgccatgggaaaaaaaaaatccccttttcccttcccccaagatgggaagtttcctggggattcccgcaaagccaagcggggggggggggccaggttgggccagcccccaaaattgggggccaaaaaacccctttttttttttgaatta

SEQ ID NO: 530924 - DNA, 154 bp, Homo sapiens
ttgactcatttctaaatatttactcctcattatgataattagtttaatatatttttaggcctctacgacccaagctaagtcctcatatcccctgtgacctgcatttacacatccagatggccggttcctgccttaactgatgacattccaccac

SEQ ID NO: 530925 - DNA, 178 bp, Homo sapiens
cgacgagactgagtgacgaggatggtacgacggaagacacagaagaaggtgcagagagaacaggagaagcgtcatcctctgatgagggcagcgacttccagcagtagctcatcagagtccgacgatgacatcggacgtcgcggcaggagcagctcagaacgctgccctcctggcagca

SEQ ID NO: 530926 - DNA, 447 bp, Homo sapiens
  misc_feature (27)..(27): n is a, c, g, or t
  misc_feature (160)..(160): n is a, c, g, or t
atctctacaaccacagggcgaaactanttggtgtttgggtggtggggtatggtcccccatcccaaatatcttggagccctcatcagggctcggggtgggtccttgcccggcggggggtcacacctggtgccctattttaccctcctttatttccccgggntgttggggccccgtgaggcccgggataagcggcagtgcctcaaaaagtacggcctggcctggcaggagaactgcgggggtgtgcctttccgcataatgccctacatttattaaaggggctccccccccccaggtggggggaggggcccatttatcccccagcacccccaggaccaggagccttgacccccttgggattcaagggcttgccccccccccagccctggggatgaaccccctcaaaaaaaggggggtttagagcaaggaaaaaaatgaacccgggggcca

SEQ ID NO: 530927 - DNA, 139 bp, Homo sapiens
actaaggcgagctgctgtggccacattcctgcattctgtgcaggtcccgaattcacccccaagtctggcgtcaagatccaggccctgcaccagttctgctgcatcctcctcattgctggggccgaggtggccggccatg

SEQ ID NO: 530928 - DNA, 135 bp, Homo sapiens
tgttacctttcctgagcgtcggtctacgtgacagactgtagctactgtacaactacactaacctacgtttacacttaacctactgcgactgttaacctacttacttacctacaacttttacaccacttttccaca

SEQ ID NO: 530929 - DNA, 224 bp, Homo sapiens
gctcgtaccccatttacagcgtagggatcgaaatttcgacacttacagacttgggcacatgctttaaatcacatatgcgattttcacacgtggggaaccttaaggtagtgcaacggcactgttaatcacccagggtttttcctttccctgatggaaatgtcgcacacaattgtccgatgactcctttgataccacaaggacagcgccaaccccacagttaaatg

SEQ ID NO: 530930 - DNA, 704 bp, Homo sapiens
cgcgggtgaacgggaggctgcaggatggtcaagctgacggcggagctgatcgagcaggcggcgcagtacaccaacgcggtgcgcgacgggagctggacctccgggggtataaaattcccgtcattgaaaagtctaggtgctgcgttagaccagcttgggatggctagtgattttgtcgtgaccaatgagatcaggaaactggatggttcccctttgttgagaagactggaaaacattgttaggtgaacaacaacagaatatgccgtataggtgacgggacttgatcaggctctgcccttgtctgacagaactcattctcaccaataatagtctcgtggaacttgggtgatcgtggaccctctggcatctctcaaatcgctgacttacctaagtatcctaagaaatccggtaaccaataagaacgcattacagattgtatgtgatttataaagttccgcaagtcagagtactggattcccagaacgtgaatcctaaaagagcgtcaggaacgcacgatgaaacattgttcaggggcaaacggtggttgcacagtttgcacaatggatatttgccaggagaagcaaaaatttataatccaggtgctggttttgccaactgaccaaaaagaaccggttgcgccatctccaggggatgtagaagcaatcaaggaatgccatagccaaaatgcttacaacttctggcta

SEQ ID NO: 530931 - DNA, 350 bp, Homo sapiens
cattgaactcatagtcgttttatttgcaaaaaaataaatatttctattttgaaaagcatttaggccgggtgcagtggcttatgccggtaatcccagccctttgggaggccgaggcaggtggatcacctgaggtcaggagttcgagaccagcctgatcaacatggtgaaaccccttctctactaaaaatacgaaagtagctgggcatggtggcagatgcgtgtaatcccagctactcgggaggctgaggcaggagaattgcttgaattcaggaggcagaggttgcagtgagccgagattgcgccattgcactccagcctgggcaacaaaagtgaactccatctcaaaaaaa

SEQ ID NO: 530932 - DNA, 1347 bp, Homo sapiens
  misc_feature (1064)..(1064): n is a, c, g, or t
ggtgccacccacccggagccggtgagtgcagccgcccgccctccggtagatctgcggcctggcggagaagtcgggaggggacagtgaagggagggctgggcccctgggcccatcctccgtctcagcctgactgcggaggtgcatgcccactgcctgtgaggccccacacgtgacccgtcagaaccagcgtctgctgcctccgtctcacccggtaaccctctgaggcatgagttgggcaagatgcaagtcggtcttaagaccaccgccaagcttctgggacacctcgtggagcaaagaacggctgggaagcacaaacccacctccgtcttttcccattggctgtggcagccacgcagaccagacactcgcgagcaatccatcaggggtaacgaccccccagaggccagggggaaggggccccgggaagagggctagggggcagccgggaccattcgtttccatgcgggagcgagtccagatatcagaaaggctagccccgtataccaggcggttccatcacttcgtttctcaaacggggcctggttgtggccatgaaagcggcgagacatttggcccttccccacaacccttggatcccaagtaccttcgcatcagacaaagattcccaccatatacaagcggaagacaccgagtgggccgccgcaacgggattggactaccccgccgcaagccacattgtgcagccgacacggggcacaacgttcgtggggtgggccaacttcttttccacagcgaatgtgtgcagcagggcggccatatatctaggcacgcaacgacaaagcaggcagctttgattgcacccggccggtatgatagacacaaatgcgacaggtgcgaacttcacaaggtgggcgaactaccgcccaaaaggcgtggggatatctcaaacagttggggcaaatttggacccccagcgcgaagaacgggtgggagcatcccagtgcatacagagcgccatcggaacgaggggaccaacacagttcgttgcccaagcccccaactagcagaagcaggaaaccccattaccagcgcgaaccgaccanagtatacggacatgagacgagcactaccaacgacaccacgagacatcggaggatccacacacacgcaaaacgaagcggtgcggggaccccagacgcacaacgacctagcagctcagacacacgccctatcacaccagcagcacacccagggcaccacagagactacactggtcgcacagcagcgacgcctccgacggagcagtggacggccctccgccacacgaggggagcacccaccgcccccgagcggggaactcaccacacggtggcggcaacaccgcgc

SEQ ID NO: 530933 - DNA, 2622 bp, Homo sapiens
cggtacaaattcgacaacggtaaaacagcatttgaaacagaattagaacgtatgctttactcaatcagtgacgcaggctttgaaattccagacgttgattttactttcgacaacattgaccaattcttgaagtcaaagcaatataaggcattcattcgagttcgtccacaaaagaacaatccagaatacactgaagctattttcatctcaaaagaacaattcgacaaagaaatcgaaaaacaagcaaatgacgcatttggtgacgtagttgacccattcgcaacagctacaccagtaacagacaacccatttgcttaataaatgcccttttatagggcgtaaataatcgtgcgctatccacgttaaaagggtaagaaaaggagtattatcatgaacacaaagaagttagcagtaacaaatggagtagtaggacttgtcggtggaatcgcactgttgttaggtggttggatcgtattgtattcaggcaacaggtggaacaggacgttcgcaattgtaaatgtgttattcttattattgaaaatcgcaacgcttgttcttggtattgtaggacttgtacaatttagcaaggaagcagttatcacaaaggcacctagcgtattactagttgtcggcggtgcattggcaattatcccattcatggggtggatcggtggtattctttcaatcatcggtggttcaatctacctagcaatatcaagaaatttaagtaacaaaatggcgtttatcgccgtacatattaaaaaaggagaccatgacatgattaacaattcgtatctattaaaggcagatttaaagcgtgaaaaggacattcctttaatcagccgtgaaagtattatcaaattagctaaggcacacgaacgtggcgatgttagatatttaaatgaagcagaaactaatgtatacgacttactgacaaaaatagaagtaaagcggttagctagtctgtacaagtcatttatttttgatttctcaattgaagatagtacagtgtcatacactttcgcagatattgaagaagctatacgtgataatatcggtgtcaaaaacaagcgtttgctagaagatagtactaaccttatgagtgatattatcagattcgcagtgacaccagttgattatatatttgattttcataaaaatgacaatggcaatttagaagtacaacgtgatcaagtattagaacgatttatcgaagttcttgaacagcagacgtatgaaaacgtatggtctgacttaatgaaatatccatttgacaaccagacacacgggatacgcaaacatttaatgctcggtgtcgcagcgtcaacaggtaaatctattatccttgaagctattggtaagttatacgaagcgtcagcttcattcaaatcaaacagacctgaaaacggctttgacgcagcaaattggaacgctgacattattgataagtttgttgtattgcttgatgatgataacccaaacgtctcaatcaacgaagactacctgaaaaacttcctaagcaataatatgccacaacaattagcacgcggtggcggtcaacgttggtcagaaatttattacgggtcatcggttatcgctttaaacacagcaccagacttccttaaaaaccaacaaaacaataagcgtgtcattttcttgaagttgacccagtcaattgaagaaatgttcacgtcagaagaattaaatcatttacacaatttagagcctaagcacatcttgggttacgtcaattcagaaccaacaaagttgtttaagtggcgtaatgactggtcaggcgttattgaagacttgaaagaagatgttaagcaacacatctcaatgcgtggttacgcaagccttaatgaccttaaaaagacgtttggcgacaaagttatgcgtgactatcaacgaacggttgaaaaggctaaaaacatcacagtaaacggtgaagcgttctacggtttaagacaagacgcaatcattgatgagccttatcgtgtcgatcaactaacgtttagtgcatttatcaacttacatgacgtgattggcgaacgaaattttgaaagccttgacgagtttaaaaacgatattgaagaatacggaaagttgaagaaagaagagcaaccactattcagtccagctgtttatcatgacgagttgaccaaagcaaatctaacaggctttgttggcgttgttctggatattgacggtgcaaacgcagcagacatggacgagctagaagataaaatcgctatgactggtatatcagcagttgcttgggaaacggcatcaagcacaccgtcatcgttgagagcgcgtatttggttctatcgtgtcggtggtggtttggaagaatatgctagtctagttaaaaagattgcgatgaagattgacgagccatttgaccgtgctagcatgccagctgaacatcgtttcttcattggtggtacaaatgtacgcctaatcaatacagacagcacagccgctgaaaataagccaatgacagacatgaagaagcgtgggctagtccgtgcagttcagaatgctaaggacggcgaacgtgagcagataacttactgggcattaatgcgagcagagcaagaaaacggtggaaaagaattc

SEQ ID NO: 530934 - DNA, 394 bp, Homo sapiens
  misc_feature (197)..(197): n is a, c, g, or t
atgagcatgtagtcatgatgcagaaccttttttttttttcttcgtttggagaacggagtttctctctcttgcccaggcgggagtgcagtggtgtgatctcggctcacgtgaagctccacctccggggttcacaccattctgcgtcagcctcccaaaatagcgtgggaataacgaggcaccgtgccacacacacccgngctaatttattggtatttttagtagagacggggcttcaccatgttagccagcatggtctcgatctcctgacctcaggatccgcccggctcggcctcccaaagtgctgggattacaggtgtgagccaccgtgcccggccagatgttagaatctttaaggaagacctcgtcgatcagaattcaggaggaagtactaaag

SEQ ID NO: 530935 - DNA, 222 bp, Homo sapiens
ccaggctggaacattcgtttcccttcaattgggtgggtaactcaatggtacggccttaatcgaatgactaggactagcacagccgctgaaaataagccaatgacagacatgaagaagcgtgggctagtccgtgcagttcagaatgctaaggacggcgaacgtgagcagataacttactgggcattaatgcgagcagagcaagaaaacggtggaaaagaattc

SEQ ID NO: 530936 - DNA, 703 bp, Homo sapiens
ctcagacgaggccacaggtccccggtcatcctcacctgcttctgaaacctggggcgctgtggtgggaaacagcccagacaggctgtcctcaacactctctactgcaaactacacacagttttacgtcgccagaaagaccccaaatttctattcacataaagaccgataccacgatttcaagttccacgccgaaccgtcaataggcagaggacaaagaggacgagtgtgccccatcctgtaactttcactttccttcaggtgacctgatgaacggccatgacggcgcacgacggtccaaccgccatgggggaacagggtcatgccagccgacatgccgagccagctgagctccaaatccctcgacatccgtcactcgcgcagaaagaacgaaccgttgccgctatccggccatcaagggtcacacgcggccctgtccagaacgcacacgccgcgggccagcccggcaaccccaagagaccgccttcggtcattctcgtcccgttcctccatgaaagaagcagagcccgttggaatggccttccctggccattcaaggcaacaaggcgcgtggtccacccctttcgcttccaattgcccttggcgacacctttacaaaccgttccggagctggcccccaagccacttggttgcccccaaacgcgcgggagccccttggcgcttttaaagggcacacgcgcacccg

SEQ ID NO: 530937 - DNA, 122 bp, Homo sapiens
ggggacaatcacagatctgatcaaggtacttgactcgcagacaatgatggtcctggtgaattacagtcgtgctttaaagccaaatgggagatgccctttgaccccacaagatacatcatcag

SEQ ID NO: 530938 - DNA, 107 bp, Homo sapiens
attcgcgaatacacaccatccgcgacccagatcctgtcatcaaggtgcccgatactgtgcagattgatatagggactggcaagataatcaagctttatcaatatttg

SEQ ID NO: 530939 - DNA, 966 bp, Homo sapiens
aacttatggctagtagagccggtgttaatcaggccgaggggccttgaggagctgctttcagcccaccgctgcactgtgggaagccctttctgggctggccaaggccagagccggctccctcagcttccaggaggtgtggagggagaggctcaagcgggaactgggtgctgcgtgcggctgcttgcgggccagctggagttccgggcgggcgtgggcttggcgtggccctgcactcagagcagccagccggccctgccggccccggtgcagtgaggggcttagtacctgggccatgcagctgtggagggtgtactagggtcccccagcagtgccagcccacccggcgctgcactctgatttctcacctgggccttagccggcttcccatggggcagtggcttgggacctgcagcccgccatgccctgagcctcccacaccccctccatgggctcctgtgcggccgagcctcctcgactgagcgccacccactgctccacaggacacccagtcccaatcgagcacccaagggctaaggagtgcgggcgcaaagcaggagactggcaggcagctccaactgcaagacaccgagagcggggattcaccagggtgaaagccagctgggcatccatgaatctggtggggcttaggagaacctttacaaacccatgaggctaaagcatacaatacacccaaaacagggagagaccatggataacatagactacaaaggagtttggtagaagacaaccaaggaaaaaggaacccaaagaagtaaaaaaaatcaagagggaatgtaaaattgcaccaaaatagacaacatctgtatcataagcatggattcaagaaagaaggcacggaaaaaaacgtataaagaaaaagctcaaggggataggagaagaaaacaaaaaaggagacaataatctaagatcaagggtaagagaacaaacaacaaagaccgagtgtct

SEQ ID NO: 530940 - DNA, 606 bp, Homo sapiens
tcattaaacactgcatttgaacattacatttatctccattagcagaactgggatccttatttagaatcttttgaccacctatcctgataatctgcttcctttctgaaatgaaatggaacaggaatgaaaatgtgctttgctattaaatgtcatgggcagggagggactttttcagcttccctaaactaatctcaaactccaggcagcatttttattttatgattatagacataagatccaatgtgcacttgcgtgcttaactttaatactgcatgcaaaataggggcatcatgaaattaattaggacatttatttgcagccatgagaaagaaaacacattactatgtagcaattgcctgctatcctttaggtggcagtatgaagtaaggagaggctggctgtgatagttactgcataggatctcttaccaacaaacagtcacaaggaaacacaaatcagtttcctgtcagacatggccttcttgaatcttctgcattctgattcctttctctacgggcacgttcctagtttgaattccacatacatgcccctgaatcttgtccattattgcgccatttccctttggtccacacacggtactctccg

SEQ ID NO: 530941 - DNA, 110 bp, Homo sapiens
tgttgatgggggctatagctgcatccgaggtgctggtggacagcgcggaggaggggtcccttgcttgcggcggcggagtggccccttcaagaaggcggggacaaggaggc

SEQ ID NO: 530942 - DNA, 332 bp, Homo sapiens
ttgcaacagcagtgagtgggcccacacattccttctacagagaatttctatgaatgcccactcacttgccgagttccagggccaataggaccggatggtatgcatatcccgccccttgtatatgatttgcttccttttggttactaggtcttcgtatgtgctatgtccgcgtgtcagcgaaacaagcacttactgtgtggggtgccgcccgcctgagtggtaatctccttggccagcactagtcccttttgttcgttcaaccatattggccaaattcctttccatcccaggatcacagtatttgctgttccctctgtttgcttgttccgctg

SEQ ID NO: 530943 - DNA, 438 bp, Homo sapiens
gtactctgggggctgcggtagttgaccctgattccagtgacacgatgacctgactgggagtcagatagacatgcaaagagaggacaccctagaacttcttcctgaagtggctcttagcttatattctcagcagagttcattctggtgaggcaagacgtagaatgtcatctttcactctaatgctttttataccatagatatgagacaactagcctgttattcagaccaatataccccccatggttttcccccaatctccctagcctctgctgcgagaagttctggagaagcagccagtgctaagccagaccgagacccgcgacttagtagaacgctgcatgcaagtgctgtactaccgagatgcccgttcttacaaccgggtgagggatgtgctgggaacctaattggcgggctctggctacttgcaatccccggtcg

SEQ ID NO: 530944 - DNA, 99 bp, Homo sapiens
attctgaatctttaatgaaaatcagcccagagcttgttgtaatacagacataactgcaagagcatgcccacagcttagagaggttgtaccaaatttaga

SEQ ID NO: 530945 - DNA, 971 bp, Homo sapiens
  misc_feature (13)..(13): n is a, c, g, or t
  misc_feature (16)..(16): n is a, c, g, or t
  misc_feature (21)..(21): n is a, c, g, or t
  misc_feature (80)..(80): n is a, c, g, or t
  misc_feature (127)..(127): n is a, c, g, or t
  misc_feature (196)..(196): n is a, c, g, or t
  misc_feature (201)..(201): n is a, c, g, or t
  misc_feature (205)..(205): n is a, c, g, or t
  misc_feature (233)..(233): n is a, c, g, or t
  misc_feature (278)..(278): n is a, c, g, or t
  misc_feature (324)..(324): n is a, c, g, or t
  misc_feature (326)..(326): n is a, c, g, or t
  misc_feature (357)..(357): n is a, c, g, or t
  misc_feature (359)..(359): n is a, c, g, or t
  misc_feature (376)..(376): n is a, c, g, or t
  misc_feature (403)..(403): n is a, c, g, or t
  misc_feature (419)..(419): n is a, c, g, or t
  misc_feature (439)..(439): n is a, c, g, or t
  misc_feature (470)..(470): n is a, c, g, or t
  misc_feature (508)..(510): n is a, c, g, or t
  misc_feature (512)..(512): n is a, c, g, or t
  misc_feature (527)..(527): n is a, c, g, or t
  misc_feature (581)..(581): n is a, c, g, or t
  misc_feature (628)..(628): n is a, c, g, or t
  misc_feature (634)..(634): n is a, c, g, or t
  misc_feature (689)..(689): n is a, c, g, or t
  misc_feature (698)..(698): n is a, c, g, or t
  misc_feature (707)..(708): n is a, c, g, or t
  misc_feature (724)..(724): n is a, c, g, or t
  misc_feature (739)..(739): n is a, c, g, or t
  misc_feature (756)..(756): n is a, c, g, or t
  misc_feature (811)..(811): n is a, c, g, or t
  misc_feature (879)..(879): n is a, c, g, or t
  misc_feature (971)..(971): n is a, c, g, or t
atggaggaccatnagnacgtncccatcgacatccagaccagcaagctgctcgattggctggtggacagaaggcattgtancctgaaatggcagattctggtgctgacgatccgcgagaagatcaatnctgccatcttaggaatatggccatgatgatgcgaagagatcgcccagctgctgtctgggtcctacattnactantttnactgcctaaagaattcctggaccttctnaataggcacagaggcctccacgaagaatatttttggccgatactnttcacagcggatgaaggattggcaggagattttagtcttctgtatnanaaggataaacactctatcttatgttggactntntatgcctcctggttcgnaatgtaacatttaaaatcccctcactnaaaaagaaaattgcanaagtgccaagcatgctgcangcaaaaaaacaagccgcaaggacggacggangtgccacggcacggggcgtgccgaagaatgcgcggaannngnttcgtaccacctccntgcaacgcacgtaatggcactcacggggcgaaaaactgtcccgaaggaagaacntgcatggccccctgggtgaagggaccctgcccgagatcagcctggcntgaganttgggggcagcggcctcaggcaagtccctgtgggggaaagcccatttgacggtgntacccaggncgtcttgtnnggggttttgtggtgtntagagcccccacagnagccagggtgtttgccnaatgcctgcgtgtttcgtgccagaaagcggggggaaactctaacgggtgttacgnagtgggagggacaggggacagagcccctctgttggtgggaacgacccccacctcggaggagctttctngagcaggtgggcagaagatgcgattgactgggggcgacttttggggtagaggcagtgtctgaggggactgactctggcatctctgccgaagn

SEQ ID NO: 530946 - DNA, 698 bp, Homo sapiens
tgctcctcttcgccctgcttcgtgccctgtgacattcctggtctgtcctcctccggtccatctccttgtcttgtgcctgactacccctcgtcttcatgttttcctccctccagctacgccacttgctgggcgtattagcctcttctaggccatctgctgcctctcatctgtcggtatccctttcccatgtgccttggctcctccggattcgcatccctcgttcattgatttctcagtctacctatacgtcatatactacactgtctataaatacaacacacccttcctaaatgacagcaacttcgcaaaggattatagaaacaccagccctctcagttgaggacggaacctgtgccaggttacccttgctaattctagtaagtcagagtgtctcccttacttccaaaggatcgaactagctccccagcaatggatcctaaccagatcttagatgtctcaaaatgacagagcatagaatttagaattggatgacaaggaagtctaatgagattcaagagaaagttaaaaccaatccaaggaccccagtaaagtaatctcaagagttgaaagatgacatagccattttaagtaagaaccctagctgaatcttctggaattgaaaaaatcactactaggaaattttcaaaataaattggaagttttaacaacataatagagctaactgaagaaagaattta

SEQ ID NO: 530947 - DNA, 294 bp, Homo sapiens
tgatcattggggtgggtcacaccagtaatcccaggctcttagggaggccgaggcggggcagatcacctgaggtcaggagttagaaaccagtctggccaacatggcgaaatcccgtctttactaaaaatacaaaaattagccaggcctggtggcaggcacctataatcccagctactcaggaggctgaggctggaaaatcacttgaacccagcaggcggaggtagcagtgagcccagaatggggcactgcactccaggtggggtgaccagtgaagccccaccccgtcgggtggag

SEQ ID NO: 530948 - DNA, 782 bp, Homo sapiens
gccggccggtctaagcgggagtctcgcggttccactcgcggtaagcgagagtctgagtcgcggtggcagctccggtcgcgtcgagcggtgagcgagatcgggagcggtgagcctgaggcggcgagctcccggggcagccctgtgcgcgtgaagcgggagtccgagccggcgagcgcgcgcgaggccccggtttcggttgtcccgtttgtgctgggtgatagcgggatgcgctgaggtcagatggaggactcggatgcctgagcgggaggtgctgagcaatgaatggccgagtggattctgaggacccggaggagcctgacactgctccgtacctggacagcattaacaggagtgtgctggacttcgacttttgagaaaacagtgttctatctccctctcacacatcaatgcttatgcctgtctggtgtagtggcaagtactttcaaggccgtgggttggaacgtctcacgcctacattcacagtgtccagttatagccaccatgtttcctcaacctccacagcctcaagttttagtgccttccatgacaacctatgagatcatcgattcctcatgtggagcgatatcacgtatgtgttgaagccagttttcacacacgcagcaaattgtcaacttggaaaagcaagccaaattgtcccgggcatatgatggtaccaccttaacctgcgggtattgtggactggtaacattattggcaatgattattgcaacgctgcctcaggggtctatctatggtctctctcgcaatacttctggcacgag

SEQ ID NO: 530949 - DNA, 194 bp, Homo sapiens
ttgcagataactgtcttgctgcatcctcacttggttttcctccatacacacacattcttatgtctcaatttcctcttcttataaggacatcaatcagattggatcaggccccgccccccaaagaactcattgtatcttaattacctctttccaaatcttatctccaaataccgttaagctgaagccacggtcaa

SEQ ID NO: 530950 - DNA, 216 bp, Homo sapiens
gcacgaatctgccacagtatagctgtctctcgtgtccaggaccccgtcttgagccctcgtcaccttgtcctgtggcacaagcagagggtcttgtcctcagatcccgggaacgtcaggaacctcaggcgggtcctcgcttcctcgatccagaatccactctccagcctccctcccctgactccctctgctgtcctcccctctcaggagaataaggtg

SEQ ID NO: 530951 - DNA, 543 bp, Homo sapiens
tcagctcggccccattactttgtcacagcacaccaacaccagttacagtgctgggtctagcaggttgttccaccactgctactgccattacccatttcacaccagctgcccaggagcctgagaagttgcccacatgtctggcccactgctgccactgctagcatctgagcaagtcacctgaaggcccaataattggccctccaagacccactaacgctgttgtcagtttaagccactctgtgggccctagcacaggctcattcaacccaccgctgccatcactagggcctgaagactggcccacctagcatcttagttcccagccaaacttcaccacagccttcactaataagtgcaccttaagtcaatgaggaagtcacagataccactgatgttgtatactgccaaataaatcatacagggatcacactactataggcactcaaaatcaaagccaaagcaccctactcaacaaacaacacgtaaaatcttcaggaaaaaaatcctcccctatgaaagcaatttcacaaatggaagaagtga

SEQ ID NO: 530952 - DNA, 223 bp, Homo sapiens
gcgcagattggatgtggataccgagcggcaccaacagcgcgcggcaagagcgcttgagtgaaaagtagatgcagtagcctctgcctcggatatagtggtgataactgtgccatctgcaggaacacatatggatcttgcatagatgtcagctatcagcgtcgctactcagagagtgtactgtcgcatgggagtctgtaccatgctttcactccactgcatcttg

SEQ ID NO: 530953 - DNA, 460 bp, Homo sapiens
tggggggaggaacacacgacacacctgttttaatttttggaacgcatgtacaatgaccagcaggatactgagattctaatgtagagactgagtatgccaccacactagaattatataaggatacgtcgaaggacgacatgcacggatatacttgctggacgtagaccacttttggaagctggacctagaccagtattacagggttacctgctacacatcatggagaccctgcctaagctggacccagaaaatggctaaatacatttgaaaaaacggacatgtgagcctgagcatcttcattgcccgaatctacgatgatccaggaagatgtcaggaggggatgcccacgctggccacagttggggccaatgattgaatagtgacatacagtgaatttaagaactgatggtagctctagccgagaccctgatggcgaggctgttgacccatcctacataag

SEQ ID NO: 530954 - DNA, 130 bp, Homo sapiens
agatccccctttcatcccttctgataacaaggagctccccaaggctgacacaaaccagcttgctgacgaatgggaagctttctcctcatgtctttcaaaatccgacatctggtggcaggacaactgacct

SEQ ID NO: 530955 - DNA, 192 bp, Homo sapiens
atgatgtgatcttggagtcgtgaaactgcttgacagccaggccggcggcaattgctaggacgcgatctccatccaccttcatgatctgaatggagtgggctcgggcgcggtgaccgggcacacatgtatcggtagcactgggtgacagcgcactgcagtggtcagagtcaccggaatccccggcacataccg

SEQ ID NO: 530956 - DNA, 884 bp, Homo sapiens
  misc_feature (42)..(42): n is a, c, g, or t
  misc_feature (73)..(73): n is a, c, g, or t
  misc_feature (81)..(82): n is a, c, g, or t
  misc_feature (145)..(146): n is a, c, g, or t
  misc_feature (182)..(182): n is a, c, g, or t
  misc_feature (200)..(200): n is a, c, g, or t
  misc_feature (209)..(210): n is a, c, g, or t
  misc_feature (227)..(227): n is a, c, g, or t
  misc_feature (231)..(231): n is a, c, g, or t
  misc_feature (268)..(268): n is a, c, g, or t
  misc_feature (326)..(326): n is a, c, g, or t
  misc_feature (339)..(339): n is a, c, g, or t
  misc_feature (364)..(364): n is a, c, g, or t
  misc_feature (368)..(368): n is a, c, g, or t
  misc_feature (467)..(467): n is a, c, g, or t
tgtaatttatagttgtgttctcattgttgtgggttataggangtttagtattctcctttaggtggggggacantgagggtnntattagtgagaagttaggagttgtgtttccattcatctttaggttttcaggtttcctccgttnnaggtgaggtcatgatagctatggataggtaggaagntgagttctgctgtggcanagaattttnnttaaaggaaaaacaccntttncaggggtcttcttccaaggggggttcccaccaccacnccttgaagtttaaaaaacagttgaaatcttgtgggagctggtctggctgctcctattngcagtcaccatcnagggtgcttagggtaagaggccctngaantgtgacctgaacggactcacagagctcgtggagtgaggaggggagctgggggaacacgggggcggagggtacagctgggtggccgcatactgcaatganggctctgggctgcaagactgaggacttggcacctcacagtcctgccagtttaggacggagctttgtttacagcaggagcagtacagcagctccatgacccggaagcagttgtccagcagggctttgggccgcaccagcttcaggtttggccctggggcattcaagagggacaacacggattccaccttggggctgacctccacatccgtgaggccctgctggacattcagcagcagcgtctgcacctcctgcaggtacttccaggatgggtggccctcgagcagcacgtcctgcaccgactcagtggcactgaggctcaccaagacccacagataccgcagctcccgctcgctcacctgggccctcagcctggtgacgttggcgattctgaacaccccctcgtaaggcacactgatc

SEQ ID NO: 530957 - DNA, 575 bp, Homo sapiens
tgactggacccacactacctcaacaattctagtattttgccccggcgaccgcacagtgaatgtggagtgccaagattctctgtaaactccacctgattctccttactgccctttgataatcgagtggacattgactcaagtttgtctatctacactcttcggggagccccttaaaacccggattagacttggagattatgcttttggttatggcttctgatcatgctatattgtggtagaagcctagtgtctgtatttttcaaattcagcacgggctttaattcctgggtaactacgtcatagctcctgctagattgatggagtgatggaaatagacaattgccattttgcagcccatcaatgaatagatggatctgggcatgagacatcgacacttggtaatatcctccagagacaataagctgttgtttgcccctgacagtagaatactttacctccaaggaagtagtcttataaaaacaaatacagctgatctgttcaagtaacaatttacagtaactacagaggacacgaaaacatggtaaaacaatgttgtcagggataccattggacta

SEQ ID NO: 530958 - DNA, 129 bp, Homo sapiens
gggaatgtgataacctaaacaacctttgctttgaaattccatttttccctctttccctgagttggattgacctacagagttaatttcctttgtatttttttaaaaaaatattaaaaatcaacggtctca

SEQ ID NO: 530959 - DNA, 328 bp, Homo sapiens
gatagacacacgcacacagatcacacacacactacagagagagagagagagagaaagagatcagctccaagcattaatgtgagtatgctgaaagcacgcagcgcgtatatgtaccaatataaagcaagaaagaggtggctcgcagtatatttaggtccttctgccataaatacgtttaatacactgttgtatctatggactttgctggctcactgagtctctcccatatgtagctataacttgtaacagtgatcaggaaatcgcattattagcacatatatcacccactgagcttcaaagaagatgaatactctttgtagccacagct

SEQ ID NO: 530960 - DNA, 234 bp, Homo sapiens
gaaagaaaagaagggatttgggccaaaagcaaaaggcggccccaaagacccggggaagggccgggggccccaggggttgaggggaattccaaagagggggaaagtggaggcccggcccggaggggtttggggcccagggaacctcccaaaaaggcgggggaaatgggctgtttggggaattcatccatggctttgtggatttttggaagggtgccttgagttccaatttggaat

SEQ ID NO: 530961 - DNA, 222 bp, Homo sapiens
acaacatgtagtcctcacgcgccaggggagcaggcttctgaggcaaggttcagccagtcaagaacaggccttatctgctcagacaagctgcggtgattaaccttactggagtaggaagtttaatgcagtcacaggcagctgcagttgcgattcttgcagcatcaagtggctatggcagcagcagcagcacaaacagctcagctacatcatcatcggcataca

SEQ ID NO: 530962 - DNA, 858 bp, Homo sapiens
  misc_feature (6)..(6): n is a, c, g, or t
  misc_feature (76)..(76): n is a, c, g, or t
  misc_feature (79)..(79): n is a, c, g, or t
  misc_feature (86)..(86): n is a, c, g, or t
  misc_feature (97)..(97): n is a, c, g, or t
  misc_feature (156)..(156): n is a, c, g, or t
  misc_feature (189)..(189): n is a, c, g, or t
  misc_feature (200)..(201): n is a, c, g, or t
  misc_feature (216)..(217): n is a, c, g, or t
  misc_feature (220)..(220): n is a, c, g, or t
  misc_feature (222)..(223): n is a, c, g, or t
  misc_feature (240)..(240): n is a, c, g, or t
  misc_feature (247)..(247): n is a, c, g, or t
  misc_feature (261)..(261): n is a, c, g, or t
  misc_feature (275)..(275): n is a, c, g, or t
  misc_feature (287)..(287): n is a, c, g, or t
  misc_feature (289)..(289): n is a, c, g, or t
  misc_feature (292)..(292): n is a, c, g, or t
  misc_feature (300)..(300): n is a, c, g, or t
  misc_feature (305)..(305): n is a, c, g, or t
  misc_feature (309)..(309): n is a, c, g, or t
  misc_feature (315)..(315): n is a, c, g, or t
  misc_feature (317)..(317): n is a, c, g, or t
  misc_feature (325)..(326): n is a, c, g, or t
  misc_feature (340)..(340): n is a, c, g, or t
  misc_feature (359)..(359): n is a, c, g, or t
  misc_feature (385)..(385): n is a, c, g, or t
  misc_feature (389)..(392): n is a, c, g, or t
  misc_feature (397)..(397): n is a, c, g, or t
  misc_feature (399)..(399): n is a, c, g, or t
  misc_feature (409)..(409): n is a, c, g, or t
  misc_feature (416)..(416): n is a, c, g, or t
  misc_feature (425)..(425): n is a, c, g, or t
  misc_feature (429)..(429): n is a, c, g, or t
  misc_feature (433)..(433): n is a, c, g, or t
  misc_feature (439)..(439): n is a, c, g, or t
  misc_feature (472)..(472): n is a, c, g, or t
  misc_feature (474)..(474): n is a, c, g, or t
  misc_feature (479)..(479): n is a, c, g, or t
  misc_feature (490)..(490): n is a, c, g, or t
  misc_feature (507)..(507): n is a, c, g, or t
  misc_feature (515)..(515): n is a, c, g, or t
  misc_feature (565)..(565): n is a, c, g, or t
  misc_feature (569)..(569): n is a, c, g, or t
  misc_feature (578)..(578): n is a, c, g, or t
  misc_feature (580)..(580): n is a, c, g, or t
  misc_feature (589)..(589): n is a, c, g, or t
  misc_feature (593)..(593): n is a, c, g, or t
  misc_feature (602)..(602): n is a, c, g, or t
  misc_feature (610)..(610): n is a, c, g, or t
  misc_feature (619)..(619): n is a, c, g, or t
  misc_feature (627)..(628): n is a, c, g, or t
  misc_feature (650)..(650): n is a, c, g, or t
  misc_feature (662)..(662): n is a, c, g, or t
  misc_feature (677)..(678): n is a, c, g, or t
  misc_feature (690)..(690): n is a, c, g, or t
  misc_feature (697)..(697): n is a, c, g, or t
  misc_feature (711)..(711): n is a, c, g, or t
  misc_feature (713)..(713): n is a, c, g, or t
  misc_feature (733)..(734): n is a, c, g, or t
  misc_feature (771)..(771): n is a, c, g, or t
  misc_feature (773)..(773): n is a, c, g, or t
  misc_feature (832)..(832): n is a, c, g, or t
agagcnaaaatgataggcataaaatctcaggtatcagaaagactcaaaaggctgtttttcactttgttcagatttngtntccaggnattaagtgtgncatacagttgttgccactgctgttttccaaatgtccgatgtgtgctatgactgacaacnacttttctctgggtctgatcaatttcccagtanaccattttacnncttacggcgtcaatnncananncctcaacatcatcagcnccaatcngaagtccttgctgnattgcgtcaaaagncctccccctatntnccnctgccatncccancaancccagncncctcattnnccccatattctgtncatgtaacaggccaagtgnatcaatgaagtctttattattctganaggnnnngggangnggggggaatntggggcngggaaaagngggngggngggggnggggggggggggggggggggggggggggggggntnggggnggggggggggntgggggggggtgggttngggtgggnggggggggggggaggggagcggggggcgggggggggggcgtggggagcantgtnctctgtgtnanttccgagcnattncaccatganttttggtnttttttcantcttcttnnaatccacaagtgcctcataaantagtcttaaaanggtgtgctttttttnnatggtgagattncagttanaaatccattttctnanttgatccagctcagttgggnngtactggatggcccacaagatgctgccactttataangntgcaatacactgtgtatcttacaggagtcttcttatcctcccgtggaaaaggttgcttnaacactgcagtctcagagacgggcgt

SEQ ID NO: 530963 - DNA, 1732 bp, Homo sapiens
cggacgcgtgggtccacggcccgggcacgcgcgcgcacggacccacaccccggcggcttctcacaatcgcacacacacatacacacacacaccagcaaacaaagggtctggacacccccggtgccagtatgacgctagcatcataaataagcacatcacgtatcagggacacacatatgtacaagcaaagactgggcaacgacgcatacagccaaagagagaacacacatcgaaggagaattactctcaccagacggaacgcacacaatacattatacacataacaacaagatactaataatacataaacacaactgtaaacaacaaacatcacctaaaacaaaaatctaaaacaaacacattatcagatacaaacaacaaacacacccacaaaaatttcaccacaaaaacaacacaacaaacaactaaaacaacaaaagccggctaccacaagatggcctcacacgtaatagacgacaagggaggagaacacaatcgaagcaacgaactcaatccatagaaaaccgtattatagaaatcacactcaccaccacaagccaactcaactacgacaagatctcatacaaaagtcactcacaatacacagccacaaacatcaaccacaactacatcgacccgcgaccacgcgaacggagaagcgcgaaaaaagaggaagaagaagagacgaaacacgtcggaccgcagacaacagagcgaagatacataccgaagagagcaaaacaagaaaaaacggaggaagagacagccgagacaagaggcaggcaaagctaacgactagtcgcaaccacaacgacgacgcacatacaagaagagcggaaacacagaactaagaacacaccaataagatgacaacatagaaagaagaacgaaaagaagacacaccactacacacaccggagacaacaacacgaccaacacaatataacaaaaataaaacatataaaattataacaaaaacaaaacatacataaacaaaaacacatcaaaaaagaaataatacacaacaacataccaaaaacaaagaaaaaacaaataaaaataaaaaataacataaacaacaacaaaatataataatataaataaactatatgacaacaataacacacaaatcaaacactacacaatattaacataaacacacatactaactaaaacctaaaacagaataaccaccagatatatctcacaataaacacaaacaaatcacacactcccaacctcaaaacactaaaacacagagcaaaacgataaagaacataaacacaataaaacaaacataccaacacatacacacataccatcatatacacaacatcaaacaactcaataaacatcaacacaacaacactccaacactcatacatacattacagcaaacaacaactacaacacatcaatacaagataaatttaaaaataatttacacacctcaataatctatatgacaagacacacaaattcaacccaatcacatcacaccatgactccaccaaacacatatacacactaaacataccactcacatcaattaaataaatcataacaacaataccattacgaacacagaccagcaacgaacaaagatcaacagacacaattccacaacaacccacttcacaattataatcaacaacatatacacaatcaccatacaccactcacaccacaacattcactctactaatgacatccaaacctatcccacacaaat

SEQ ID NO: 530964 - DNA, 613 bp, Homo sapiens
agggtattcacgcagagaatcgttctctgttggacgagggcaagagagacaggtggggccgaagggactggtgatgccgtgtctggggaaaaccttcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggataggaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaatggcagaaggaag

SEQ ID NO: 530965 - DNA, 193 bp, Homo sapiens
cccaagtagctgggactacaggcactgcacctcacgccctgctaatttttatatttttagtagggatggctttcaccatgctggccttaagtgatccgtccgccttggcctccaaagtgctgggatttcaggcaagcgtcaccacacccgacccctcactagtatttcagcatttgggtactacgctttggca

SEQ ID NO: 530966 - DNA, 178 bp, Homo sapiens
cttcctgcttctgccgcttctgtcttctgcaaaagtggctgcttcctgcttctgcccctacttctgctgcttcctgacttctgcctccatgcggtctagttggatttagggaattgacctctcgtgacgagtctcactgactccacgggtcttggtaggggtacccgagctcgatatt

SEQ ID NO: 530967 - DNA, 549 bp, Homo sapiens
  misc_feature (28)..(28): n is a, c, g, or t
  misc_feature (33)..(33): n is a, c, g, or t
  misc_feature (338)..(339): n is a, c, g, or t
  misc_feature (396)..(396): n is a, c, g, or t
tacggtagaagaatcagagggaaaatanttttnggcttctattttgacaagtagcatttccacctttctcattctcctttttcctttctgctccaaaaattcaaagaggcaggtaattgaaatggacggtggccagtgtgggcagggagagaaatatgaatcctctttacatccttaatcctaatgtcctttaagggacatttggctatttattgaggttctttgtatatttacggacagtgacttggccaaaagacctgggcacttggctaacttttcaaacattatctaacctctgaatctggaataaccaaactgtaagttgacttaattcacannaaggcagtgatgttgaaatagcatgagtagagtgataagtgtgatgcaaatgaaagncatatcttcattactaggctttatttattaaatatagctaaagtactctaaaggtatatgtctacacttttttgaacatggataggttttacataactgtactgaaagaaagggcactaattactaatgcgctcttaaataagaatttaactt

SEQ ID NO: 530968 - DNA, 225 bp, Homo sapiens
gaactggtgcggaccgtgggaatccgactgatcaatttgtacacagcattgagaaggtccgtggcgcttgctgacgctatggacgctctgccctgtgctctcagtgttacagtgattaaattcaatgaagcgcgtgtaagcggcggaagctactatgactctcttaaggctgccaaatgcctcggatctaattagtgacgcgcatgactcgctgaacgagattac

SEQ ID NO: 530969 - DNA, 321 bp, Homo sapiens
ggttgactctagagtgatcccaatcgccacgacaaggagctgagaccactgacgcgcaccaccacgcccagctagttttttgtatttttttttggagatgaggttttgccatgttgcgccaggttgatctcaaacttctgggctaaagaaatctgcctacctaagcctcccagaatgctggggtaacaggtttgagccattggccctagcctaagtttggctaagtccctgtttcactacattctaaactttcaaattgaattcctgttttggggtactaagggtttttggttggttggtctgttttggtattggtttaag

SEQ ID NO: 530970 - DNA, 265 bp, Homo sapiens
  misc_feature (39)..(39): n is a, c, g, or t
  misc_feature (96)..(96): n is a, c, g, or t
cggcacgagaggaaacacaacgaggacagtgtttaaaanaaaaaaaaaaatgatggcaaggtttttttgtgtgatttttgttgttgttgttgttgnttatggagtcttgctctgtcgcccagcctggagtgcagtggcatgatctctgctcactgcaacctccacctcccgggatcacttgctcaagcccaggaggttgaggctgtagtgagctatgactgtgctactgcactacaacctgtgtgacagagcgacaccttgtatt

SEQ ID NO: 530971 - DNA, 342 bp, Homo sapiens
gcctcccaaaacactgggattacaccgctggtgtggtggctcatgccagtaatcccagcactttgggaggctgaggcaagaggatctgtggagcccaggagttcgagaccagcctggccaagatttaaaacgaaaacaatcatgggattccagatgtgagccactgtgctagcagaaagatgcctttttaacagggctcctgttcatgaacattatgagtttccgggtccacttggtttagcgtgccaatcatagcgcttaccttgccttgcttttcgtttctttccttcctttcccaatggttgtcaaagtttttaataggctttcgctcctcctttgata

SEQ ID NO: 530972 - DNA, 230 bp, Homo sapiens
  misc_feature (130)..(130): n is a, c, g, or t
atagccgacgaaagtgcaatatatataagtaatacacatgtaagctaacagtgtgactctgccattactctctaatttattaaggtaatagtaaaactcttaagagaggctgtagaaataactctctttnggttctggaaaggctcaccactgtagtaaaaactgaatcactttgttgtacagcagaaattatcacaacagggagttcctgctgtggtgccgtcggctaa

SEQ ID NO: 530973 - DNA, 333 bp, Homo sapiens
cgtaggaaggaaagagaaagaagaaagaaagaaagaaagaaagaaagaagaagaaagaaagaaagaaagaaagagcaagctgcagacttaaatgtccctgtctgacagctttgaagagagtggtggttctcccagcatgcagtttaagatctgagaacagacagactgcctcctcaagtgggtccctgactgccaagtagcctaactgggaggcacctcccagtaggggcagactgacaccccatatggccaggtgcccctctgagacgaagcttccagaggaagaaccaggcagcaatatttgctgttctgcaatatttgcttgttccgctg

SEQ ID NO: 530974 - DNA, 329 bp, Homo sapiens
tatgagctggcccgactttggtcaacgggcctgctgggacggccagtgcggcatacccccatcctctacactcatacccacacaagaccctgtggtggctaaggggcagaagtgtattgcaacacgttatggggaaaatcaagttatggagccagctcccaggaaggagaagccgtggaacattgccagagagaatactgaggatcagaggcatctaccaactccacagtcagggcttgaagagtaaggggctggtggtccttgaagccacagtcttggggcgagtcccatggagctaggaaggggaagacggaatccagggtgcaggc

SEQ ID NO: 530975 - DNA, 255 bp, Homo sapiens
aagggggtatccttggtgggccttagccagggttcatgcctgggaaatcatgctatgcaacagatctgggatggaagggattgtctagggaagaggggagaagtgacaggagaggtgaaggggacgagacaggtgagtgggcgtgtagacaggcaaacagacaggagcagagccatagggcagagaaaagggtggaagaggagagagagagagggagagggagagggagagggagaggggacctttggtcgacgc

SEQ ID NO: 530976 - DNA, 327 bp, Homo sapiens
cttaaagttgacttgaacttgagtggcaatgcacctggatttctgatgcttatgaaaacagccacaggggatacaacccactgcaaactttcttcctggcacagtctctttattactgttatgtatcttatcctgtggtgctctactgacagctgtcccactccaaaagagtaacaaaagcaggaagaagtgaggggagagccagacacctgagtgagcagttatctctggagccccctccctggccttctggaacactgagcacacaagatgtttaccaattctgccttgagtgatctgcaaggaacccacgcgggtaccgagctc

SEQ ID NO: 530977 - DNA, 534 bp, Homo sapiens
  misc_feature (85)..(85): n is a, c, g, or t
ggtgtgctgaggtctatctagaggatcccgctcacccggagggggttgggcacggcatggggagctgaggttgccatcgccgtgntgaatctttattcagctctgacagtggctagcagcaactaccgtggcatccggaaggggggtgtggtgatgctgatcttgagcaaggcccggttatttcgggagaacctcatcaggtatggcatccgggtggaccccatccaggtggtttctctgtccctgaaggatccctatagctggcccgccccatgcctggttatggcggccaatgtcttggctggtggctgcattccaggtagagaagcgcctggggggtgggtgccctgacggagcaggcggaactgctgctgcacgtggccaaccgggccaccattctgtgctccccaggggcggtggtctgacgggtgagagtctatcactccagggggctcccggtgggcgctgatggcgcacaccatcctcttcctcaagctcttctccaaccgagacgtcaactcatgggtggccgag

SEQ ID NO: 530978 - DNA, 647 bp, Homo sapiens
tggtacccactttgtgtgggggccgtcttgaccgcgcatatggtgacgagagttcagaaggcgagtatggaacaacagagcctagcatctaaggacgctccacatatgtttcccagtgtataacacgtttccccgcagggcgcgcaggtccaagcagacacagatcactgcaggttaacacaccaccatacaaggccgtggcctgttcactgtcctgcagtgctagcagtgtttcttgcagaacggatctgtaaaccaaaacacactgccaaacccctgccaatgacaaaacagacccacagaccatacataccctggtccccaggcaacccactactacagacagaggcatacagaccctctgggctgttcagatggtcagtggtacctaataagaccagggcagtcaactcattggattcacccagttaccagaggtgcagcaggtacatgccctctaacctttatcaggccaaccctcgacccaccaacccatctcctgtggcttcaccactgcaaaagcatccaaacctaaccaccacctgcgtgtgtgcccaccaggcttgaatcctaacaggtctaggcaggtcttttaacaggtgaaggatctagtcctcccacgggatccgtgcacgttaacgattact

SEQ ID NO: 530979 - DNA, 184 bp, Homo sapiens
cttcttctaccactccctccaacatacaaaccaccccccccccacaatctagctttgctattatgaagatgacacatggctgagacacagcctgattgaagatttgattctacttttggaagaatgcgacgccaacatcagagcgtcctaagggaacgcagtcagagggaaatacggtgtgtgt

SEQ ID NO: 530980 - DNA, 103 bp, Homo sapiens
ttcagttttcgccctctccaaaactgccccagcactgtgattagacctacacctcagtcttccattctgggcgtggcaatccacaatccccatcctcacaccc

SEQ ID NO: 530981 - DNA, 223 bp, Homo sapiens
ccccatcacagcgtagcagctttcttgtgggagggtcttgggccacgtgccctgggctggcctgtaggctgtcacaggtttattcttggtcctgcagacaatcatgacatcatctccatgaagctgttccagctgatggtggagcacacgcccagagcgagagagagcatcgagcgtggaccagagatctgagcccagcggtcaatcttccttcaagttcgcc

SEQ ID NO: 530982 - DNA, 207 bp, Homo sapiens
ctacaggggttggggttttttttgggggggggccctaatttttcccatacccctgggggaggaggggttacggcccgtgccccttgggggttgatggggccagtggaaaggggtggggttccctttctttccccccacccccaggaaggggggggggacacagggccagtaggggcaaaaggtttttaataaacagaccccccccca

SEQ ID NO: 530983 - DNA, 1414 bp, Homo sapiens
gagccatgcgtccgcgtacgcgtggtgtcgaaccatgcgtccgatcataatcgaaggcttgggcgaactgacgtaggttccctctgtatgtaaatcggtgtgtgccggagtatggcagtttcccctgcagtaatcaagattagagcattcttgactccttacgcgtccctcatctgcctactccatgcgtcgcatcgtgctatagtggaggccggagcaaggacaggcacggtaggaagcacggtctagccctcgcctgtaggcagtggacactacacatccacacacctggaagacgctacacggtagaagatctaaggcacagtgcttcgtgcacttaatcaccgctagtgcacgagtggtctcactgctagtcgtgtacgggggccaactcgaacttgtgactcagcgagacatgatgactcgaaatagtaaacgaccgccctgggacccactaatgacacacattaccccaatatcgactcccttcattcgtctactggaagtgccggtccttcgaatcatcggggaaggtgccctttacctctcgtcacattattcaatcctcgcactagggttccaataagcgaatgacatggtccatttcgactgaccttacattagcagtagaacaagaagcaccgggaagggccgtcgacatggacgccagcataagcgttatcggaaggccccggagtgggaaagagaggaggagaagccccccaattgttcctagttgccaaagccagcgtaattgcatggagtatcaggcccgggatcgagccactggaaaggttatgaatacgttgcgtcataatgccttagccgagaggcctgctgaggacataaactcatccccacaaatgagttcggtaacacatttaacataacatcacggggaaacgaatgccagtaaaaccaatgagggaacatacccttacggtctcatgccgatcggggcaaccatacgaaaataacagaagtgggacagtcccccacgagatagaatacggcgcatgaagacacaacccaagaatcattaaaacaagaaaggacaatcagaacggatagaaacacaacacagggcactattaacacaacaacccaactaaaccagaaacaagacgcaaaatccacaaccggaaggagcaaaggaaaaaaagcaagaaccacgcaccaacgcaccaagaacaggacacaatgaacacaaactaggggacacggaaccagaaccccacaagaatcacaagacaaaaaacgaaaaggtggcagagaggaccaagaaaaaagaagcaaacaaaaagacgagaaagcacaacgaaacacatgtgagcaaacaaaaaacacaaaaaaaaaccgctgacaccaagcacaaagacaccaaaggagacaacaaagagacgagcaaaaacac

SEQ ID NO: 530984 - DNA, 802 bp, Homo sapiens
  misc_feature (133)..(133): n is a, c, g, or t
  misc_feature (136)..(136): n is a, c, g, or t
  misc_feature (140)..(141): n is a, c, g, or t
  misc_feature (802)..(802): n is a, c, g, or t
gtgggaagctggtgagaaggcacacatctctccacagttagatttgtgagaggagtgcctgacttgggagagtgatccaggctcacacctgtcctgtcctgtgtcctgtctgcagacagcggaactgaaccgngangtgnncacaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccagggggctgattggcagcgtgcgagggagcagctggcccaggcttcgctgcgagatggagcagcagaaccaggaagtacaaaatcctgctggatgtgaagacgcggctggagcaggcacgattgccagctaccgactggcctgctggagggagaggatgcccacctgactcaggtacaagaaagaaccggtgagcacccgtcaggtgcgtaccattgtggacagaggtccactgatggccaggtcatctcctcccgcgagcaggtccaccagaccacactcgctgaggactcaagctacccctggcgggccagccattgaggcagtggaggcaggccggccaatactgccccaaaggtctcccgggccatcttccaggcactcgagaactcccatggattacagggtccgcttcccacaatggtctcacgttagcccttgatggaaaattagaagcttggctagacatctaataaacagtagaagaacgcaaacn

SEQ ID NO: 530985 - DNA, 296 bp, Homo sapiens
taccgtggaggtccacatgcagcttccctggagggcaggccggagccgtcccccccctgggcttgaggatgctgcaccccgtgggcttccaggcctgcccagatgatcctacaggcctctgtcctggcgccatcctcaggccgatttaacacagcaatgatagactcttcataaaccctatcaaaataaatttatacagtgggacagaaaggagaaaaaaaaacattttttaaaagaaaaaacaactgacccacaaaaaaaaagagatctgttttatgcaaaatacaaaatttttc

SEQ ID NO: 530986 - DNA, 449 bp, Homo sapiens
  misc_feature (12)..(12): n is a, c, g, or t
  misc_feature (32)..(32): n is a, c, g, or t
ctattctagaanaccaccagccacagtgcctnaaatcactggaagcatcagtagatcatttggcataaatagaaattagggggcatttgtcatttaaatatgtatttgaaagcttttttttttttttttacaaaaaaccattttgctttgttttataacagtattgactggcggggcatgatgctcatgcctgtaatcccagcattttgggaggccgaggcaggcggatcactgtggtcaggagttcgagaccagcctgaccaacatggcaaaaccccttctctactaaaaatataaaaattagccaggtgtggtggtgcacacctgtaatcccagctactcaggaggctgaggcaggagaatcacttgaatccggaaggcagaggttgcagtgagccgagatcacaccactgcactccagcctgggcgacagagtgagactctctctc

SEQ ID NO: 530987 - DNA, 1657 bp, Homo sapiens
  misc_feature (170)..(170): n is a, c, g, or t
  misc_feature (1184)..(1184): n is a, c, g, or t
  misc_feature (1187)..(1187): n is a, c, g, or t
tattggctccgtaacaaaaaaatttaaatggcaataagggcacaggtgaagagggcgggaatctcatttaaggcatctccctcaaacacaaaggggcccagcagcgctgacgcaaaaagaccaggacgacactcctcccttcatataccactggggcgccctggagacangctccctcctggaggatgtacgggggctacccatgttcttgtgggcagggtggcctgggggcgcaagagaatgtggattaacgatatgagataccacaagttaaccctcttcggtggagcaaatactggccaacacaaagaggcagatctctatgggtgccctggcgatcaaaagtgtcatgtgcgcaatatgtgtcccaggggtgttcaacacgcttctggaaggcgacatcggagggggtggcgccaacactgtgcgcccctaaagggtcctgtgcgcgacaagttctctctagaaaaacagggttctcctctcacaaaggccccctttactttggggggacaaccatatgtggtggggcgcctattcttatccattcgggcttggggagccacaaaacaaggaagtaaaagaggcggtcgagcctagtgtcacaataccaatcttagggtgagagactacggccgggaagaacaaaaataatagccacaacaaatgcgccatttccagaagcccccacgcgacatattttctccccacatgatttccaagcacacacggtccaactctttgtgtcgccttcttcaccaacagcggtgttaccaagtgagggctggggcccacacacaaggggtacaccaacaaaagaacattatctatgcggggacacatatatttctcaccaccacacgatgtcgacaaacaggtattgggaagatatgtgagggcccaccaaggtacatcttaccaaggcctcttctcacaatccgtacaccacgggagggacacccacccctgagcagcaaggagggccagtacattatgacataaacacacaagaccaagcagcgacaaataaaacgtagggagcgaccaacgggggcagtccacaagagacgtcggacacaaggtagcccccaagaaagctcacaaagaagggggggtagaagacaaaattctcgccttgcacgaaaccacaagcagcttcgggggcgaggaagacgtatccacgnccncgtccaacctggaggaccatacaactacacacacagatcaaacaaaaaatgccgaaacgtcggggaaacaccagggcgtacacaatagtactcctccgaaaagaacgacccagaaaccaacaaataacggagcgtcacacaaccaccacagcagagagaagaggagagataaggacccacacctactaaacgacacagagtcgaagaaaccacagcgaatatgaagaacacacctactatggcacagagggagaaagacccaaagaagcgacactcgcgaacgtcaagccacagaacgaccaaacaggagctcacgacctgaaataacaacacaaagtgtaggacgaagaacaccactacatacgaggggttatgacgacacaacaaacacaggcagagcaactccagaggagcccccaaaaaagaaatggaaaacagtcaaggagcacagactgtaaacaagtacagac

SEQ ID NO: 530988 - DNA, 1153 bp, Homo sapiens
accgttatggtaaatctaactgagtgccggaaaatctaagacagtaatggattgataacgtatgattccgggctatgatatcagagagataccttaaggtctgtctgaagctagagtcacacacaatcatgtttgacattgataatggagataagacaattgcaacacatgggcttttaacaggctccgctgtcatcctcatacgatatccgctatcggggtcaaaatgtttgatgcataggcattctgcacaggacgtgctcgacaggtaagacggataatccaagatgactcttggtctcgtaaggctagtgtctcgaatgtcactccagagatcactaatcatgtatcttaatcaccagtgaggtcgagtcttgaactgccattgagaggatcatgtcaaacagcgattcctttgagatattccgactacatagtagcgaatagttgctttaacagtagtcacattcaatttacacaacttatgttggctcattccaagaatgaagagtacgtccttgttcatctaatgtcctattccaaatgaagtgagagcgtgtcccactctaccaactcgaatttttaccctcattattatctctaacgcataattcacgcataaggatacaaaaatcactttacgcctataatcacgatatatcaacattagtccattatttcatacggacagaattaggctgcattgtcttacatccaaggctatattggtggcccatcaccggtctgcacctcgaacagtatgaatgcacgaactgaccctttgttgctttagccatctgaaggttctatgattcatgaggcgcgtcatcctattaatcttacgatgattatgtcatttaggaacattatagcgattccgggagtgctgtcgattctccgcagatgtgtctcattagtaatgtatactatctaaaaatatgttgtgctgttaggtggtctaaacctgaaatcctatcagtttgggcgcaaggtggatccccgaagccaggagtggaaataacccccggcgagggtggagccccccccttctacagtacccttagcggacaggcacaccctgtccaatacaacagagggggggaatttacaccggagaattagccttccaaaaaaaaagcggcaaattcgggca

SEQ ID NO: 530989 - DNA, 138 bp, Homo sapiens
gccctaggcgagtgaagtggactctgagggctcccgttaccccactgcgtgcggcaggggcgtggagggcagagggccgcggagggcgaagttgccaacatggctcagagcagagacgggggaaacccgttcgccgag

SEQ ID NO: 530990 - DNA, 774 bp, Homo sapiens
tcgaggcctggggttgctctactaaaaatacaaaaattggcggtgtgttggtgcacgcctgtaatcacagctacttgggaggctgagacacgagaatcacttgaacccaggaggcggaggttgccgtgagcagagatcataccactacactccagcctgggcgacagagtgagactgtctcaaaaaaaaaaacaaaaaaaaaacaggggattgggactctctaaagtggtccatgtgtaaatgtccgcaccaaccttatgggcttgtcctaggaagctattttggcagctaaggatggctggctcgccttgagaagccaactatcctggtggacctggagccggatggccggcctccaacctcccaagctggctccgggagtcacagtgggcccacccggtttatcacatttggactgggcagttctcccgagcccgccccaaaaagccatgacccacaggggtagattttttttttacactggattctataaagcacttttaactttaagtttttaaagagacaggggtctttctatggttggccaagggtgggtctcaaaactacgtgggtctcaagcaatcctccaatctcagttttccaaagtggtggggatacagggcatgagccacaatgccctggtctggtaaggcattttggagcttaaataatacattcacagcacgtggggggataatgctggtattccaagatatggtaaggctgaggggggaggatccttgagcaggagttgaaagttgagtgagttgtgac

SEQ ID NO: 530991 - DNA, 661 bp, Homo sapiens
tatcaggagagaagggtgagggaggagatccagggctggtcttagtcatcgtatctggtacatcttactcccccggagaaaattcttgcaaaaaggagaggatcctacacagaccaaaaatgctggtgtcagtgcttttacaaagtacctctggtgctgtagaacctgtagcaaggtgctcttggcaggcacccggtatagttctgccctgtcctcatcctcaaagtagacctccaaattatcagggcaatatttttgctctaggtcccaagagggtgtttcaccaaacatcaccattagatgatcaataaacctggagtcctcatgaaaagcagagatgaagtccgactgggcatactctgggtatagaaagagcacaggccagctcagcctgccctggccatctagactcagcctggctccatgggggttctcagtgctgagtccatccaggaaaagctcacctagaccttctgaggctgaatcttcatcctcacaggcagcttctgagagcctgatattcctagccttgatggcctggagtaaagcctcattctgattcctctccttcttttctttcaagttggctttcctcacatccctctgttcaattcgcttcagcttgtctgctttagccctcatttccagaagcttctctctg

SEQ ID NO: 530992 - DNA, 130 bp, Homo sapiens
gcaggacgtccagtctcaaaaagatagttacgaaaattagcgagggtgtgctggttgatgcacctgtagacgcagccacagactgaggcgggaggatcactcgagtccaggaagttgaggctgcagtgag

SEQ ID NO: 530993 - DNA, 170 bp, Homo sapiens
aaaaacagggagggaggggcatttgtggcagaaagatgcacaagaaatgctcaggccaggcatggtggcacatgcctgtaatcccaatcctttgggaggccgaggtgggaggactccttgagcccaggaattcgggaccagtctgggcaacatagcgagaccttatctct

SEQ ID NO: 530994 - DNA, 596 bp, Homo sapiens
  misc_feature (20)..(20): n is a, c, g, or t
  misc_feature (228)..(228): n is a, c, g, or t
cacactttctgggcactgcnggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccantatcacagtaaagagcaacaatgtgtgataatgggctgaaaacaggaagtcctccataatcattaggatgagagatgcagttttattttgaaaagtaaatgtatctttcagagtgacagactgtgaaatggaaagaactacagaggggacgatgttccaaacaaaaaatggcatcacctgtcaaaaatggagttccacttttccccgaagaccttaggcagacttttcccttcatctttgggttcatctacgggaaagggtccctttgggccttggaagggattgtttccaggacccccttggggttacaaaaacccatcctttttaaaggcccttaagtttaaataaaggaaaggcctttgaaacgg

SEQ ID NO: 530995 - DNA, 153 bp, Homo sapiens
gtatatcctaaagcatgttctaattattgagaagcatagaggtagttaagggctataaaccagcgcatggtatctgcattagttaccactgttagccattaagaacatattgatagtgccattgcaggtcttcacacaagctatccagtgaaa

SEQ ID NO: 530996 - DNA, 922 bp, Homo sapiens
  misc_feature (20)..(20): n is a, c, g, or t
  misc_feature (284)..(284): n is a, c, g, or t
cacactttctgggcactgcnggccagtcccaaaatggaacataaggaagtggttcttctacttcttttatttctgaaatcaggtcaaggagagcccctggatgactatgtgaatacccaggggccttcactgttcagtgtcattcaacgcatagcatgcttgcgggtgctacgtgtacacgccagcagacaagatattgtcgctagtgacacatatgtgcaaggaagactaatagatattccagcactgcgaaggggctagttcccaaatatccacaagtcaanagcagcgaatcatgtcgcttgtaggattaatgtggctttggaaaaactctaagtgtaaagctccattccccttatatatattcctatctcagggctaatggccagctaaggaattggccgatggttttacttattatggtggttgtgcgccaaataccaaggcttttcaaagaccaatttgggtttttcatttctccccttttatttctttttcccccggacacaaggcgcgccaaaggggtttttgtggggtccccccccatttttaaagggggaaaaaaaaccttttgtgggcgggaaggggagaaaaaaacttcggggggcggggcaaaaaaaaacacggaaaataaaacccattaaaattcccccaaaaggcggcaaaggggggcggttaaacccggaaaagtgggttatctctcaatttaaaaatccaaaatacaattacttcggtggacatattctaacctccattggtattccattaaaatatactttgggggaagctgtttccccaagcttttaccattccacacccccgtacaatgataccccatttaacggggttcacagaatccctgtgtccctcggcattatgcgggtcgtatatgggtggtttccatttcttacccttggctatg

SEQ ID NO: 530997 - DNA, 380 bp, Homo sapiens
  misc_feature (178)..(178): n is a, c, g, or t
  misc_feature (298)..(298): n is a, c, g, or t
  misc_feature (311)..(312): n is a, c, g, or t
  misc_feature (324)..(324): n is a, c, g, or t
  misc_feature (333)..(333): n is a, c, g, or t
cctgatttcatgttcaaaggtcatgtcctctggggaggcttcccttgatgctcaaatgaggtcagtgtctaggggggtaagctcttgtggcctgtatggcaccctcactagagtcttaagtcccacagcaataagggctttgtctttgcttacagtatatgctcagtgcctagggagnacccctcaccaggtgagcatttgacagatatttgtctagtgaaggaatgagcggatgaatgaatgagtgaatgaatgtcaggcactgtgccaaggcaatttgtacacatctcatttaatnccgggaaaccgtnngaaacttgcaantctcaactngggggagttcaacccagagctgagcccaacaccccaaggcccgggtt

SEQ ID NO: 530998 - DNA, 182 bp, Homo sapiens
acgccagatggaagctcttcaagttttagctatttccttgcatatctgactcagcaacatgtcccaggcttatcttgttcacttcctaactcagacctggaactcagccatttctccacaacaatcctggttcttatacatgtggagacagtacatggcaaaccacaataggggcactggca

SEQ ID NO: 530999 - DNA, 240 bp, Homo sapiens
ccttaacacccctccccatatcattgcccgatgatatttcctattcgcctacacaattctccgagtccgtccctaacaaactaggaggcgtccttgcccatattacatatccactccccatcctatgcaataatcgcctgtgtcacgatgatggtggatccatctagaagtctgacctgtcaggctatgcaatgcttggacgtaatctatggtcgagtagctagtttccctgtgatgtaa

SEQ ID NO: 531000 - DNA, 631 bp, Homo sapiens
gctgcaggcgttgatcgacactcgggagttgctctgctacgaaccagacggacgccccacattcacgacctgtacggctgaacatacccaaagacacaagccatctgaagaaacatatgaccttgctatgcgatcgattatccaaaggtgggcgggtctggctaagtaccgatcgcgcgggccgcctgaccatgggcatcccacctccttgtactacaatccgagagccggacctacaagaaagatcagtgttacaagactctacagaactgtttaccatccacagacatctgactgtagagacaccaatgcctgtagctccaaccgtccatggagtctaggaattactcaagcacagacgttcgcctgatatgtacactcccatctcaaggccgaacctgtgtgaacctcatgccagcacaaattaggagtgggcatgtgcatcctaaagcctaccttcctgagatgacatgcatagaaagaggggttgcttctttccacttcacatagacaactcgtgacaacatggggatgtcacctgaaacttggattgctctgtcgaggaaaggtagtagcgtttggcattcatctgcttactaggcgcagaatacagtgctgacattttttgggg

SEQ ID NO: 531001 - DNA, 142 bp, Homo sapiens
ccccgttagtagtcacacaatacagctgacaatctgatagagtggtacaaccagccaaaggaatccaggtaaagtacaaaaacgccaccttttattggtacctgtctgatttgctcgggaaggagggttctactttacacat

SEQ ID NO: 531002 - DNA, 1416 bp, Homo sapiens
caggttgttaatccagctaatggatgaattgatagatgcagcgctatcttgtgatttaagtaaatagataagaacaaaaatgatcaaacgataatcgtccccttccgtttataatgatagatctaatgtctgccagtggcacatatcaagataccggcgtggcacctaactgcagatcctactgcagctcgcagtgtgacaacgtgacgtgctgacttcatttcaagttactgaaggctactaagagtagtattctcttcaataaactataaagcttgcaatcatcaagtggagcgtgtttggccacattctgccacagaattcctgcgcgaagaagctgaatgcgggaatacgagtgacattcgtgattatactttgagctggatgcatacctacgttacttaatgtacgtggtatcatgcgtgcatatatgatcatggccttacatgtccccgagatggttgaaaagaatgcacgaaagcaatgcctccactggtaagcagttagcgcgacacattaataatccaccgagggacgaagatccaatccattgggcatcctccgtttgtatcgaactcaatacatggacagaaccgatacaaatcagggaacatgtagtcctcaatgtatgtgcagagacctttttgacagtccatttattcaggaacctgataccgaaaatcctgggagcaccaagtgcagatggatggtcactggaaaccaagtaattggcagaagaaaagggacacacaagaagtgaactttattgggacattcgtcttacagagacccaaaaactatttactgtgaatctggcatagcaaacagcagaaggtagaaacaagggatgcagaaaatccgaaatccaggggtctattcacctgggatatgtgaacaccacatgtccaacggtttgactctgtataacatcgaattgacaacaccgtgaacaacaacgataaccccaaaaaccattaggaataaagaagaaaaacaccaaattgtgcacgcaaacatagcggggacaccacaatggggagaagagagccacaaaaaaagagcagtgctattaacaacaacgggaatatcacggtaagagaaaacatatgaacagaaacgccccacgcagtgaaacaagcgagggaccgaacacatgaaataaaatataagcaacaccaatcataaaaaaaacaaagtagtaacataataacgaacaacaccagaactaacaaagatagaaaaataccaacacaagaatagtacatatagatacaaaatataacaacataacaaaaacacaaagaacaaaacaacaacaagcataataacaccacaaataacaaaacaaatattaaaataatataaatatagctactcatacctcttctctcacccattgtagtataaaaagaaata

SEQ ID NO: 531003 - DNA, 473 bp, Homo sapiens
  misc_feature (459)..(459): n is a, c, g, or t
tcggtcgatgtactagaggatccctgcgggtctctatcctgagctttagaatacctgaaatttgtaaatatattttttttccagacctgtcagcaggaaataagaaattttgtaaatttagagttactttataccagatatgcaaccagaactaagaaaacaattctctggataacaattaagaattcagacagagaagtcaatcaataaaagggaaagggatatctctccacagggcagctgtgtcaatttacttcacctacagaggccagataggtccaaatccccctactcattaggttatcccaatccaacatttcctcatcccaaatattcccaaatccagtttcactaacgtaaccccttcccacaatgagcaagtactctgttctagaaacaagacttagttctagtagttcagaagggaagtaactgtgaaatgtagtaaaagagggtacnctagagggaccagg

SEQ ID NO: 531004 - DNA, 842 bp, Homo sapiens
aacggtccggtgtcgggtggtggaaaacctgggcgtctttcccctttttgatgtgccgctttcacagtccttgttcaacgtaccagtgtgtgctgggtcccctcgtggtgcgcttaggaagcggtctcccgtcccgccggtggtttgtgtccaggccctttcataccgcccgctgtttttttaactcacgggcggggtttggtgccgccccacattccaggactgcgtgcgtctctggcccgcctcttcaaggttgtactagtcacaccccccgcgtggtatgatggggggctcgcacactatttcctcgcagtttgtggcttgccgccccacaagtgtcgctctctctaatgtggtgatcttcgcgcaattgtgttcttcggccgcccgggtgtgtgagatggattctgctccccaccttgtgtagttgttttcagaggtagtgccagcgccgtgtggtccgccacatccatctcttccgtcacatcgtctgtctgttcgagtcgagttaatctttccggtctcttgattcgcgaggatactgtcttaagagtgagtctccggtcggttgggttgccaaacctaaacaaaagagaagttttcttttatatagcagagagcatcatacaatcatgcaaaaaatttctcttatttatctatgatggacagcggcgcgtatcgataatttctcgtcctcttttatctcactcccctcctcttagttgtgccctttagatcactcaggaggtgcccccttcttttctattatttctttcaaacaccctcactcactccccactcactccctccactaacaaccccccccccccccccacataaca

SEQ ID NO: 531005 - DNA, 850 bp, Homo sapiens
  misc_feature (2)..(2): n is a, c, g, or t
  misc_feature (62)..(62): n is a, c, g, or t
  misc_feature (90)..(90): n is a, c, g, or t
  misc_feature (286)..(286): n is a, c, g, or t
  misc_feature (400)..(400): n is a, c, g, or t
  misc_feature (404)..(404): n is a, c, g, or t
  misc_feature (546)..(546): n is a, c, g, or t
  misc_feature (556)..(556): n is a, c, g, or t
  misc_feature (733)..(733): n is a, c, g, or t
  misc_feature (735)..(735): n is a, c, g, or t
  misc_feature (757)..(757): n is a, c, g, or t
  misc_feature (763)..(763): n is a, c, g, or t
  misc_feature (847)..(847): n is a, c, g, or t
gntttgtgtttgtggaatttgttgttttttgggtttttttgtagggtattggaatattaaantgggatagttagtggggggtggggtggngggtgttgggaatgaagagaagggcccctgtgtttgtgttcctcagtacgaagatgaaaggctggttaaggtgatagtccagcgggaaggtgaggtgggcaggctgcagctctgggctgggggtggttcccgggccatcctcgttccaatcaaagcaagcacggtgtttcacctgagttagcttgatgggtttgcntgtgatcttgctaaagtctggtgaatcaaacaaggattgcagcttcatttcctgcagggacttggtgacttcgctttcataactcagcttcagcttggggacagtgaggaacgnttgnacggtttttagttctcggtctatgttatgaatgaactcggaggtgaggatctcctctatgaaggtgaaattatgggttacttttagggggaggaagaagatgatactcatgcttccggtcaagggcagctgggcaatcttgnagctgagatntgaattcaagccatagcgtaaaaaagccttagggttcgacatcatggggacctcacggtcctctcttcatccaagtagaaatcctcgagggaagtctttctggagtcaaactttgttacccactgccccttgaagtgcgccacaccgagaaggagaatgctgatctcatcgggaatntnctttgtggacctggcgagcttncctttnatctgcgcctgcactcagttgttgatctcttgcaggttcaagcgagggttgccggtcaggactctggggctggtcccatatganttt

SEQ ID NO: 531006 - DNA, 740 bp, Homo sapiens
ggtgtattcttgtggacaattcatgttcctagagactatcgccttcgaatcactcgtaaaggttggcagtgtgacaacgaagaattcatccatccgagatctattgaacgagtgagtggcagctattggtcgtcgatattctaagatcacagtggtcgccgtgctttaacaaatgtctacacagttcttttatccattatgttcacggcgatgtgatccaaacccagatgaccccctaggtgccaccgagattgcacggatctatagaaacagacagagataagtacaacagaatatctcgggaatggactcagaagtatgccatgtgatggctaccttaagagtcagaataagctgcatttatagctggaataacactttaaattactgttccgtttcctcttcgatgtttcttatccggctgcatcccactatgcagacctcatcttgtttcaagttgtgactttgttggtatacctcgcgctccattcattcacatgctcatctgagagacttaagtgcttccagcttgggacaataaggtgcttttagaaagctgtaaaggtagttacaaggaggaacagttgggccaagactcagaatctttttaaacaagaccaagtggagcatgtgtatcatggtggtgcaatggtcttcagtcttaactgtggttcatgagactagaaagcgttcctcactgcttctaacatgctggaagaaatcattgagggggaaggagc

SEQ ID NO: 531007 - DNA, 216 bp, Homo sapiens
ggaaagttcctaaaaagccaatgccccccccccccctttttaaataaacaggggtcacttggggaacctagacttcttcccccatggtcaagtaacaaaaccccgcccccttttcccatgtttgatgtcaccaaaacccaaatgggaaacctgggtttaaaccccccagggcagcaagggaaccccccaaataaaatttttgccatcggggcccca

SEQ ID NO: 531008 - DNA, 963 bp, Homo sapiens
  misc_feature (25)..(25): n is a, c, g, or t
tagactaggtagagacgcgtggtanatcaggcagaggcccgtaccgacttgcttaggcttgcgatacaggtacagaggcatccccaaagatgtcattcttccccaggatggccacgactgacgtcgccccgcaggatctcgatggagccccgggagatgaagtacagggcggtgagcaggtccccagcatgcaccagtgtgtcccctgtgcggtgcatgtgtggtcttgaacattcatggccagggcccgaatggcagcccttgtgatggccccgtcggaagggttttgcagtgctgcagcagtgagcggttcagtgtgcaggcagatgtccagccctgcaggcactcagtggaagcccttcagcaccgcgttcatgtcagatgccgattggtgtaggaccagagcgtgctggaagtactacctccgagggctgctggcagcacgggtgattggcggatcttggtgtgaagctggatgaactcccgcacccgcaagcatctggtgtgtggtagctgggctgtgcccgagtacagccgctggatgatggccgacactgttgccgaagatgctagccatacattgagggagccacatgagcatgacgcagaatggcgcaccgatcttactactgagctggtgtcggagagacgacgttggcctgaagcacacacactggtgaagggctgcctcgcaaggtgcaagtaacgcggccgacacaataccgagtcccttgaattggcagggggccgcccacgccgcagcagaaggtacgggactggccaacaggacgccacgacccggcacccaaccggaaacagagacccagtgtcgactgaccacagccgacgcgacacatgcacggcaccacaacagagaccacagagcataccacagacagcagacacactgacgaacactcacacccacgacacggcgtaacacaaacacaaaacacaacagag

SEQ ID NO: 531009 - DNA, 361 bp, Homo sapiens
cgcgtcagatagagcagggtattcaccatgtagcccaggctggtcttgaactcctgaccgcaagccatccgcccaccttggactcccaacgttctgggattacaagcatgagaccactgcctctggactatagctgtttacaaaatgaggacccaatcaaggagcacagtgagtatatttatttattgtatctctttaaatctcttataatttatctaaggacagttccttaaactaattatgtgtcttaacaggacattgacagtttaagaagtatccaggtcagtagttaaaccgaatatccctcaattcagtttagtccaacagctttctcatgattcagctagtaatacataggcaa

SEQ ID NO: 531010 - DNA, 970 bp, Homo sapiens
  misc_feature (1)..(1): n is a, c, g, or t
ngacaacacagagaaaaaaagaaccctaataacaactacaatcacgacgatagactatttaaatatctcctgcaaactttcactcggtttctcgcgatactctctctcaacgacctcctctcccccgtcccaactcttgtgggggaccccccttctgttagaacgttgccacaatcgccaacttctgggtaaatagaggtaatgtccaaacacaggggacaccaacagaactcccccgaacacgggtcttaccagccctctcccccttcccttgattggcccttcttttccgacccaggacggcgggtcatacagcgaagcacccgtcggcggtcgccattagagagccaaatcaggcggcttgtcacaaacggggtttcttgtaagaaaccaggccgaaggagtactttcctcggctgcaggtgcaaaaccacagatgatcccgcccgcccggggccccaccaagaggtctcgctgagtccccgccaaaagtttcgcacattccttctaagacaagggacacatatgctcgccccccgtatagtgctttaaaacaagccgcttcctatagatacagcagagatcaagaaagcctctcgggcccacagacacccccgcatgtagcagcgggctccatgggtgtacaacaccacgttgtcctcacaccccacacgcccgcgcggtatttctgcttctccaaaacaaatcgcccccgtcgcccaacaaaaacaatataacagtgcgtcccccccaagaaacgtcaaaccatgcttggccccacaaacgcaataacaccatgctcatagaagaagtcccccacgtggccccatcttccggaagaagaacccaacagacgttttcctcttcagccgcaagctgttcttattatgtaggatgtgacacccccctcaaaaaaaagttcttttggggcaccaaaaaaaaagggaccaaatccgcgaaaaacaaaaca

SEQ ID NO: 531011 - DNA, 779 bp, Homo sapiens
agcataggctaggtaggaggccgggtggttaccatctctctgcggggcgctgacagctggaagagccgaacggataacgagaagaggagtggcgcggatggctgtcggggcgccccgaggacctgtgcctatgctgcccatggtcgaggagccctgtgcggaggcagctgcgccgttgcctccacgacatcgcactggcccacagggctgccactgctgctctggcctcctgcgcccccaccagcaccacagccacccagtcccacacccagcccacccctggcctaccctgtgccagagaggacaacgaggagtgacgaggatgagcccacagagacaagagacctcctgtgtggagcatgctggtgcatatagtgataattggatgggctacttatgtgatggatgagtgacgccaccctccagtgaccttcccaccatatctagtgagtacagaccccgagagtacagcatgattggcaagcctgagcgaggatgacccccgactgccaccaacacaaacgataatacaaccacacaaaaccataaacaaatactcaaacaacataacgaggcaacatccacacgagatgcccttggccccagctcataatgcgaacacagttaatggatggactctcaagcgagcagctcacgggaaaagtttgctcggataactaacacatgaacgaagtagtgtagccagccccacactcgacacggaatgatcacaggagtattcgacaacaaatagtgtacgagcactgctgcagccagac

SEQ ID NO: 531012 - DNA, 103 bp, Homo sapiens
gctaccgcaagggtctagctggttgtggctggtgctggtgtcggtgttccatgcacctgctgctctgtctgtgtacttgggacatgctgcatggcagcgtgtg

SEQ ID NO: 531013 - DNA, 379 bp, Homo sapiens
atcgatgccactcactttttgcccaggctggagtgaagtggcatgatcttggctcaccacaacatccacctaccgggttcaagtgattctcctgcctcagcctcctgagtaggtgggactacaggaatgcaccatcacacctggctttttttttcttcttttgtagagacagggttttgctatgttgcccaggctggtcttgaactcctggcctcaagcagttctcctgtctcagcctcccaaagggctgggcttaaaggaataagccaccatacccaccataggaataattttttttaaaaaaaaggacgtacaggttgtataggaggaaaactagaaattactgataaaattaactgaagtagaccgtggaaataga

SEQ ID NO: 531014 - DNA, 425 bp, Homo sapiens
  misc_feature (408)..(408): n is a, c, g, or t
  misc_feature (411)..(411): n is a, c, g, or t
aaaaaaaaaaaaattttttttttgggggcgcgcgcccctcctcttttgggggtgtgtttctcccccccgggggtttaaaaaaaaatcttttctccccccccccctcttttttttttaacaccgggggtgtggggggggggtccctccacagaaataaaagggggggccctttttccgggggggggggaaaaaattttttttttccccccggggtataaaaaagaagggggggggaggggggtttaaaacaaaaaaagtgttggggttttttttttaaaaaagggcttttttaaaaattttgtgttaaagaggcaaagagatttgggggtttttttgtgtttttaaaaaagggggaaaaaggaggttttggtgtctttttgggaaaaaccttaccctgcaagcccgtanttnacctggtggcgaat

SEQ ID NO: 531015 - DNA, 214 bp, Homo sapiens
atatgctatacccctgggagtgcttcgtcttctgcctgactcatctttggcaacttcaccaatcagatccacacgtggtcagcccactgtactttgggcatgcatgctgtggtcaccactcctgcaggactggtatgtcatcctgccacgtacagaccatcgaatccatcatgtctcaccccacgagaactacttctgcatcaccagaggctgg

SEQ ID NO: 531016 - DNA, 811 bp, Homo sapiens
tgaaagggacctagtcactttaaagaggcctttatctcagcacgagatatccaagcgtgaatgctacggcttgatgtcccattaggatttagcatcgagattcagatttctaactagtcttgatgtgtatcggctgtattataacacatttaaagggaaactagctattcatggtttataaacatgtacgtcattttcataaaaatatccagataggtaaactggaacgaaacatagctagcattctagtccaatggttaccaaactgcaacgaggctgtctgacacaagtttgcttgtttgcatccacagaaagttcccttgagatttctcagctaactgctacggttgccctggacacttgagtacagttcagcctatactctgtataataacgtagtcgacgtagtcaattaccatcgcttgtcaaaagtcctgaatgatccttggagacttgggagaaaacacgataccaggcactaccttaagactcccacatgaacagattttcaatcaagtttcctcaatccatccctggcacaaagtacaccatggtccaacaaagcgaggccgaacaactaatgccggaccctgagacatacacaacacacatatcgacgcggatactggcgctgacacatttgcaacaccaacccaaagccacagatgggcaagggaagatggccccaaaccgacggacaatatcacacacagaaccaccctgaataaggccccaacatcaacactctgaccgcattggaactccaggacaacgacaacgccacgatacaactcaaaactacaagggacga

SEQ ID NO: 531017 - DNA, 1113 bp, Homo sapiens
  misc_feature (429)..(429): n is a, c, g, or t
  misc_feature (540)..(540): n is a, c, g, or t
  misc_feature (683)..(683): n is a, c, g, or t
tttcctgtgtgtgtgtgtggcgtttgggtttggtgtgtttgtgtgtagtggtgtgtagtgtagaagaggcgaggaaaaaagaaaaaagaacaacaaacaagtatggtggtggctggtgtgttccttgaggagtctcccgtcgtctcttctcggaggggtctctctctccgcgcggcaccctgggtggccctaactttctccggcggccacttcatttattggatgggggtcgtattatttctatttccggggccctgcggagcgttgttcgggcaccctggcccatggggccccttgaacacgcgcctgattgtccgtggtagttgcctccgccgggattttgctccagagggctttgctgaaagttgttctgcgcccctgggagccaaccccagtgcgtgaccggtgtcgacgtccgggggaccgtcnggtgacccagattccggctacctctctcgggacctccggccgtttcttttggttgacagaccccagggcgtgacccccccgcctgctctcgggaggccttctttatggtgnaccgacctgaccccttgccctgggggaccccgattgttgcctcctgccgcttattggcaccattggccctgccccatgcgaaccgccgcaggggagactcacctccaatgggtttgatattggtggatgctggctcgggaatntttgcggcatgcgtggcacccgtttccccggggaccacccctgggaggtctatgcctgatctgtacttgttaccgagatcctgaagagattgaaaatagaagacccaggctgtctgctgagaaggccagtgacccaggaggaatttcagggtgaatggactgctcccgctcctgagttcactgctgactcagcctgaggttaccagactggtctgaaggtgtcaccaggtgccctctgtggcctattcacgccaattccctactgaagactggagcgctccagcctgcccccggaagaactggtctcgcagctccccctgctcaggcccctgaatgggtaggacgccacccctgactggttttaacctgtttttgcataggctcttaacccgcctggaaaaatggttgatggaaaataaacatcccgttt

SEQ ID NO: 531018 - DNA, 90 bp, Homo sapiens
gtggacacagccacatattactgtgcacacaggggactggggtctttcattagctgggattggtgctactttgacttctggggccaggga

SEQ ID NO: 531019 - DNA, 1321 bp, Homo sapiens
gtgcctttgtgaccctaaagacatccgctcccacccccatgcctgccagtgagaggctgctgtgctgcagatggatgtgccttctacatgcccccactgatcccactgacatggcccagtgaacatgtgaatggctggtgagcagaactggcatctatgagttcttcctgatgcaaaaatgcgtggccctgtgctgtgagtgaaatgtgccaggagaagatgtgaacagatgtgaccctcgatgtgtctcgaggaggacagatccaacgagtcagacgtgtgcgttacttcactcacctgcatccaacgtcaaagatccatcaaatgtcttcatttgcatctgtacgtcaatggtcaatggatcgaagctcacgttgctacccagattccatacatcaccgaatcacagaatactaagaagatctggaagcaaggtcagaggcatcctcacagagaggcccgctcccctggtaccccagatacagaagagtcacacgagtcccaaacgtcgataattcaccccccagtgcaaaggaccggaccggccggggtcacacgggtcacataggagacccccaatacacgctgagcatttccctacttgcttggagtctgggacttacctaaatttccaggcagaacctcacccaatcaccctttgaactacaaagggattcgggacgacggagaaccataatggcccaatccaagaatggcttgaggtgaaaatcatttgtgcattgtaaagacggaaatcacaggcgggacatacaggctgacgacaagcgacgccaagggggacatccaggggacaccccaaaaacaacagcatagacgaaaagattacgaaaataacgatggcgacaccagcaaataacacggacatcggaacgatagagcaagacgaataagacccacaataagcaactaaaagaacgaaatatacaaccaaaatcccataacatggaccggcaaataaaggtacaaagaacaagagtgatacacgataggaaaccaaagacacgagcaccagccaagtgacgaaggcaccgatgttgagaaatactgaataagtaaacacagcacaaatgatcagccgacagaccacacacgactccaccgggggaggcacaacgaagacaagagacaagagattcccaaagaaagccacaccagaccgaggaccgacacccagacaaacacacaagagaacaaagcaaagaaacactacaacaaacaaacacagaaaagaaaaacgaagaacgcaaacaaagcagccaacgcagaatagatgtagcaacacgaccaaagagccaaaaca

SEQ ID NO: 531020 - DNA, 1296 bp, Homo sapiens
atgcccctcattgacacaaagtattatactagcatttaccatctcacttctaggaatactagtatatcgctcacacctcatatcctccctactatgcctagaaggaataatactatcgcatgtgcattatagctacatctcataaccctcaacacccactcccatcttagccaatattgtgcctattgccatactaggtctttgccgactgcgaagcaacggtgggcctagcccgtactagtctcaatcatccaacagatatggcctagagtacgtacataacctaaaccatacgtccaagtgctaaaaactaatcgtcccaacaatgtatattactaccactgacatgactttccaaaaagagacataatgagagatcaacacaatacgaccacagcctaattattagcatcatccctctgctgatgttttgaaccgaaatcaagaacagaactatctacgactgattcgccgcgaaccttttgccatccgaagccccataacaagcaccgccatcctaattaatacactaccttgacgtccttaaccacgtcacaaatacatggagaatgcaaacggacaactaatgccagtagaaccactcatacgcgacgacaagcaaatcagaacagtagacatactcacacaactatcgccctgacgaagtctccgattaacgtaccacacccgtgtgcaacaggcgcaaccgaaacgcgactgcaactacgaagagactagctactcacacggaaaagacacacgaggacatccataccctatggacagacgcagaatcagacgacaagaacggcagccgggccagcgaaacagaccgtgaacggaaaggcaacaataagaatgcaaaaagtatacacgaccacgtagttagaggcgaccactgcaccgataatcacggacacaaagttaacgagacaacagacgatagagacacaacagaacacatgcagacagaggtaaggagtaatgggaccagagaaaaggtaaagacaacggcagagccgaggagctcagagggcacgcgaaacaagaaggtaggagcaggaaaggaacatggatgaggaacgcaagtgagaaccagaaggaacggctaaggccactatcgggggaagaataccacgaagcaagtgacaaacagggggataaatgagaaatcaaccgaggcagaaaagaactagagtggcatagacgatacgcgaaacagcaagggcagtgagagagcagaacacgcctacgccatcattggacggagacggagcatatcgacagggagagaat

SEQ ID NO: 531021 - DNA, 688 bp, Homo sapiens
ccgagcaatgagtgggctggatcggaacgcgaacctataacagcggtaatcactgatctgctgcctgtgatgatgactcgcgatggtgggtgtgaagacactgctaacggccaaggtctgtggatccatgtcaagaagaaccgatggccatctggatcctgggcacaacctgaataccagccgcacactgtgattctccagcactagatagatacatgtcaaggacacataattgcactttgcggttcacaatctgaactgcagagacatgagctctggtgactgcaaacacagactcatgtgatcgatctggacactatacatagtctcaatataggttggcattgcatgtatagcgccaacatatatgggaatacctgaagctgaagttgatacagaatttctacacgacggacatgctgatcgcgatgtactgacctatggagacacaattgacgtaagtatcgacggtgcttatatagaatgcatgatcaatgcatgtcgactgcattctatcatcgtcatgacatgcctctgtgggatgatgatatgtgtctagatactgaaaatgtgacatagattcagtttcataggtccagacacgaatgggtgacaggacgtgtaaagaagatgcctgctgaagctgatgtaatactgcatgatttgaatgacaatggactttgtccct

SEQ ID NO: 531022 - DNA, 1017 bp, Homo sapiens
  misc_feature (805)..(805): n is a, c, g, or t
cgccccggcgagcacagagcctcgcctttgcccgatcctgccgccgtccacacccgccgccagctcaccatggatgatgatatcgccgcgctcggtcgctcgacaacgtgagtccggcatgtgcaaggccggcttcgcgtggacgacgactgtccccccgggcgcgtacttacccctccatccgtaggggcagcccctaggcatcacagggcgatgattggttgggcaagtgagcgctcagagaggattccgtactgttgtggcgactgagtgtgctcagaaggcaaagagaggtctattccttcgagcccctggaagggaaccccaatcgtaaacatgggcgatccggtcgacccacatcatggtaatcggacatggaggagaagaatctggcccacccaatagcttctacaagtgaggcctgcggtgtggttcctcgtagagtagcacccctgtgctgttcgaacgcgaggaccaccaactggaatcgcgccaagggcgcaaagtctgctgtgacagatggacacccatgaatcattgtttattgtaccacgcctatacaattaaccctcagtactaagtgtcctgctattgctaatccaggggctgttgcatagtccgcccgtggttacgccctcttggtctggtaagctagctggggcaatcgttggattggacttccgggatgaacgggggatcgactgccatacgtggttgccccgatcgtatcagcaggcggggttattggtcccccttccggccgtattggcccattcccctggcagctctgggcacctgtggggtntgggcccggggggcctctttggccgtgacgttaccgtcggtggagaggaatccgttcgaagcgcagtcggacgcgcttgcgggctttcctcgcggccactgtggcgctccggggaagatcgctagcgtgactgtttacgccgaagctgggactagggtcgcccctggacttccggcacgggggtggcctccgcttggttcatccccctcgcg

SEQ ID NO: 531023 - DNA, 361 bp, Homo sapiens
gtggaggattactattgccatgtgctcacttagtgactctttgtccctttttgttaattctcatattatttcacacattttcattattatatctgttatggttatgtatgatccgtgacctttgacgttactgtgaggtgaagttaataaatgttgtatgtgttctgactgctgtaccagctggctgttccctcatctctctctactctccttaggcctccttgttccctaagacacaacaatattgaatgtaggccaattagtaaccctttgacaaggtacatagtcacctaagagctctgttgaagatgtacaagaaaatgttcttttcatacctgctaacaacatccatcctgcagtc

SEQ ID NO: 531024 - DNA, 345 bp, Homo sapiens
  misc_feature (81)..(81): n is a, c, g, or t
  misc_feature (120)..(121): n is a, c, g, or t
  misc_feature (123)..(123): n is a, c, g, or t
  misc_feature (126)..(127): n is a, c, g, or t
  misc_feature (139)..(140): n is a, c, g, or t
  misc_feature (142)..(143): n is a, c, g, or t
  misc_feature (225)..(225): n is a, c, g, or t
  misc_feature (244)..(244): n is a, c, g, or t
gcctctaagaacttaagtggaatcccccagggctgcagggaattcgagcaccgaggttgtttttgtggcaagtacattttngaaaagaagggccttgttggaagcccaggttgtggcatnncnggnngctgcgggcccnntnnccgtctgtgagcatccctgctcgcagatgtggctgcaggcagttgctctcgggtttccttccaggagctgggaagccggagnaaagctgcggttcctgttncgccgagcttctgaccttcctctgcaggacgtgtgctactattactatcgtaaaagaacacccctgtctacctcccacaaagttagaagcaaagggcattc

SEQ ID NO: 531025 - DNA, 1443 bp, Homo sapiens
  misc_feature (416)..(416): n is a, c, g, or t
  misc_feature (1034)..(1034): n is a, c, g, or t
  misc_feature (1090)..(1090): n is a, c, g, or t
gtggaagcggggttagtcagtgtacttgaattttgatggcttataagacctagaatggagactgaagctcttaatactatggatggctagaggtaaggagcctaatggatgtgcgcctatgaattaatactatactcacgaagctgccgagagaaatatacggggggaagaatgccctctggtacgagtctgaatacgaagatatcttatcgtagagttatcgcatttatcaactcatgaaatgtcatccctacgaaggatgtgcaaactgacgtgcataagtcgcgctggacgtccagtagtcaagaggtttggaaatgtgttacgttgcgaggccattatttacccttgatcgctgcgcattgtgttgttgtgaccggaaagcagttggagtaattcatctaacataaacaggntacaatgcaatattgtggatactaatcatgatcttgatgtgatgtgggtggcgcccatggtattgcttgcgtaagtattgtgaggcgttccccaggcctctgtccatagggctgtccactctcattctcttggaagtcccggagaacagtcgcggcggcaataggcgccatagaggcacataggcagtctcaattcagttgcctacacaagtagccaggacgcaagttgtgacaacaatagggggtgtcaatcgcggtcagaacctacgtcaacttgagtcgtcagactatagtggttgaatagacaatctctctccttctccggagtgaggtcaccattagccgcgacatcacattacattcggcgcatggggcatgtctggtggatagggcataagaggttgacggctctacggcccccagttcagaggttacgacgtacaagggctggggcccgccgcttgaacttagtgtgaggccgattttgcgcacaccgaccaattataccatctcccaggcaatttcagaggccctcttcatgtgaatcggtcttttataggccttagcacactttcggtgccttgcggttaagtttcgccttgggcgatgctgcacaanttcgtttgctgtaaataaagggtcgaggattggggccctggtggacagatcgcacntttgcaccacagggcggttgtggaacacacaaggctcattagaggacggtcctcaccatttacgttcaacgggttaacacccctatccggtagctatcacccacggtttggtgtacggcccctctttcaggtaaaaggaacccccttagataggcgaaattttttttcttcccgttttaatatacgtctattaacgtaaaaagcggtatgtacgataccattctggaattgcgtaacaaagtggggggcacaaatctacaaacgatattcaagttcgagacagaaacgacgggtatgttgaacgggatatctcaaagaaatcccccgctttggtcggatatataaccatctaa

SEQ ID NO: 531026 - DNA, 1309 bp, Homo sapiens
gccaaaaattcaaaaattagccgggcgtggtggcaggcgcctgtaattccaggaggctgaggcacaagaatcgcttgaacccgggcagcagaggttgcagtgacctgaggtcacaccattgcactcctgcctgggcaacagaatgagactctgtctcaaaaaaaaaaaaaaaaaaaaaaattatttcataatttaggcccaaatatttaattatttttaaccaagtgtgggtgtgggtaacaggtattttttttggcccattggctgggcaaattcctggttttggtgcaagattttcccaataactctgggccacaaggtgtggcacccttggatgtgtgggcaaacgttataaacaggtcctggggaataggggtgttctctaggaggtcctcttataacttctattaaggactggtatttttacaaaacattttttttacccactattaaaaatctttggggagtcccgcgtatatataggagtctcttttgaaaaaagcaagatcaaaaacaagaaaaacactatcgagagagggcaaaattaatatgggtgcagagagagtggagagagaaaaaaaaggaggagtaaagtagacatggggggcacacttgtgggtcataagaggatagtgtgaacacatgatagaccacgaaagatgattcttttgtggaccacaaataggggtgggcaaagcattatggaagagagggatacaacccaaatatataggaggagaggaccagagaaaataaaaagttcacgagagttaagcacacagaggtttaaacaacggtgaagttaaaaaatagacactcgggggaaaaaagagacaagcaacgaagcaagaacagccagaaaacacacacgcagaaccaacagcacgcaagacaacaggaaagaaagccgccgagagcgaaaaccaagcaaaacgcactaccaagagagcagaacacaaacagagaaacagacaagaaaacaccgagacacaacaccaacacgtgaggaaggaagcaggaaagcaaggaagaggggagaggcagagagagggagagaaggaaaacagagaggagagggtgaaaggcgaggcagaacaagagaaggagaaagaaaagcaaagacagaacaacaaacggaagagagaaagaaaagaaagagacagaagacaaagacaaaggaagaaggacaggaaagaggagagagacagcgagtaggcagaggcgcgaggcgagaggagaaaagagagagagaagaggaaagagcagaggaaaagaagagaggaaaagaggagcgagaacgaaaaagaaa

SEQ ID NO: 531027 - DNA, 375 bp, Homo sapiens
tgcccaccagatgagatccagctcggagcgtgcattttcaaacctcccctccatgtttctctctcctttttcaggcccagagcatgattcccatcaatgagccctatggagatggtaagtgtgtgccgggctcttcaggaccctggagatcctgggcggctgtgtgggtgtgtgtgaggggacaatattatgtctccggggccagaggaccagtggcaactgctgtgtggcatccacatgtaccccagtctagatgccctggtgtggggtctggggagggggtcaggcccaccaggggtgggcatgggtagaggaggcagctgaaggctgtgcagactgctccctgcagggtagcttgcagaccctagtcgacgc

SEQ ID NO: 531028 - DNA, 242 bp, Homo sapiens
tagccgacgagtgattcagcatttcgtcggtatttcaagactcggttgatgaaggggtctgagtgtatgtctcctatggagcatctataattgatcatgtgacgaatagtgctacgggacatgcatattactgagaactagtctattttccagctacgagagagttctacggtctgtagggttattcactgtcagtctgacctgattgatttcttggcctgtgggtattatatattagtaag

SEQ ID NO: 531029 - DNA, 183 bp, Homo sapiens
taaaatttggggggaaattttaaaaaaaaatttgccgggtttttgggaatttggtttaaaaaaagaaaccctttgtccaaaaaaaatccaattttcctttttaaccctttaaaaaaaaagggaagggggggggtaaaccgggtttttttttttccccccgtttaattaattcttaaaccttga

SEQ ID NO: 531030 - DNA, 834 bp, Homo sapiens
cgcagtggctctcacctgtaattccagcactttgggaggccaaagcgggtggatcacctgaggtcaggagttcaagaccagcctggccaagatggcaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaactaaatgaacacacatgctgctgagtccgcagggggggcagagcagaggacagcgtggcttagtgtactgttggaagaatggctcctcctgttcagcacttctgagcccttgtgcaacgcactggcacgggcaccatccagttcctggccgtgtgaacaaccacagctgactggggagcaggcacaggcctaaccgagcaagccggaatgggtcgcatgactccagctgaggtagctgagtacatttcc

SEQ ID NO: 531031 - DNA, 475 bp, Homo sapiens
  misc_feature (110)..(110): n is a, c, g, or t
  misc_feature (196)..(196): n is a, c, g, or t
  misc_feature (263)..(264): n is a, c, g, or t
  misc_feature (267)..(267): n is a, c, g, or t
  misc_feature (272)..(273): n is a, c, g, or t
  misc_feature (354)..(354): n is a, c, g, or t
ttctgacacgcgctatgtgaggggaaagagttgattggccggtgcagacggacaggctccagctcttggcggtgcagatggacaagctccagctctcgctgaaaccctcncctgtctttgcttgcggggcacactgggtgctgtgagatttggagacgtccccgaagactcagagcctccaggagcctccctgaanccacatgtccttcctgactgctctcaccatcctcctttaggatttattcctcagtgagtgagctganngcnttggnnacgaaaacagggtgttgagtgtgcttctggggactgtgatggactccgtcagtcctggttcaacatccacaccgatccggnctgcccttgcatggattccaggttgcgggaggaccccgggctttgtgcaataccttccaggcttggtggaagcttctcagtgggtggtgggctggctgacccttggccccaggaattcatg

SEQ ID NO: 531032 - DNA, 829 bp, Homo sapiens
catcatccaggctcaggtttggagttgatcttaaggtgaaagtggaaacagaaagaacagatggatccatgtaatacaaacccaagcccatggcctccatgactttttcaaacaaaaaaaaaacaaacaaaaaaaaaaaaaaaaaaaaaacaagagggggccgactgagaataattcgccgcgacaggcggggccacctccgaaccacgcccaccgagatatgtgttaccacgtgggtgcgcccctagaaagtggcctccttgtataatcgcgagcaatcagggggccagtctccataacaaaagcagacgtgaccacgtggggcacaccggacacgcagcagtagtgaggcttcgtgggaagacaagcccgtgcctcgtgcggtggggggacaaagcagcggccaacgtacgccgagaggacatgtaagaggcttcgcgggggagcccaattgacaagctgacagctgggggtgagagcgcgggtccagcagccgcagcgggcttacacgctgctgggggcggcaaaaagacactcgttgcgtggaaccgggcagccaggaggcgcctgcaacattttttgcaacccgggaggcttggatgaaaaaaaaagaagttgggtggccccaaagggacgagcgggaccgggcctccgcggaaagggccctgatgaagaggcgggtccgggcgccacccgaacggttgaagccgacaacgggccgttgggcgggcccttggcaaggcgcctggacaggcgcccccgagggactgggacattaaaaactctgaacctcaccttccttccatataaataatacatacatacacgc

SEQ ID NO: 531033 - DNA, 501 bp, Homo sapiens
agtcgctctggctggtcttgtgagatgaacaggatatgctagacgtcttcctcacagtttggattcatatcccgtgaagactgagtagtataaggagagtatagatcagttccttgaacaggaaattcgaggccctgtgagaagagtagggagataggacgtgtcggagccaacaataagatttcgcccactacggggaatataagtatggcagagaaaatagacaaaccacatggacacggagcaggtggaataagatacctgaaaaaggtgtactctgatgggcaaaaatattgggtaagctaagagacgacatgtagaatagaccagagttgttactcgtcaaagaaagtattcggccagtacattttaactttgtaaaatagaaaaacagtagccaactccgggaagccaaaatgattaagaactagctttcaaagaaaagagatgcggaagacatcttatccaagagcgactgacaggccaagagcgactgacagg

SEQ ID NO: 531034 - DNA, 114 bp, Homo sapiens
ttagcacgtggatttctgtgtctatactacatggacataatttatttaacaatcccatattgcaagatatttagatcttgtttccagtgttccacttttatcaataattgctat

SEQ ID NO: 531035 - DNA, 257 bp, Homo sapiens
cacgaggacgtccacaccaatcccaacttcgagactctgaagtgtcgctgtgacaactgcgatgcttttttcactgctcagaagcgatccagacaggatgatgcaagacatactgaaccatatggtcaccaggccagcaaaattggttcatcaagttttttgcctcccacgttgggaagtcattagatgaacaactttcacattggtcccccacacacggcactctcttccctttcctggtgcactggggaaagaga

SEQ ID NO: 531036 - DNA, 359 bp, Homo sapiens
tgaagaagagaaaaagagaggaggaaggtaagaaagagagggaaaaagagaggaagaaaatagaagagagagaaaggagaagagaggagaaaggagagagtgagaagaaaaaaaggaggaggaaaaaagagaaaaagagagagaaaagaaagaatgagagaggagagagagagagagaagagagaggaaaggataaagggaagaagaggagaaggaaaaagagaggagaaagagaagagaaaaggagaaaagggagaaagagaaagacggaagacgagaggacgaaatggggagagaggggggcacgtctctaactctctctctctctctctctctctctctctctctctctctctctc

SEQ ID NO: 531037 - DNA, 110 bp, Homo sapiens
ggcgctggtagcgcacccctgcagttcagagtgcatccaccccacgcacgccccgtgttgtgtttctgggccctgcccatggcctcaataaactttctgcttggtgtgta

SEQ ID NO: 531038 - DNA, 439 bp, Homo sapiens
aaattggggaaagttcacacagacctgtttaacagtgaccttcattcagacttgcctccctccagcccccagccactgggattatttgccgtatttcatggtagcctgccttttcagagttgatcagaatgtaaatgtgtgatttgaatcatgcttggctaccaagcttctttacaactttgcagaaagcatcgtctttactgcgagctcagtaaagcctgggcgggtaggcgggccggcagccacgctccctgtggacacggaagcagcagcgttgacttcccccgtcagggacagttgactgtccgagggaagggcactgtggtgaaataaacctgaactgttttattgcagtagtttttttcatatctgaaattgtattatttaatattttgaataagattttaagaaataaatggtaaaggtataaaaaaaaaaa

SEQ ID NO: 531039 - DNA, 328 bp, Homo sapiens
  misc_feature (194)..(194): n is a, c, g, or t
  misc_feature (227)..(227): n is a, c, g, or t
  misc_feature (253)..(253): n is a, c, g, or t
  misc_feature (280)..(280): n is a, c, g, or t
  misc_feature (313)..(313): n is a, c, g, or t
  misc_feature (315)..(315): n is a, c, g, or t
taatgtttgagggcttgatctgatttctcttagaagttcattgctggccaggcacagtggctcacacctgtaatcccagcactttatgaggccaaggcgggtggatcacccgagttcaggagtttgagactagcctggccaatatagtgcaaccccatctctactaaaggtacaaaaattagctgggcatggtngcaggcgccggtaatccccgctacttgggaggntgaagcagagtaatctcttgaacctnggaggcagaggttgcaatgagctgagntcatgccattccacaccagcctgggttacaagngnaaaactccatctc

SEQ ID NO: 531040 - DNA, 254 bp, Homo sapiens
  misc_feature (16)..(16): n is a, c, g, or t
cccccggaactgcttnggatgtgggcattgatgatcttgtgggtgaacaggcacaggatggtctgccgaggggggttggccctgtggttcaaccccccggaaaagatcttgagtaagacatcttcataaaccggcacccccagggcctgggggaccaaaacgccatgcttgtccagttgggcgctctgtaccaagcggtactccacgccctgccaagagctctcaatggggaattccccgggtgagtggaactc

SEQ ID NO: 531041 - DNA, 106 bp, Homo sapiens
cgtgtggtgatctagaggatccctcggtcgcgaatcaggtggagcttgtggcccttcttggtgcctccaggtgcactttgtggcaaagaagtggcaggaagagtcg

SEQ ID NO: 531042 - DNA, 268 bp, Homo sapiens
ccctttttcaaaagaaaaccccttttttccccaaaaattttttttttttagggtcccaaaccggtttttatgattaccccccatttccctatggttctgaatttgaaaaaccttttttaaattccacccgtcccctttttttttttgtaagggttaaatgggaaaaaaggccctttttttaatttttttccgcttttggaaaaaccccccaaaaaacccctaatttggggggtttttaaaaaccccggggaataacccccccctttta

SEQ ID NO: 531043 - DNA, 276 bp, Homo sapiens
aaggacctgtgtccggtcagttcaccatggctctggccgcacccagaagttaccaccctcaccctgaacatgtctgcatagaactgccccttcatttgacatataattaaaagtggatacaaataccactgcagaactgcctctgagctgctactgtgggcgcaccgcctgtagggcagccctgctttgcagagagcagcgcctctgctgctgcagtgcacagccggccgcttccatacaagtttgctaacaccagtggcttgccctttacgtcct

SEQ ID NO: 531044 - DNA, 432 bp, Homo sapiens
  misc_feature (41)..(41): n is a, c, g, or t
  misc_feature (179)..(179): n is a, c, g, or t
  misc_feature (220)..(220): n is a, c, g, or t
  misc_feature (241)..(241): n is a, c, g, or t
  misc_feature (282)..(282): n is a, c, g, or t
  misc_feature (351)..(351): n is a, c, g, or t
  misc_feature (357)..(357): n is a, c, g, or t
  misc_feature (382)..(382): n is a, c, g, or t
  misc_feature (390)..(390): n is a, c, g, or t
aacaagggggacaggcgcgccgccggccgcctccccggacnggtctcccgccgtatcccggccgggatgtgccttccgtccgcgcggggagtgcaagctcgccgcgcctgtttttgtcagttctgcttgcccggctgtcggtatccgccgacaggcgcccgcgccgccgtcccacttgngatgccggtgggcggcaactatgatgcagactgggtctggnccaggcgttcgctgtcgttgntgtcgttcgccgatgttcgacctgcacgccaacgccacggnaccctgaggaaatcgccatgatcgaaatcggtgcacgcgtgcccgacgcgacgctgtacgagtacttcnaaaccnaggcgggcggctgcgcgttgggtcncaacgccntctcggtcgccgagtatggcaagggccgccgcatcgtcgtgt

SEQ ID NO: 531045 - DNA, 286 bp, Homo sapiens
  misc_feature (100)..(100): n is a, c, g, or t
gacaccccatcaagtttattgtccttaagggctgggctgcttattccagcatctcttccaacttttcaaaaggaatactgaaaacaaaggctaacttttnaaaaggggtgctcctggggggagcatggaggactcccgcagtaccccaggagcccacatttccctctccaagtagggaaacagaatcctagagtcacaagctaggaactacagatgagagagaaagcgtgctgactgtccttctgggtctggggtaaacgcccccgcgaatttagtagtagtaggc

SEQ ID NO: 531046 - DNA, 703 bp, Homo sapiens
  misc_feature (3)..(3): n is a, c, g, or t
  misc_feature (77)..(77): n is a, c, g, or t
  misc_feature (86)..(86): n is a, c, g, or t
  misc_feature (89)..(89): n is a, c, g, or t
  misc_feature (97)..(97): n is a, c, g, or t
  misc_feature (133)..(133): n is a, c, g, or t
  misc_feature (137)..(137): n is a, c, g, or t
  misc_feature (146)..(146): n is a, c, g, or t
  misc_feature (152)..(152): n is a, c, g, or t
  misc_feature (155)..(155): n is a, c, g, or t
  misc_feature (169)..(169): n is a, c, g, or t
  misc_feature (178)..(179): n is a, c, g, or t
  misc_feature (183)..(183): n is a, c, g, or t
  misc_feature (189)..(189): n is a, c, g, or t
  misc_feature (194)..(194): n is a, c, g, or t
  misc_feature (198)..(198): n is a, c, g, or t
  misc_feature (200)..(200): n is a, c, g, or t
  misc_feature (633)..(633): n is a, c, g, or t
  misc_feature (647)..(647): n is a, c, g, or t
  misc_feature (669)..(669): n is a, c, g, or t
  misc_feature (674)..(674): n is a, c, g, or t
tcnggggtcccaagggaacccctagtcccagcctccttggcttgttgacttcccctatttgctctttggagccaacntaatctaanagngatatcanaagagatttcctgcaaggcctagaggctgtgaacantacnttttattcntttggntgntctcctgtggtgtnctggacccnnttcnttgganacacntttntntttttttttttttgtagtgactcgtgctctccaacctgtcttcctgaaaaaccaaggcccccctcccccacctcttccatggggtgagacttgagcagaacaggggcttccccaagttgcccagaaagactgtctgggtgaaaagccatggccagagcttctcccaggcacaggtgttgcaccagggacttttgcttcaagttttggggtaaaaacacctggatcagactccaagggctgccctgagtttgggacttctgcctccatggctggtcatgagagcaaaccgtagtcccctggagacagcgactccaaagaacctcttgggagacaaaaaaggcatttgtgcccagctcgattttctacttgcctgtggggaggggagtgacaggtccaccccccacactgggtccccctgtcctggatgcctttnaaaaaagggacagnccgtcagaaactggagagtttntattnaaggtcatttaacccctgaaaaaaaaaaa

SEQ ID NO: 531047 - DNA, 133 bp, Homo sapiens
tagactcatgtggtctatcgatcatacgtcatgtgaggcgtcttgttagtagtgcaggtataggcatagtcgtgtggttctcagaggcagtaggctgaccacaatgtgtgagcccataattagctcagttcat

SEQ ID NO: 531048 - DNA, 126 bp, Homo sapiens
acacaaatattaaacacaaacaatactcaatatgtgatcatggacttaattgtgtaagagtaaatcttccatgtaaaagataaatcgagaaagatcttcatggacccagacatctaagcaggagtt

SEQ ID NO: 531049 - DNA, 204 bp, Homo sapiens
  misc_feature (86)..(86): n is a, c, g, or t
  misc_feature (163)..(164): n is a, c, g, or t
  misc_feature (179)..(180): n is a, c, g, or t
aaagcattcaagtaagaatatggcaataaaaaacaaaaatatcttctcagcattcaaaacaaaacgcataagtcattcctaacttnagagctttatagcattttcctagacaggaagggaaaaaacagttagcatttaaaagtccggaaagctttttcgttgnnttaattacatcaacnntctgcctttgtccaaatcccttat

SEQ ID NO: 531050 - DNA, 334 bp, Homo sapiens
  misc_feature (1)..(1): n is a, c, g, or t
  misc_feature (216)..(216): n is a, c, g, or t
  misc_feature (247)..(247): n is a, c, g, or t
  misc_feature (271)..(271): n is a, c, g, or t
nctgctgctggcttcctgttccagggtcttggctgccaccaccacggctgggccccagggctgaggcacacatggaaggactgccttgctgggagcctgggtgggccaccgttcatcggccttccccttctgggccttcgatttccactgggtgaatggggaccgctcctctgccaacctgctcctgggaggaggcatggtgctgggcagtggctnggcggccacctcggccctgaggccttctgtngctggtcaggcaatgctgttggtngtcgcagtgaccatcctcattgtagctgtcttcacggccaacacttatgggatgttggggggg

SEQ ID NO: 531051 - DNA, 115 bp, Homo sapiens
gatagaaccaggacgttatgttagtgcacggttaacagaactgggtgtccccatgtcggtgacagtgatggtgatgttgtacatcggactatgagatctctcatgtccagatgtt

SEQ ID NO: 531052 - DNA, 1148 bp, Homo sapiens
agcgggtgagcggcatggctggctgtgccgggaggaggcggctgcctggcgccggggcgacctgaggccgcggggctcctgatgggcctctgtgtggcgctgtgtggtggtgcaccccagctgtcttgtcaccggtgcccccgcgccagggacttggactctcgcccctcacgggcctgctccgtgttgcctgtgccgaggccccttgcctcttggctcgcgccgcccgccgtgaaacgcgagggcccaggccggttttcactcaccgtggccacaacccttgcgctgcagcctggtgttggggcctcgctggactcgggggctgccggggacccctgaaggctgcagggccagaggcagaccgggggagcccggggtaactgaggtcagggcccacagggagggacaactcgctcctggacctcggggacacgccaagggactttccctcttcaaagccgtttcccggtgggaagtcggggacggatggatccgtaggggccgggaggcagagcagggaaccgggcgtggggaaacagggcttgaacgggcggcaggggaacgtcgggtccccggggggcccggggagtgacatagcggaacggtccccctgggaagacccgagacgttccagcaaaggaggagcacgttgaacaaccgggggagcaaagggttgcggccccaaggagagaggcaattggacgaagtgccgagaggtatcccttgagaggacagggtcgccaacgtatgggcggttgcctggacaaacaaggatggcacaaaagcatttggagagtgccacgaaaggggaaaacttcagagagggggtcgaatggtgggacagaagccccattgggtgcacacttgggggttgggcgcgcatacacgcagggggagtcacggcgtagactgtggcccaacacttcggcaggagcatcacaaggaagtgcaccccgtgtccagagggagaaaggacacccagaaaaggggccttgtgactgagacagagccacttgggaggacctattgggaccagcgagggccacggcaccccagcgcaggctatgagtcgatgaggcacacagcgcaggagcacccacttgggggagacgccgctaccacggaagtctcccagtagtagcaggtgg

SEQ ID NO: 531053 - DNA, 106 bp, Homo sapiens
gttgggactacagggtttgcggccaccacttcccagcttaattttttttatttttaggtagagacaggggttttgccattgtttggtcaggctgggtctcggaact

SEQ ID NO: 531054 - DNA, 524 bp, Homo sapiens
ttggggctccatcagcgggtcagaaaagagtacttatttaaaggttggtgctcgtaacaaaggtggcccgggagaaccggcatatgtggatgaaccggtaaatatgtcaactccggcaacggtacctgacccaccagagaaggttaaatggagagatcgaacagccaatagcatcttcttaacatgggatccacctaaaaatgaggggggttcaggcatcaaaggatatatagttgaaagatgtccaggtggttctgataaaggggtggccggtggagaaccggtggcagaaacaaaaagggaagtgacaggtctggaggaaggcaaagggtatgcctacggcgtgaaggccttaaacaggcggggggctagcaaaccaagcagacccacagaggaaatcggggcggtggacacacaagaggccccagaaatcttcctcgaggtgaagctcctggctggtctcacggtaaaagctgggaccaagatggaacttcctgccaccgtaaccggaaaaactgaaccta

SEQ ID NO: 531055 - DNA, 390 bp, Homo sapiens
agagcagagacggaatccacatgtcctcccctcagggagctttacattctagaaggggaagaagatctccccctcagctcaaaaaaaaaaaattggaaagaaaatggccaaactcatccataagctccaatctgagctgagccctcagggctgacccggacattatggggattcctgtagattctcctattcgggacagcaccaatttcagactgagcccactcttctcaaaatttgtcacctccgcagaccttgatattcctgctatccgcagaaatttccgggcaggcgccttacagaacactcaaatgcattatggccagaaccaactccatgttgttcctatctgggctggcccttcccctgggctacatcttagggatagcacca

SEQ ID NO: 531056 - DNA, 195 bp, Homo sapiens
tgtaggttcagtagagtgtttttattgttttcttttttttatttcaataggggtgagagttcagtatatgtgggattgaggtaggggtgtgagcttgaacgctttcttaatggtggctgttaaggcctactatgggtgtaaaatggggaatctggatgggcttaggtgagggaggtaggtggtagtttgtgttta

SEQ ID NO: 531057 - DNA, 159 bp, Homo sapiens
gattgaagcctatgcaatagcgatttaggtctgtctgtcgtaggcgcatgagcttgtaataattatgcctcatagggatagtacaaggtaaggggtatgctatgtgttttgtcagggggtctaacagatgagtgtgaggcgtattataccattagccgc

SEQ ID NO: 531058 - DNA, 293 bp, Homo sapiens
  misc_feature (16)..(16): n is a, c, g, or t
  misc_feature (46)..(46): n is a, c, g, or t
  misc_feature (62)..(62): n is a, c, g, or t
  misc_feature (68)..(68): n is a, c, g, or t
  misc_feature (85)..(85): n is a, c, g, or t
  misc_feature (222)..(222): n is a, c, g, or t
  misc_feature (231)..(231): n is a, c, g, or t
gagcgacagtcccgangggcagcccagcacttgagccccagctganggaacagcatgggcangtgcangccccacctgccagggncatggacacctgccacctttcttcaacaagagtcccccaatccaggctacccttccagagaacgctacccacccagccagggttctctcggggaagatcttcgtcttgctcaccttagctttcttgccttggagcancgggctcgngaaagaaagcacgctgggccagggaggcaggggtgcccaagccacagggagccctgggggaa

SEQ ID NO: 531059 - DNA, 125 bp, Homo sapiens
ggtgcatgcaatggtgtcaggaagtcgtggaaggtaagttgggcatgttccaccgactagtttcaactgtgtccattatcatgcttgtggtgactctctgagttgaaaatgtggagctcattgtg

SEQ ID NO: 531060 - DNA, 1508 bp, Homo sapiens
tcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctacaagatgaacaaatcaactgtcattgactcctcctgtgttccagttaataaagcatctacaaatgaggcagcctggggcaggtatatcactcattttaccatacgaatatataataatatttcaaaacgaggcttatgtttaagttttcagagtgcttgcacttatagcagttcttttaaactggccttcataactacattactttgcagcatatactggtgatagtggatgcaaagcattgcaattgtgtgtttcacacagagtagaaagcactcaggcctagacttttggagacccagatttctctaataaggtataggagtttggatctttagttttaggcagctattcacaaatactgccaaggcaatttctcccactgcatattgtttaattgtactgtatttccaaactcccaagcttttaaatgaaagaaaactgtaaagtcaaaatgaattactatcacgttaggttgggcacagtgcatcacgactgtaatcccagcactttgggaggctgaggcaggcagatcacttgaggtcaggagttcgagaccaccctggccaacatggtgaaaccccacctctacaaaaatacaaaaattagctgagagtggtggcacatgcctgtaatcccagctgctcaggaggctgaggcaggagaatcacttgaacctgggagatagagattgcagtgagctgagatcaaaccactgcactccagcctagacaacagagcaagactctgcctcaaaaaaaaaaaaaaaaaaaaaaaaaaggattttctttacccttttaactttctttttcgggggaaccttttttttttttaattctctaaaagggccttccccgggggtccgggggaattcccgcaacttggggcgctacacttgggcgaccccctcggggtatggaccgatggtctcggcagagaggtaaaaacccctctaattggggttcgggcgggctgggggacacacatggccttaaagagggcaactatttcgcgtcgttaatcaatactgtttgtcttgccgaaattttgatgaccccacgcttttatttcccccagaccatctacaagccgggggcacacggcgtcacagggagacggccacacccctacactgggtgccgacagctctcatagaaaaagaattcttctttgtgccaacccacaacacggaagaggcacaacacattgtgccacgctggggctgcttctcaaaagaacaaacaacacaaatttgggcgc

SEQ ID NO: 531061 - DNA, 87 bp, Homo sapiens
cctggggatacaccaacctagtgggtgtctatggatttattggttctgactatttcctctaaatggaagcataccggttggaccttt

SEQ ID NO: 531062 - DNA, 225 bp, Homo sapiens
ccagatacacaggtgtcgtgaaaactacccctaaaagccaaattgggaaagggaaaagactcatataaaacataaaaaaaaattggacacgtggattccgaggcaagtcccaccactactggcccatctgtatctataaatgcggtggcttccgccaaaagaaccattgaaaaatttgagaaggaggcctgctgagtgggaaagggttccttaaaggatgcctgg

SEQ ID NO: 531063 - DNA, 321 bp, Homo sapiens
caggaagatcccttgagtccaggagttcaagaccagcctgggcaacatagggagacttggtctcttaaaaaaaagacatgataagaaaactataaaccaatatcccatatgaatgtagaaataaaaatcctcaagaaaataacagcaaactgcaaactggatccaacagtacattaaaaagattatataccatgaccaacatttatcccaggaatgcaagagtggttcaacataaggaaatcaatcaatgtgatacaccacattatcatctcaacagacacagaaaagatatttgagaaaattcaatacccttttaagatt

SEQ ID NO: 531064 - DNA, 759 bp, Homo sapiens
cgtttctgacacaatcccttggagtcgcaaattgtggtcattctccgtggttgaaagttcccttcgaacacttcatttgagaccttattcccttatttgccatcactgtaatggtcgtggccgttgagaatggtgatttggactcctaacgctctgtgcccttcaatcatggggtaatggtatttatgggttcactcaaccacgaatgggaactggtgggctttataagaagaggttaaagagctttgagctagcatgctcagcccttcatgagatgcctctcactagagtgatgtctaagtggacatttgaggaggcaactgccaccggagggccccctccacgggcaatctctagtgtttaatggatcccggccccctgagagagtgccttgtggagcgctgggagcagtgacctggaccaccaccaggaccccagaactctggagtcagatggcagcaatcagcgcccccttgggtaagctatataggcaccagacctgcaacccattcgacgcagccacgctaggctgcagccccgctttagccacaggcacggggctacctgaggccatgggggccccatccctgctccagaggtccgcggaggcagcacacgaagtccaaagagattattctcttcccacagatacctttttttttccaagacccgtttacagcatctgcttcatttccctcacctttcccggctgatttgaggtaaactttgaagtaaataaaagctgtgtttgagcatcca

SEQ ID NO: 531065 - DNA, 139 bp, Homo sapiens
tccatagctagctcgggtctccagtcgagagatgcgccgccctaggtctcgatttcctcggtcaggccgcgcaacgcgtttatggtcgtgatgatggtgcccgcgtccacggtttttctggttacgctccattcgggcg

SEQ ID NO: 531066 - DNA, 800 bp, Homo sapiens
  misc_feature (166)..(166): n is a, c, g, or t
  misc_feature (197)..(197): n is a, c, g, or t
  misc_feature (226)..(226): n is a, c, g, or t
  misc_feature (243)..(243): n is a, c, g, or t
  misc_feature (447)..(448): n is a, c, g, or t
  misc_feature (473)..(473): n is a, c, g, or t
  misc_feature (648)..(648): n is a, c, g, or t
  misc_feature (712)..(712): n is a, c, g, or t
  misc_feature (719)..(719): n is a, c, g, or t
  misc_feature (770)..(770): n is a, c, g, or t
cgggcgcagagactttacctgaagaatgggggcgctgaaaaacaaaaaccaccacatcaccgggtcaagaaaccgagaccaaactggccaacatggcgaaacctcggctctactaaaatttacaaaaataatataatgaacaaccactgtctctaacaaaaggagnttaaacattactcgtgggggggagggaaccncacccccccacaaaaaataggggacaaancggatgacggggggctngtttaaaccttatactataaaaatactgggataaaaagagaagacaatcttaggtaatcttggggtagcgaaaaaatctctacatacagacacaaaaggcattacgatataataacctggaaacacagcttaatcaaaaagtaaaccttgagatacccaaagacaccgagaaatagcgcatgcgatccatagccaaatcctgcnntacatgtatctgacaaagggccttnatataaaatatatacaaggaactttgcgttctattgaacgggcccacttccagccacgtcctcatggctcacacccataatcctaataaaaccggagacaacgatggttgtccttcagcttaagaactatagacagtcctaacacatggcgggcggtaggcagagttaaacgcanccccggcctcaaaatgggaacacaggccgatgcttgtcccaaaaaacaaaagattataatccgncggcttncgcctgcttgccgcggggctaacaaataaacaactacacatcggcgcaatncaacaaccgtctatatgcagtaaaggatag

SEQ ID NO: 531067 - DNA, 563 bp, Homo sapiens
tggttgtaagcatcgagcgaggagggaatgggagagggaagccgctcctactgtcaagaaaggtaattgtgctgagataagtgctcctgggggcacacactcccactcaaagcctgcaggctcaatgttaggtacttaattggaacaatcccatgacagccttttgacaccggaggtgctaggaatcctgtctacccaaccagaagtgaactctcgagtgggaggacagtagggaaaaccaaccagacctctgtttgtacgacagatgctgtaaggttggggcctggctggcaaactgtcagtgaatctaaacacaaacatccatatggggactttgcctgacccactcacttacaagtgcttgggaaagggccaacctgaggatggcaactatataactgtggagacattcaggcccaatctcccaacataagcaaacatctataataggctccttccaggccaagtctagtcgggaccacatacccaatatactaacaggaaaacaacttggagggggcccagggagaaagctgatcatgactcttaacttcgagaactcc

SEQ ID NO: 531068 - DNA, 602 bp, Homo sapiens
tcaggccatagtcaaaatagagattgcgatgggaggaccagtaaaggtctgccctccctgacttcgctggtggaaaactggagagagggggcattgagagctggtgcctttgaaaagacaagttgatcatgacattgggatggcgccttcgaggtgtaccaaagaaagctaggaactgtccacaacaaatacagatgtggtgagttcatggaagggtaaggagaccaactgtgactgtgtgttactgaaaacaattccatattgaactctgtatggctgcctctgtcactgaatatgggctccaaagaccttatagcaagatttcttcatatcagtacaaggtaacatctgagggctggatcctttctctgtagtgggggctgtatagtacattgtagggtgtgtagacagcatctctgatctctatgtacttgatgccaatatcaccccatctccacaccttagttacacaccagaaaagttccaagacattggcattgtgtgggacaaatcccgctaggtgagaatggtatagctgctctcattgcaaaaagaatacttagacggtgatataaggaagggatatggctcactgtcaaagc

SEQ ID NO: 531069 - DNA, 489 bp, Homo sapiens
  misc_feature (40)..(40): n is a, c, g, or t
  misc_feature (193)..(193): n is a, c, g, or t
  misc_feature (196)..(197): n is a, c, g, or t
  misc_feature (230)..(230): n is a, c, g, or t
  misc_feature (252)..(252): n is a, c, g, or t
  misc_feature (254)..(256): n is a, c, g, or t
  misc_feature (295)..(295): n is a, c, g, or t
  misc_feature (336)..(336): n is a, c, g, or t
  misc_feature (365)..(365): n is a, c, g, or t
  misc_feature (387)..(387): n is a, c, g, or t
  misc_feature (465)..(466): n is a, c, g, or t
acataactttataccaaccataattcagccagtcaaaatnccaaaaacaatccaaataacttccaacatactagcggtcaaactaccgaataaacttgatgcagaccagtattcccaagttgcaatagtatccaatgactttgctgaaatgcataaaatggacaagcctaggtatctgcgcaaccagcaggcnttnnttttttttgtaccaaggctagagaatgcctggnaaaagcttgaccagaaaactcncnnnagtaactgttactgccctactattcttaagatacttaanatttggttaaagaacctactggctatgtaacattctaaggnctaccagatgcaaccaaaaaatattagcnacatggggtgttgctaaatatngctggggtttacaaaaccccttttgtctcgttgtcttttctgtttggcttcttttttttctttgccccggcctggcannttagagggttgttgtggttgggg

SEQ ID NO: 531070 - DNA, 262 bp, Homo sapiens
tttttggggggggggggggggcccaaattttttttttctccctcccccttgggggctttttgagggaaaggggaccccttagggaaaatatttttttttaaccccgcccccggggtttttttgggggttggggccccctttttcgggggggcccccccctttttgggggccccccccccggggctttcgggggggggggggccccccttccccctttggggggccggttcccccccctttttttttcccctgttccccccca

SEQ ID NO: 531071 - DNA, 229 bp, Homo sapiens
cacattttaagttcacctagggataaaaatgactccagaaggactaagacagtcataggcatacccagcacccgaggtcatgtctgctctaagcaaggggcctaaatgcacttaattattcactaagagatggtgaaggtactccttttaaagtgggatgtctaccaatgtacaatcttcttatgaaaaaatacctagatgtggggctaagacaaactacaacctatgt

SEQ ID NO: 531072 - DNA, 486 bp, Homo sapiens
ccgtgtcatccccttcgtgaggagggcctggagagtggtgacgctggactccaggtcatcatggcagacagtgagatctgtggcaccaagggacccaccttccagcggcatctcctggacacgcgctttgagctagccttagacattcctgaagaggaagctcgctactgagccaagaagctggagcagctcaatgctatgcgggaacaggatgaatattccttccaagatgagcaagaaaagcctctgcctgttcccagcaaccagtgctgcaactgggaattattttgggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagtt

SEQ ID NO: 531073 - DNA, 250 bp, Homo sapiens
cgcggatgtgcaccattacacccagctaatttttaaattttttgtggagacacgatctcactatgttacccatgctggtctcgagctcctgaccacaagtgatccttctgccttggcctcccaacgtactggtattataggcataagctactgtgcccagccttttactaagtaattatatgtggaacaacaggtccagggcagaggaccaacgtcgacccggccgcgaatttagtagtagtagtcgacc

SEQ ID NO: 531074 - DNA, 122 bp, Homo sapiens
agatctggctggcaagtatcgtcagatcctggaaaaagccattcagtttatctggagcagaacaactagaagctttgaaagcttttttggaagcattggtaattgagattttcagtttcgtg

SEQ ID NO: 531075 - DNA, 950 bp, Homo sapiens
gggctgcactcagcgccggaccgtgagctagcggcgcgccatgtcccaccagaccggcatccaagggaagagctgggacagtggaggcgactgggcttcagtacgctgtcgagcaccagcaagtgaagatgtaaagagatctttgccagagcagacatggaacgtacagacttctgaaaatatctatttgacaaatgagcaaactgtgtgatgggactcatataagtcagccttcagattcctgggatacagggattatgattccttgtgttttaccccctgttggaggacaaacaaccatgctatatatactcaggtaagattctcagaatgcccaggatatgacatggctattcatgtgcatggtctccagatcattctcatgttcgtcaaaaaatgttgtatgcaagcaacaagagcaactctgaagaaaggaatttggaggtgggcacattaacgatgaacgtattgggccccagtacaggaagatgtatcatttacctggcatctacaaaaaatacttgcggtcaacaattcttcccctgcccccaatgaactgcagctggagggaagaaactacggacagatttaaactcactgagggtccagactgctgtggcggttggcccctacagcattccaacactaacaggagtagcatttccccatttctcgagaagccttcagcgtggggaaaacttgatcatcggcagccaactaatgtgcgggtgcatcagctttacaactgcattctattgggcacacaaacatcgacatggagttggcacgcgttcagggttagtcgtccatttgttgttaacttccgtgggcacatacagccacggaaaataaggcgggacagcgataacgggtgtcacagcaacgggcaatgagacaacgttaacatacgagagagacctagacagcgcaatagacggaagacacgcgtt

SEQ ID NO: 531076 - DNA, 549 bp, Homo sapiens
ggcctctctatagtgtgcaaaattgagtggactggtaaaagctctatcttacaaggtgaaataagaaaaatccaatacaaaaagtacatcaatgccttagtggtggtagatcctttactctgtttcttgaacgtggacatattggaggtctgagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgatacataacttataggtgatcgtgctacttcctgattccaagaatgccatttgctcacaacgcatagcactggacagtgggactgagagggagtcagcaggcatgctgcggtggcggtcactccctctgacaatatccccaggaaaggaaaggt

SEQ ID NO: 531077 - DNA, 209 bp, Homo sapiens
  misc_feature (56)..(56): n is a, c, g, or t
agactttctggactttaatagaaaaatgtgattttaagattgctttttcttttgtnttagcgtaatttttccctttatattcccctcatcaatgtaaataaacacacacacacacacacacacacacacacacacacacacacacacacctttcaccacaatggtaatgcttctgtaaatgcctctatttgtccagttggctgaaaatg

SEQ ID NO: 531078 - DNA, 882 bp, Homo sapiens
  misc_feature (639)..(639): n is a, c, g, or t
  misc_feature (690)..(691): n is a, c, g, or t
  misc_feature (821)..(821): n is a, c, g, or t
ggacagtcagccgcatcttcttttgcgtcgccagccgagccgcatcgctgagacaccatgggtgaaggtgatggtcggagtcaacggagtttggtcgtattgggcgcgtggtcagtcatggtctgcttttatactctggtatgagtggatatagttgccatcaatgacccctgtcattgacctcaattacagtggattgtacatgttccgagatatgattccacccatggcaaattccatggagaccgtcagaggctgatgaatcggtgaagcttgtcagtcaatggaaatcctcattcaccatcttccatgaagcgagatcacctccaaacatcaagtggggctgatgctggcgctgagctacctcgatggagtgtctcactggacgtctttctaccgaccatgtgaagaaggcctggggcatcatgtgtgcacggcgtgtgacgccgataaaggggtccatccattcgtcttgactcccccatcatgacttgatgtagcctcccgattggtctccgctcagttgtggctgctggaatcccattgtaagatacggtaggtgagcaatcgatggtccctctatatgaatctatctcgaatgcgaaatagcgctatctcggttgctatcccaatctccangatcgtagtcttactaagtcgaaccgctctttggggcgcactatggtttcnnatcctagttgatcatagcgttagagcgtgatacggttgggaagggacttcagttgaaccatcaggtcgcagtgtccagtacactggcacaaccccgaagaaagactgtgtggactgtgcgcccttccggnggaaagtctgtaggcggtgactgggcgcgcggtgtgcttctcgcagaagcagttcatcccc

SEQ ID NO: 531079 - DNA, 255 bp, Homo sapiens
gggcattacacccactgctctatttggccgccagcctttatgtcactctcttcagcatatgtgcggcggataccctttcctcggggacgagaaatccatggttatgttgccctatccagtgacaaaaatattggcagaagtcgagtggcaccgctgttgccataagtatcttacacgtaaaccacgtcgaaagatccagggtgcctctctctataggtgatcacaccagttcttcctaggtaagcacctccggtt

SEQ ID NO: 531080 - DNA, 647 bp, Homo sapiens
ttaccctatcgtcgacccacgcgctccggaagaagaacggcgtcgctgcttagagatgccatggcagatggcgtaaaatagtggtcatataaatgatgtccggcatgcaaacatctggaggtacagccacttcacgttgcagctgctaaaggctatacggaagttttaaaacttttaagtacaggcaggcgtatgatgttaagtattaaagactatgatggctggacaccgtcttcatgctgcagatcattggggtaaagaagaagcatgtcgaatttgagtggacaatctgtgtgatatggagatggtcaacaaagtgggccaaacagccttagatgtagcagatgaagacataacaggatatttagaagagttgcaaaagaaacgaaaatctgctccatagtgaacgaaccgggacaagaaatctccactaattgaatcaacaagcaaatactgggacaagtaatcaggcagcaggaaggaccggtcaagaagacagaacgcgacgctcgacttatgggacccagagaacacaagcgcagtcgccgtaatggaaatcacagggaaacccggaacacgggctagatgaaacgaagaagaagggcacagcaaggactgagcctaggcggcgccagtgaaaggaggat

SEQ ID NO: 531081 - DNA, 385 bp, Homo sapiens
ttatactggaagggtatctgttcactcagcggctcaaggaactaccaaggtaaggaacatttcaggggcgctccattcaactcctaccaattctgggaaatttaagtgaaaggacagcgtatcccagggtatatagccttatgggttagaaaacatcacaacgattataaaaagacaggcgcaagcagcactcaactttggaaagcacttatttccggtaatctgaaaatgagaattcttttcccatagaaataggtggcaatgaggttagattccaataactcataaaagcggattaacatacacggtagctcaaatatacaagatggtcagaaagatcctggtacatgctcgcttcttttcaacacatgtgcccttacggaaa

SEQ ID NO: 531082 - DNA, 143 bp, Homo sapiens
tgatgaattaagggtgttagtcatgtagcttgtttcaggtagcaatagtatagggtcatggtgctggagtttaagtttagtcctcagcatgcggtagtagttaggataatataaatagttaaattaataatggttatgttagg

SEQ ID NO: 531083 - DNA, 291 bp, Homo sapiens
  misc_feature (111)..(111): n is a, c, g, or t
  misc_feature (245)..(245): n is a, c, g, or t
cagcaaaccactcacagagccaggaagaaatgaatgctttggtattaccagggggggaggccggcccggctgaaatacgctatgaccatagccaggagatactgatggagnaaggaacacagagagggagaggtcacatcttgggagaggaagattgtggatatagtggaatgggggtctggggaggggttgcccatcagagaagggacctcagtgttggggtgactgtcctcatgtggaaattncggggtggaggggtattcgaaggtcggatgcaaatccgagaagccg

SEQ ID NO: 531084 - DNA, 833 bp, Homo sapiens
agtgaaaaccttatggctgatgaacgtgggatggtgtagaccccctaacaatgctgtccgacctccttctctctcagcatttgctgctcggatgtatttttccgcttctttagtaattcaaaggattttctctccgatcaaagaggttagtttaaaagttaaatgagaatatgggaccagaagataaaatcattatttttaaacaggggaagttctttcttttaataaggacttctattagatattgtttaactttttagcttcctgtgcttcaattgagttccatgaaagcatttttgtgtctacagaggagtgtttgggacttgtcttgtggttgacagcagcagtttacctgatgggggtttcataggatgtgatgccctgtcaccaggtgatggacttgatgtaggaagtgccaccagcagtctctgccacatggcatattctcccaagtggcccttgccattccagaggatgttgggttgcattgtctgactcattaatttacaaaggattatttattttctaatgctctatagcttcttcgccttcaggatgtgggctgtgctgctgaacggagagggggtagagcttgtaagccgtgacttattctaatccggtccatgttcatcttcattcatgcctttctcctgtttctcctgttatatgggaattggttcgatatatttgggttgacatgctggttctgggtttggttgaccctatgttctgtgcccatctgtttggtgcccgggccggcgcttaaggaatacccccggggggcggcccttgtcccctggagcgggggttggctaccggggaagccccacgtg

SEQ ID NO: 531085 - DNA, 86 bp, Homo sapiens
ggaaggtcccatggcctgctgggctgtgctcggcgcccccacaactggctaccttgtgggaataaacagacaaattagcaaaaaaa

SEQ ID NO: 531086 - DNA, 634 bp, Homo sapiens
tggcaaggaggaggggtgggggtggtggtgaaaaaagggcttcatgcagcaagttttttttgaaaaactgcgtgtgccggaccctgtgctaggtgttgcaacagatggagtccctgctttaatggagcgtaagagtctagaggaacacggtactaaagaactccagataatggcgccgggccgcggtggctagaggcaggaaaactcgcttgacccagggaggcggaggttgctgtagacgccgagatcgccgccactgcacctccagcctgggcagacagaacgagactcctcaaaacaaaacaaaacaaaacaaaacaaacaaaaaacaattacaaattaatggccgggccgcggtggcttgaccgcctgtaactcctagcacttgtggagaggctgaggcgggcggactcacttgcggctcgggagttcgagaccagcctggccggcgtggtgacaccccgtctctactattacaaaaaaaaagatttggccgggcgtggtggcgcgtgcctgtagccccggctgcttggagaggctgaggcgggagaatcgcttgaacccggaggcggaggttgcacagtgagccgacactgcacctctgcactccagcctgggtaacagagtgagactc

SEQ ID NO: 531087 - DNA, 379 bp, Homo sapiens
cccttattccaaggcctgaaaaagtgccccccatggatgttaagtagaaattcaagaaagtaagatgttttcagcaacccagtaaacccctacccccccttttggtttgtaaaaggttttttatacatttccaacaggttgcccaaaagttaaaaaaatggggtcttttataaatccaaaggcctgtgaaacccttttacaaattttttaaattttcgggccaagggtaacgcgtaatttaattaaatttcaaccagttcctccagtaagccttaggaagggaatatgatatcccaaatagtttataaagactctatagtttttataattttttttacgggcaaatgtcatgccccaataataaatttttgttaactta

SEQ ID NO: 531088 - DNA, 1135 bp, Homo sapiens
gggcggaagtcgtggaacgcgtcgtgcgacgcatcgcgcgatggcgcgggcagggacagttgcttgtgaaccgtgaacacaacaaacagttatggatcatgggaaaccaacatccttctattagtaggcttcaggaaatccaacaggacagtacaaaagtgtagaacagcaagtatatcggcttcagtgggtctgtccagatgaccaagaattacactgaaacctggcagaggattctaacaaaacagctttttgacactagactctgtagactactggaagagaacacacggcgacatatccagcaaagactaggaagcgggcagccacaggagaccagaaccgtcttctcaaaaagagtaggcagcagaatgcaaaacccacccaacaccgggatggaagcaatacaggcaacataacgggcgggcaaagccccaggcacactcggtgagagaagcaaacatggtcgcacagtgtgattaatgggagagacacatgcggtaacctgatgaagtaggaagaacggcaattccaggaatattcatgctggacggcctgacacaaatggtcaccaaactggggagggaaaacatcataccttgcgggacatagccaaggtagtcacactttaaccccaacaatcaggatggcgggtgcaaagagacatcaatcggaaggactggcatgacacaaagagcaggcacttcaccggtgacgacataacagcaaggaaaatgaagaaaaacactatcaaggtaggacaaaacaacacactacggggaaagggaacaagcagaaaaaagggcaccgaggaggaccaagaataggacacacaaagaatgagagagatcacaaagagatgaaaaacataaaggacacatcatcccgggggtgccccgagggacgtgacaccgagtcccaggagaagcccaaaaaaggaggagagccgcgaaagaaacaccaaacatccgggcgagaagcacaagacaagaactccagacaggtgtacaaacggaatgcgagaggaagcaaccaacacaagactgaggagcaagagaacgccacagagacaaaacaagacagagagacaaaaaacaagcaacagcaaccatgagtggacgccaaacacgacaga

SEQ ID NO: 531089 - DNA, 415 bp, Homo sapiens
  misc_feature (77)..(77): n is a, c, g, or t
  misc_feature (84)..(84): n is a, c, g, or t
  misc_feature (86)..(87): n is a, c, g, or t
  misc_feature (169)..(169): n is a, c, g, or t
  misc_feature (172)..(172): n is a, c, g, or t
  misc_feature (184)..(184): n is a, c, g, or t
  misc_feature (227)..(227): n is a, c, g, or t
  misc_feature (229)..(229): n is a, c, g, or t
  misc_feature (266)..(266): n is a, c, g, or t
  misc_feature (314)..(314): n is a, c, g, or t
  misc_feature (341)..(341): n is a, c, g, or t
  misc_feature (350)..(350): n is a, c, g, or t
caaggtaacgtggaaggtgactgatgtaataaaggcaaagtagcaaagatagcaaggtaacaagttaacagctgtancaatgangnnggtgtggggtccctcaggaggttctgctcctcttacaaagtcactgtcctgattgctggtccctgactcttggttaggctgnatnaagcttcctganctcatcttttatttctcagggttgaatgtgcagagcctgcctntntcttctctactcctcttctccaggtcctctgcacctntttcttcatgaaagctcctcagtccagtcctaggcactcagggagtgnccatttctgggcccacttggataattngcatctttngagggacattctccataacagtccccaaccttatggggcagtctttttgaagtatttcttcatgg

SEQ ID NO: 531090 - DNA, 113 bp, Homo sapiens
  misc_feature (26)..(26): n is a, c, g, or t
  misc_feature (93)..(93): n is a, c, g, or t
gtacattaggggtaggtgtgttggcncccagcactttgagaggcctaggtgggcagatcgtgtgagtctaggagttagaatccagcctgggcnacatggtgaaacctcgtctg

SEQ ID NO: 531091 - DNA, 1135 bp, Homo sapiens
  misc_feature (196)..(196): n is a, c, g, or t
  misc_feature (531)..(531): n is a, c, g, or t
gaaccacatctacctactcgcaagtttcctcggtctccatatgctgatcccaactacgcgcctccccaatagcccttggaggggcgggcagagcggcagtgctaggtgaaatggcaaggcatgtcttactggcactgtctcctgggtttctgacactgcagtctgtgtatgcgtgcacatagtcagggctgatgtnccggaaacatatcagtctggaagagtgatatggacctgagccaccttctggggactttggtggtgatgaagagagaagccgagagcgatgagaccaacgagcctaatagtttgcgagagagtggacgcgaacgcttctaatcgcttattgggcacaaaatcctctgagctcgggatgatggctcgcgagcggcactccttcaagcactggtgtggacgaagatggcgccacggttcacctatctttgagtcagggtggtcgtggacgttccctttatcggatacaatgagcctttcctctcgtggaggacgctgtatggactgtcgcgaagaatnccttgattttaatccggaggctggttcctctgcgggaagcttattcggccttcagagagtgggaacctggggggggtaaacgcaaggctccttaaggctccatcacgaccaaaggaaacggcccgaagactccttttactagtaccgaatgggcactcacagacccctttggggcacagtgctcaagcggcgtccaagtgcctgtgatgcgcggggctccgatcaaaatctccacaggcccaaagggccctacagagcgatccccgttgaaagttgctgtgcgtgcaccactacggggggcttcactcaaaagtgtgtccacgtgtcgtggaacgtgctgaccggcgaaacgctttcgctcaaacgggatagcgcccttcacaagtcgttctgaccccaaccctggtctccgtaggagttctgccccatggaatgtttatcaccagcaaaaacggggcaagtctattcccctttatacaccactccagaaaacgggggttaccaacgacgcccgttgggaaccccctgtgaacgaagtcccccgttgagaattccacgggaaacaccacacggctgcccttccagggggggcccaaaagcccat

SEQ ID NO: 531092 - DNA, 112 bp, Homo sapiens
ctgcctctgcctccagagtagctgcgactatgggcatgtgccaccacgcctggctaacatttgtattgacctatttatttattgtgatttatatctttttttattttggaga

SEQ ID NO: 531093 - DNA, 151 bp, Homo sapiens
gacgaagaaggcagaaggagccacgagtgcatcatcgacgaggactgtgggccaagcatgtactgccagtttaacagctaacagtaccacctgccagccatgccggaaaaagaggatgactctgcacccgggacagtgagtgactgtagga

SEQ ID NO: 531094 - DNA, 246 bp, Homo sapiens
gtagggaatttcccccaaaaccctgacttcccacctcagcctcctgagtagctgggactacaaatgcgcaccaccacaccaagtaaattattgtatgtttatgtagacggtcttgccgtgttgcccaggctggtctcaaactcctgggctcaataacctgcctgcctcagcttcccaaaatgctaggattacaggcatgagccatcgcgcctggcccttcccatgttttcaatgtgcctctttgtg

SEQ ID NO: 531095 - DNA, 277 bp, Homo sapiens
tccgggctcctcatgtatgcgtggggagggagtataaagccccaggttggtaagggagggcccagaccgaagaaggttgggtggatagcagaaccttttggtctccctctgattgctcctaagcctcacgctcccttgcccctgggtgttcctgttgcttccctagatcttctcctgtgaccttgtagcataaacctttccaccgagcgcttgagacacttacatttgaaccgggatccattgaggaccccggggttaccggagctcgacattcgta

SEQ ID NO: 531096 - DNA, 787 bp, Homo sapiens
cgaagtggccgtggtagaacatcggaaaatatctgggggactttaatttggacttatgtctcaagacatacaatatccccacataaagtacaagcagccaccgtaaaacatatttcctggatgatatctctcattacttcaaatccgtggtgtggaggaaggaggttcaagaaatccatctcacaataaagacctcgagggtttgaagaggatcatcataaaaactatcagtgtgacaaccagctcttacaccgtggctctaccaccacaatataataaatagtttctctaagtgaaaacaaaaagtggattatcaggaaccagtgctgacaattattaattggccgtgattggtatcacaagggagctcactcgtgaagtggtctcgtggtgataagggttggatacaaaacaagaaataaggctgctatagctccagttagcattgtgaaaactcgtgccaagcacgaagatctcctcccagctcggcatggatggcaaccggggaacaagggaccgacccagggatgtgtgcaggtcccaaggcacagagggtcagagaggctggacgtcactggcacctagtcacggaggactggaatagtacatcaaaggtccaaatccgaaatcacaagagtgagtgtcccagtaaaaactcggtgtcgggggttctggaaaccctgtatatagcgccctaattccaaggtccctgtcctgagaaaaaggtaaatccagcagcgagatgaggtagggcttagaggtccaagacaaaatgttgcacaggtgc

SEQ ID NO: 531097 - DNA, 199 bp, Homo sapiens
tgtggcactgcggaggagttgaggcagtctattgtgtccagatgctgtcttcctgggaggagagctaagggagtgcctggggcccatttcttaaaacctggctggggtagtttggagaaggaggtgttgagtcagttgtaccgaggaggagaagcagcagggtaccgagactctgcaatttcgttaattcttggtccat

SEQ ID NO: 531098 - DNA, 1205 bp, Homo sapiens
  misc_feature (337)..(337): n is a, c, g, or t
  misc_feature (518)..(518): n is a, c, g, or t
gctggacttgtcttggttgcctgacacctgacgacccggacgacggcgacgatctctttgtgactaaaacgacagggtccagtgctccaggcctagtgagtctactggggaccgccctcccgtggcccgcccactctgatgcacctaacttctcatggctcaactgcgcaaaatccatccggatcggcacatacttctgaggcaattagctcgaaagtgcttgggggtgaatgtgatgcgtgaggaagatcgcgtagtgagctgctcgtggtcactcgccgggctggtggtagatctatatatatggagggaggtacatctttcgtacgattcacanaaagcatccgaccagcccgatgccgcaaccgagcacgtagggaattacacctcttccaccgcgattggcgaggatggcatgtccgcaagggaagcgagcatcgtgctgtcatgggagatggacccctggtccaggcagccctgtgtgggacttgggggatgcactgatgagactcatacgnattgcgtccccttgctcgcacactggaaaaaggtcgtgcgcatgcagaagggggcattcacgcgcggaaccgcgaatggcattctgggtgagtatcccgaattgataacagcatgtgatcaggacgtgaatggctgtcacaccgttgcgtcgcgttgagagcgcaatgaaggccgaagcgcactgaacatgctaacgtgagtcgcgagcccagtgggcgtcctcacgcgtcccacgggattcgctcgagggtcgcgctcgaggccccgagttacgaagccccgagggcccctgcaagagcgcgcattccgaatttgggccgcttcgttggccttcgaggcctggactgcgtgggctttccccattgggcccgcgcattgcctgtgtgactttgggccccaccgttcgccacttgcggtaggtccaaataggccgttgtggcgcccccctctgactaggctggtgtgtcgcggtgtgccttgcgggaggggtcccacaatgggacgattttaacctagtctcgggcaagtggggcgttctggcccttcccccatgacgccacgcctgggccttgcttttccctcggggacccggggaaacattgttccgtgattccgcgccttccccttggggtgccccaggggctttcgccctggcggcctttccctctcgcttgaagccctcctcg

SEQ ID NO: 531099 - DNA, 1051 bp, Homo sapiens
  misc_feature (121)..(121): n is a, c, g, or t
ttacttttccccctaccctgctcctcctcctccacagccgtctattctcttatgcctcagccacttccttccttggtctcaccctccccagtgcactgaagaaggtaacgcgggtccagancccacgacggcgccatgttctccgcgcgcggaacggcaacaaccgcgccagagcaggcagcacatgaactgtggactcaccgacggttaaccatctctagtggaggaaattcatcgtttgggttcaacaacatgctgactgcgaacgttacgcgctcacaatcctggggtcctcttccgtgatgatcaatgtgccaacctcttcgacagcatcgctacgaactcttccagctgcacacaacgaacgcgaagactcgctaacatactccagcgacagctgcttctgccaccgtgctccatgactgatgctcgacatctactatcacctgcaacccttaactgtggcttcacatcctctcccactgtacctgcccacttctctcgctctcctcgcgtacaacctggcaatataaagtgacaccaacaaaccatctgaacatcaccttcatgcactcccccctaccaaccctcctcaacccccacgccattcatgctccccgacactctgctcctctcctcatatcctgcccccaaccctctatgtactgactgctataccctacatcccactactccccctcccgcactcctgctcccacttgcccccaccccacactccccgccggcccccgccgcacccgccgggcctcactacccccaccaccaccccaccccctcccccacacgcccaccccaccccccccccccccccacccccccaccccccaccccccacccacccccccacccccccaccccccccccgccccacgcacacgccccccgcgcccccctcccacccccccgcccccccccccaccaccgcccccacccccccccaccccacaccaccacaacacgccccctccacaccaccccaaccacccccacacccaccccccccccccaaccccccacacctcacacaccg

SEQ ID NO: 531100 - DNA, 302 bp, Homo sapiens
ccagcgttggggagtagccccaacgttgagaacaagtaagcgaacaattagttgtatgaaccacttattacatgactgctgatcataaacaacctgtgtgtaatattatttccctaaacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 531101 - DNA, 1175 bp, Homo sapiens
  misc_feature (359)..(359): n is a, c, g, or t
tataaaacggggcaataactttattcaaaacccatcacaaaatgggccagttggggtcgtgtaacaaagcatttcaggtgttttagaagcatgaaggtcagtaatggtatttgagagcatacagcgggctacatacaaattaacggatcagaccacaacttttcaagtggtttaacaacaggaataagtcttcccggtaaaagcacgcaccttgggtgacgtttaaactctagatattttccatcctccttatctttcctgtcagcccttctcctttcaagcaaggaattcgcaggagcacaaccctccttcatataattcctgtttcttcaaggggggcagccatgtgtccttcaggnggccctctgtgaagaaagcttcagccttgtccttcgcattccccttcccacaagggttacccaggtgaaccaaagggcaccgttgggcaataccattcaggggttcaaacacttggggggctccagggcagacgcccagggccttcagcaatgtggcttggtgaggtgatctgctctcacgcatgtgcacaccagcctctctctgtgttaccttggggccagggttctccaccagggcgaccacaagctgggagaagggcgcggacaagtgtgaatggcacaaactcttgaaagggccactgtggggggggcacaccaatatccaacaacactgggtatggtggaacacggctggggtccttgagaatgggtggggccacatgggggcaaagcatttcgaacatttctttgggggacaaccaacgtccccccacgggtcaccaacacaagggcaagacaaagccattgatacttcacccccagttgcggggacggggctccccatttttacagccatttcagtgggtgggcggatgggccctcacaaagacaaggggcatatgggggtgaagtccctcgtggcttaaccagaaaaaaagcctggtcaccagtgggatagaggccttcccacaagaagaacgatattgacacggggggcccacttattgggccccagaagggacacgatggtgaatagcaggggagaataaggcgacccccgaggatggtgcgatggggaaaataccagcgacgggtaccaacaactacgagggctccccaccaagcgcacgggaagagccacgtatgtagggaccc

SEQ ID NO: 531102 - DNA, 544 bp, Homo sapiens
  misc_feature (529)..(532): n is a, c, g, or t
gccccagggctgaaggcaggccagctccagccacctgctgagtctcctaagtccagagtgtcagagacctcaagagactctcacccactgacccacctggggactctggaaatcgggatgtgaccagggaagaccctgtcacggggcctctgaattcagcctcatcccaagtccccactctatacttgtgtctgcagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 531103 - DNA, 805 bp, Homo sapiens
  misc_feature (43)..(43): n is a, c, g, or t
  misc_feature (96)..(96): n is a, c, g, or t
  misc_feature (114)..(114): n is a, c, g, or t
  misc_feature (116)..(116): n is a, c, g, or t
  misc_feature (204)..(205): n is a, c, g, or t
  misc_feature (235)..(235): n is a, c, g, or t
  misc_feature (237)..(238): n is a, c, g, or t
  misc_feature (255)..(255): n is a, c, g, or t
  misc_feature (273)..(273): n is a, c, g, or t
  misc_feature (279)..(279): n is a, c, g, or t
  misc_feature (283)..(283): n is a, c, g, or t
  misc_feature (300)..(300): n is a, c, g, or t
  misc_feature (315)..(315): n is a, c, g, or t
  misc_feature (348)..(349): n is a, c, g, or t
  misc_feature (374)..(374): n is a, c, g, or t
  misc_feature (387)..(387): n is a, c, g, or t
  misc_feature (446)..(446): n is a, c, g, or t
  misc_feature (465)..(465): n is a, c, g, or t
  misc_feature (476)..(476): n is a, c, g, or t
  misc_feature (487)..(487): n is a, c, g, or t
  misc_feature (548)..(548): n is a, c, g, or t
  misc_feature (558)..(558): n is a, c, g, or t
  misc_feature (579)..(579): n is a, c, g, or t
  misc_feature (643)..(643): n is a, c, g, or t
  misc_feature (803)..(803): n is a, c, g, or t
aaacagagatttcactcagtgacaaagatggagacagccagtncaccgtgtccccccatctacttagaaaatcccctgggggaggggatgcctagngcatacagcaccccattngngtggggctgtgcacaggtcataaagactctcaacttcctttaccatccaaacaggaaaacaactgtccagatgacagtaagaatccannatctgtaatcctcatggagccaggactcananngcatctagggcaatgangctactgcaagtttatgnagttanacantcaagtctgtgccaaangaggtcccatccggnggccaggtttctgttcagtctggggagcaatgnnaactggcgtgcccccatagcctggnatgagctgatggnccagtgcaatcccaaagcaaagaagggcagaactgggccaagaagctgtggtaatttgntttttttgttttcgaaagngtcgtcctttncttttgtaggnccaaaagaaggccttctgacctgagggtctgggctagggagttggattgtttttctaagcncccatatccncagagtgagagacatggaaanagggatgtgagggttctgaaaaacaggcatcaggcagctttggagatgctctcagcccacaggnagagtgctgtgtcaggcaaagatggtctcttcccggcgcttcttggtgaggatggtgcctggcttatgctgggcatctgggtggttggctagttcggggggacaggaagacactgggctttcaggatagcttgcttcagctcgtaaaacacagcagagtnct

SEQ ID NO: 531104 - DNA, 859 bp, Homo sapiens
gatccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagtgagtgaaggccaggccagcaggggctttggaaataacccctctcccacttccctggcccctcttccctggtgcccatctgtgacctgtgaccccacttgtaagatttcccacactgctgttgggagaaagccggtggtgtctccatcacatcctggagaaggcttcctgtcttcagagaaccatagactcacatctggaagccgcctttggggcatctatctggatctggtccaacttgccggtcttaaaatggggaaactgagttccccc

SEQ ID NO: 531105 - DNA, 328 bp, Homo sapiens
  misc_feature (313)..(316): n is a, c, g, or t
agctacgactaagctagactgatcggcgctgaggcacatgcctatcaatctccagagatccgagccgcgaggctgcccgcctggctgtgtcagactgaagccccatccagcccgttccgcagggactagaggctttcggctttttgggacagcaactaccttgcttttggaaaatacatttttaatagtaaagtggctctatattttctctacggccaaaaaaaaaaatcggcctcgtggcctacagcggggagtattcgtccaagaggccatttttttggactttattttatattttctcttttatttcttnnnntaatctttataa

SEQ ID NO: 531106 - DNA, 599 bp, Homo sapiens
gagagagagagagagagagagagagagagagagagagagagagagagagagagagagagagagactgtgcttacgtaagaaaacacgtggagaagatcaaaaattccatggatgggaagaatgtggatacagttttgatggaacttggagtacgttatcatcgacttatctatgagcatcttcaacaatattcctacagtcgtatgggtggcatgttggccatttgtgatgtcgccgaatataggaagtgggccaaagacttcaagattccaatggtattacatctttctgatactctgcatgctctttgcaatcgtctggtagttgccccagataatttaaagcaagtttgctcaggagaacaacttgctaatctggacaagaatatacttcactccttcggacaacttcgtgctgaatatagaactgccccgccttgctcgacactttagctgagattgaatttacaaagggattcagcgccaagtcctttacagaggaatggcttatacttaagcccccctctggtggatagcaccacgagatacctttggcacaggcaacattttgggccatggcctggaccagccccttccttc

SEQ ID NO: 531107 - DNA, 368 bp, Homo sapiens
gttttgggaaagggccttttttgaccccttggggttccccgccggccctttttatgggcatgtcttttaggccccaacccccccccccaaggatgcgggggggtctttccccggaatttataaggctttgttttatattaaaaccaaaggggcccccccccgggccgggggaaaagtgaaaaaccaaatttttgttccccccttccccgggcgggccgctccaaagactttgggggaagggccctaaaaggtttttttaaagaacccggtttgaatttgggggggatgccccccaaaaaaattggtaagggggaaattgataaattttaaaatggggatttttgaaaaaaagttgaattttttattta

SEQ ID NO: 531108 - DNA, 137 bp, Homo sapiens
tgtccatccccctgcgtgcagcaccccttataaaccaccctatgggaagctactattacctccaggcacggatgggggcatagaaggcccgcgagtcctgaatggcaacccacagcaggactgaagggggatggaca

SEQ ID NO: 531109 - DNA, 181 bp, Homo sapiens
gatcccctgtaaagcacaacccctcccaggagtgctgggattatagggcatgagaccactgtgattcagcactcgtggccagcatttttaaaaatgtctgtacatgtcgcttccttgctcacaatcctgaactgacttccccattgcattgtaaatagattctgaacctcgtccaaccaat

SEQ ID NO: 531110 - DNA, 444 bp, Homo sapiens
acccattgactacctcatgaagatcctcactagagcgaggctacagcttcaccaccacggacgagcgagaaatcgtgcgcgacaatcaggagcacgctgtgctacagtgccccggacttcgagcaggagatggccaccgacgaatcctcctcttctctggagaagagctacgagcttgccgatggccaggtcatcaccttggcaatgagcggttccggtgtccggaggcgctgttccagccttccttggtgggtatggactcttgcggcatacacgagaccagcttcaactccatcatgaagtgtgacgtggacatccgcaaagacctgtacgccaacacggtgctgtcgggcggcaacaccatgtattcgggccttgctgaccggatgcagaaagagatcacggcctggggcccagaaccatgaagactcagatcatcgcaac

SEQ ID NO: 531111 - DNA, 330 bp, Homo sapiens
ttatcacaccaaattttagaaatatacttcatattatcatctagccccattctctctcttccttatgtataagattcctattccattgcatgctagtcctatttattttgtcctgcagatcaccaaggctctgttcatttatattttattttttttgagacggagtttcattcttgttgctcaggctggagtgcaatggcgtgatctcagctcaacgcaacctccgcctcccaggttcaagcgattctcctgcctcagcctcccgagtagctgagattatagatgggccacggcaccaggccggttctttctgttttgtttttgtgataa

SEQ ID NO: 531112 - DNA, 969 bp, Homo sapiens
  misc_feature (1)..(1): n is a, c, g, or t
  misc_feature (570)..(570): n is a, c, g, or t
  misc_feature (610)..(610): n is a, c, g, or t
  misc_feature (614)..(614): n is a, c, g, or t
  misc_feature (669)..(669): n is a, c, g, or t
  misc_feature (674)..(674): n is a, c, g, or t
  misc_feature (683)..(683): n is a, c, g, or t
  misc_feature (705)..(705): n is a, c, g, or t
  misc_feature (708)..(708): n is a, c, g, or t
  misc_feature (716)..(716): n is a, c, g, or t
  misc_feature (722)..(722): n is a, c, g, or t
  misc_feature (736)..(736): n is a, c, g, or t
  misc_feature (752)..(752): n is a, c, g, or t
  misc_feature (764)..(764): n is a, c, g, or t
  misc_feature (804)..(804): n is a, c, g, or t
  misc_feature (807)..(807): n is a, c, g, or t
  misc_feature (828)..(828): n is a, c, g, or t
  misc_feature (839)..(839): n is a, c, g, or t
  misc_feature (844)..(844): n is a, c, g, or t
  misc_feature (871)..(871): n is a, c, g, or t
  misc_feature (873)..(873): n is a, c, g, or t
  misc_feature (876)..(876): n is a, c, g, or t
  misc_feature (894)..(894): n is a, c, g, or t
  misc_feature (959)..(959): n is a, c, g, or t
ngtaattataattataatctgtatatctaaacagtgcctttgtaaaaaccctttccatcatcttcaaattcagtctaaaaataattgtacgctatacttttcaagtggggtttaaactattgtttcatatttaacataaaatattttcctatttaaattaacatacttttatgttcacagtaaacaaactgcataggttttcactttcattttcttctgacatcttctgcaaaagaatgatctgcccattttttggataaaaaggctagaataatgtgaccggagctgggtgaggtggctcatgcctgtaatcccagcactttgggaggccaaggcaggcaaatcacttggagggccaggaggttcggagaccaggcctgggccaacatgggtggaaaccccggtctctactaaaaatacaaaaattaggccaggtcggtgggtgggcatggtgcctataattccaggctactcagggagggctaagggcagggaggaattggcttggaacccggggagggcaggagggttggcaggtgaggctggagggttggtggccatatggcactnctaggcctgggggaggacagaggcaaggactcacattctncaanaaaaaaatggaaaaacatgaaaaaataaggaacaatggtggactggggggggagnacttnaaaagtggngggaaaaaatggaatggctggnaangaaactcngtgaanactggggctggaangatggggaacaaactncccccaaagtcntcccaggaggagggcaggataaagggggactgttaaaacncangcaaaatggccaacctggccntgttcattctnagctncaggaaaagggggcacaccttctgggnangcnagctggaattttaaagtnccagtgtgggcacttttcaagaaaatgggcatcaaaagggttgggaccattaaatcttttcttanttctcccagt

SEQ ID NO: 531113 - DNA, 120 bp, Homo sapiens
actagatcgtgtaaatgggtgctggtatattgttgttgagatgaggtgcgattcggtcctcctactgacgtttaagacttagtggtattcacgtagtacgttgtgcactcgtcaatgcga

SEQ ID NO: 531114 - DNA, 257 bp, Homo sapiens
  misc_feature (27)..(27): n is a, c, g, or t
  misc_feature (89)..(89): n is a, c, g, or t
  misc_feature (103)..(103): n is a, c, g, or t
  misc_feature (212)..(212): n is a, c, g, or t
aatgctggtctcatgacagtgagtganacctgaaggttttataaggggcttttcccctttcgctcagcacctcctgctgccttgtgaanaaggtgccttgatncttgtttgcattcaccatgattctaagttttctgaagccttcccagccatgctgaactgtgagtcaattaaacctctttcttttataaattacccaggctcgtgtatgnctttattgggagcatgagaattaaccaattcactctgtctctatt

SEQ ID NO: 531115 - DNA, 777 bp, Homo sapiens
  misc_feature (39)..(39): n is a, c, g, or t
  misc_feature (122)..(122): n is a, c, g, or t
  misc_feature (141)..(141): n is a, c, g, or t
  misc_feature (146)..(146): n is a, c, g, or t
  misc_feature (158)..(158): n is a, c, g, or t
  misc_feature (169)..(169): n is a, c, g, or t
  misc_feature (185)..(185): n is a, c, g, or t
  misc_feature (195)..(195): n is a, c, g, or t
  misc_feature (199)..(199): n is a, c, g, or t
  misc_feature (240)..(240): n is a, c, g, or t
  misc_feature (262)..(262): n is a, c, g, or t
  misc_feature (372)..(372): n is a, c, g, or t
  misc_feature (394)..(394): n is a, c, g, or t
  misc_feature (398)..(398): n is a, c, g, or t
  misc_feature (409)..(409): n is a, c, g, or t
  misc_feature (412)..(413): n is a, c, g, or t
  misc_feature (416)..(418): n is a, c, g, or t
  misc_feature (428)..(429): n is a, c, g, or t
  misc_feature (444)..(444): n is a, c, g, or t
  misc_feature (454)..(454): n is a, c, g, or t
  misc_feature (457)..(457): n is a, c, g, or t
  misc_feature (463)..(463): n is a, c, g, or t
  misc_feature (465)..(465): n is a, c, g, or t
  misc_feature (479)..(479): n is a, c, g, or t
  misc_feature (484)..(484): n is a, c, g, or t
  misc_feature (488)..(488): n is a, c, g, or t
  misc_feature (490)..(490): n is a, c, g, or t
  misc_feature (517)..(517): n is a, c, g, or t
  misc_feature (529)..(529): n is a, c, g, or t
  misc_feature (545)..(545): n is a, c, g, or t
  misc_feature (565)..(565): n is a, c, g, or t
  misc_feature (574)..(574): n is a, c, g, or t
  misc_feature (587)..(587): n is a, c, g, or t
  misc_feature (613)..(613): n is a, c, g, or t
  misc_feature (625)..(625): n is a, c, g, or t
  misc_feature (631)..(631): n is a, c, g, or t
  misc_feature (641)..(641): n is a, c, g, or t
  misc_feature (651)..(651): n is a, c, g, or t
  misc_feature (665)..(665): n is a, c, g, or t
  misc_feature (709)..(709): n is a, c, g, or t
  misc_feature (714)..(714): n is a, c, g, or t
  misc_feature (745)..(745): n is a, c, g, or t
gcggtgggaggtacagcctccccagccttgctccaagtnggatgcctggccccaaacccccagtttcagtgaggtggagaaatgtgttgggaggaactgcccctagggatccccggcctganccttcatagggcacaagantggantgtcagcaagancggcacaagtngcgtcaactccagganaccacctggnaggngctggcaccatgggctaagaatcaggcaacttaggttctantcctggctctaccatgtagttnctgtgtggccttggacaagttactgaacctctctgagcctatttcctgatctataacatgcagctcatactaccttttagggctgtttttaattcaatggcacatagtangttttcaataaacattaatttnatanagatacttcancgnnctnnngtgttgagtnnttagttaattttatntagttgcttnatntttttntnatcccacctttgcnatgcnttantnctgttacttattgttatttatattttntctctctgagcnttagtttacttttgtnaaatggaagcaatgcttatntcatgaggntattttaaggaangggttaaataaatgaagacttctgtnaacaggaattancattanaggcaaagtntgtgagtggnctcccctccctttnctgggacagattgaactttggttcaaataaaacctaaacagggncaagntaggacccatctctccaaggtttcaaataanaaaccgaacgatctattctctccatgggctga

SEQ ID NO: 531116 - DNA, 237 bp, Homo sapiens
tatgttactagttgccttaatctgtagctattggctatattacgcgttcttcatttttcctgctcacattttgtatgagcaggatctgtggcttatttgtggtgattttcaagttacttttactttgtgtataattaacacttaaaagatcgctgctaaacttgtctagatgattatcatctatcaaagttttttgtctttctagtaaagattgatcatggttcaataatcgcaaat

SEQ ID NO: 531117 - DNA, 288 bp, Homo sapiens
atagcgacaccgtaccaaagagatcacactacgcctgtggagcctgcggcacggtgcaggatgtactgaccaccgtcaaggccactggcaagacaggaccgatggcagcctatgcagtgcaaggctatgcgcccaaacgcggtgcgtcaggtaaaccttacaatggacgctttttcgcagcctacggcacagcgcaggcacagcagcacgacactgcgcttgctgaatgggaagcgcgcaaagatgccgatctgaaagaatactggccacgttcggagcttccctacg

SEQ ID NO: 531118 - DNA, 113 bp, Homo sapiens
  misc_feature (28)..(30): n is a, c, g, or t
ttttggactccgcccaacaaccgctgtnnnggccaacaaccaggatacaacggtaacatcaacgtgcgggacgtggacatctgaggctacgactgggacgtgcgggacgtgga

SEQ ID NO: 531119 - DNA, 762 bp, Homo sapiens
gtcatcggaactctgctcgagtgccgtccgcgtctcgtcgtctgccggtctcgatggaagaggagatcgccgcgctggtcatgacaatggctccggcttgtgcaaatgctaggtttgagtggggagctgacgctccaccgagccgtgttagctttccgatcagatctgggcggccccgagacaccaggcgtcatggtgggcatgggccagaaggactccatacgtgggcgacggaggcccagagcaagcgtggcatcctgaccctgaagtaccccattgagcatggcatcgtcagcaactgggacgacatggagaagatctggatcacaccttctacaactgagctgcgcgtggcccggaggagctatcccagatgctgctgaccgaggaaccccctgaaccgcaaggccaacagagagaagatgactcgggattatgtttgagaccttcaaaacccggcaatgtacgtggttcatccaggccggtgctgtccctctacgcctctgggcgcaccactggcattgtcatggactctggagactggggtcaccccagcacggtgcccatctacgaggggctactgccctcccccacgccatcctgcgtctggacctggctggccgggactgacctgatacctcatgaagattctcactgagcgaagggtacagttcaccaccacgtgcgagcgggaaatcgttgcgcgacatcaaggaagaaagctgtgctacgtcgcctggacttcgagcaggagatggcaac

SEQ ID NO: 531120 - DNA, 111 bp, Homo sapiens
  misc_feature (91)..(91): n is a, c, g, or t
tctgttttccccgttagaatatcagattcaaggctgttcttgtcccctgcatctcgacaatctagcgtctaaacaaataataaaagttacntttattaaagatttccatca

SEQ ID NO: 531121 - DNA, 671 bp, Homo sapiens
agtctcgagctgtctgtcctttcatttttcctggaaatggagtctcgctctgtcaccaggctggagtgcaggggcgcgatctcggcacacctccgccttctgggttcaagcaattctcctgcctcagcctcctgagtagctgggactataggtgcattgccaccattgcccagctaatttttggtattttatagtaagaagacgggggtttcaccattgttggccaggatggtctcggatctcctgacctcatagatccacccacctcggcctcccaaagtgctggagattccaggcgtgtgtacccactgtgcgccccggccagcccttgtgtggctcttttcaaaaaaccttcggcccccaggtgagtggcgtgaatttcacctcccacgtggtttcgctaaacattacacctcctctccgtggggaatcccatctttccatgacacgcctttgctccactgtgggagatgtcaacagggggaaagttcacctgtgccaggggtagacctctgtgccccccccaatagaccccgtgtgcgcccaaggggccacggagcaactgactcccccaaagaacgcccccagaacaccgtggagggggagaccaccctctcccacgtggacccacgccccaaggccccccaaatccccggaaaacccccaagggg

SEQ ID NO: 531122 - DNA, 885 bp, Homo sapiens
atttgatgtgaacaaatccaccttacagagaggaagacataccagctcccctaattttgtttggcataacaaatagtttagatggatgaaaaggctgtcctgggagaacaatgctagggagctgctgttttgaggattcctattctgtatggggacatgttgacaagctcgaagaaagtgctgtgactgtaatgtttgataaatgtgcatgttcaagcaaccatattcagcaaagcatggtagtcatgtggcacgtcagaggtaccccagcacatgtcaaagatgtggccaactgtgtgccggcagcatagcagagaagagaactgctggatccactcaatttaagggatacctttcagctggtctggcaactgaatcagatgactaaggactgaaatggcatgtgccaatttgcgacgatgccttctaaccctccgccatgcagtcacgtcttaagacctattactgatcagccctgtcctagtgagcgcaaaggtccgagaaatgctcaggcttgactgctccaagattggagaccttgggcattggttcaacgaactaccatttcgaattggaactctgagaatcactttggcctttcctcattgaccaaagagatggagacacacacggtcttgtcattaggttcatgtgtagctgggtactgaatatttttctaaggtgacaaaagtcatagttatgtggcaccctttttagcgaacccagcgaacatgggtttgtaatgagtacgttacattgtgactccttgggggaatcttccagggaaactgaaggtccttgcaccagtgacaattgtcttaaggaacttaagggggcgcgtgccccgtttgccggaattgctttaatccactggtggcccggcaa

SEQ ID NO: 531123 - DNA, 129 bp, Homo sapiens
atagcccccggggctatggaagagcggtagggagtcacggagaagatgcagtgaatgcttgctatgcattcactacgtgtgtgtgtcccatctagttcactcctttcgccgtgcatgataggaggggcg

SEQ ID NO: 531124 - DNA, 1324 bp, Homo sapiens
gcacatgacacagggcaaaaagtaaccgtccttgacagggagtcttaactagagccggaaactgggactaaactggcgtggctcctgtggaagcgtggccgagcagcgtcccggacgacggagatgtctttgagttggacttgggaaacgaggttgctagaagcagcaagaaaacggccaagatgatgaagtgagaacgttgatggcaaatggagccccatacaccacatgactggcatatggaacaatcaaccccatccacctatgccagcctcaattatggtcatataattccacagcagacagtacattccattcgagcagcgtattaggcagaggatgacccgagaactaaccagtaagacagagaccaccactatgacaacataggcatgcaagaccgactgagcacacatgcgacacatacgtggagaactggacttgtaacaggaaaaaggaggccacgactgctgaacattgcccaaaggaacattgactgcaaagactgaccagccatatatgcataggagagaccaacaagaacagcagaaccaccaatcgaggaatgcgacgtacacagataactataatccacaaaactgggacgctagaatgttcacagtgccattttacaagggagcagattatgaatcacaagtccatgccctagaggacccattaagcttcatgggaagaacaagaaaacatggcttgacgaaattaatagagtacaaatacttgccagtggaaagcacaatgcaagagtaacttcaagagttgcacagggttaaaaatcaccagcaggaggaaggccaacacaacattgaggaacatggaaaccgaggagaggaccatcatggggcagagaacgcaaaacgaatcctaaaaacgacacgcgggaacgaagggaaaggaaaaacccatctcaaaagagcccaacaatacctacaaacccacaacaccaaacaaaccaaacccacaagggggaacccacaaagtgccattaaaacacggtaacagcaatatcaaaaatatcttacaaaccattaaaaggatagatatatccacatgaaagaaatactataacaaaagcaacttgaatggaccaaatatataaaagtataaaagaaagtccagtgcaaagcaagtagggacattgtaacaaggaacctccggagacattcctacgagagcacattggggaagtgaaaaccacaaggtactcgcaagcgaaaggatgagaccagagtgcagatgaaaatcaaaaacgaagaaagtgtagacaatgaaactgaaataacaatatatgcatagtagagataaa

SEQ ID NO: 531125 - DNA, 224 bp, Homo sapiens
caccgagtccttaactgtcttatcattctcgacggcctcagccttctgtggcagcgtttccacaacggagtgctcatagacacgaactccaggtgcctagcggccataatatagccaactgagcggtctaggtctgagtggcagggacttgctgagccgcagccttcagcatgtctgcaagctgagccagcagaccacctgacaacaggcgatatctgtaacaa

SEQ ID NO: 531126 - DNA, 543 bp, Homo sapiens
  misc_feature (28)..(28): n is a, c, g, or t
ctcaaaatgtcgcgccatgtgctagcantacagctgtgagctctgtgaaagccctatctcttaaaatggttgttacatatgagatctggcaatgttgctcgaactgtactcacactcctgtgtcaacgtgttatatggcttcatcttacgaacacaatagttaataggcataagcatcagaaccatctagcagatcaaagaacatttaaatattgttaaagtatgttggcttaaaacgtcatgccactagcaagttcgtgttacataacagaacttaatttcgaccaggcatgttggctcactcatgtactcatatctcttatataggccaatgtggactcatcgctctagcccagaagttccagaccaccttggaccacgtgtctcactctctgtttttacattgtaaaataaaattgcacaagggtggtggagaacatctgtagtcacacccactttgtagcataaagtggtagttgcgagtaagtcctgtacgacagaggcttcggtaatctgagctcacaccagtccactgcagcctag

SEQ ID NO: 531127 - DNA, 116 bp, Homo sapiens
tttactgagtgttatgtaaaggatgcgtagggctgggagggcgatgaggatatgatcatggcgggcatgatagttcacacggtttctatttcctgagcgtctgagatgttaggggt

SEQ ID NO: 531128 - DNA, 1222 bp, Homo sapiens
gatgacccatgtggcagtactgcaagtggaatataggcgataggcagcccgaggaacatccagagttactgtgtgacttggtcctgccattgtatagactttgaaagtcacaggcattgggctctagttttagacaccattcattaggcactgcgggcaccacgtcatctcctttacgcttcctctctttgcagcctggctgcagcacgacggaggaccgcacgcgcgcagagctcaacgagacaagcctcccacaggccctactgctcagcccctccttcctcccttgcgcgctctacgcgcggctgcgcgcttagaaactggcgttcccacgctcgtggccccagcataggcgcttgcctaggcctgcaactaggagcggctgcacttccttactcacgacagcactggcgcctgccctagtcgggtacccagcgcaacacgggggccataaacccaggtacctagggaactacccacccctttacccccagaatccacccctaaccttctcacacgggacccctacgtaggaaaacactagggggcttgactccccaactttcaaaaacgcgcgccctagcgcgggccaaaaccccccttagcctctctccggggcccagacccccgttcccattttttacccacaacgcctttccggcgtatcgggcgcacgcccttcagggcgcgttttaccctaggttcctaccaccttttcccccaccacggcctttttccaccgcattggcgcaccgcccacggactagggacccaccaaccccctttcttcaaattttcccttacggtcggtcctctggctcctaggtcccagcatctgggccacgggacgggcccctggtaagtccaggcctacacatctctcgcgcgcgaccacactgcgttcctcctcccttgtgtgcccaaggcgcgtcacccaggcctttgccggtctgcgcgcttcgctgctcgggccacctctggttccctcctttcgcgggccctttcgtccttggcccctgtggtgaactcctcttccccaccctccccgcgtgggcgctttacacccccgggggaaaacccccgcttctctcctcctaccccacgcccccaccccttttttcgaccttgtctcccagcccctcacggcgctgcgcgccgctctgccccggtgctctcccccgcgctcccgtgacgaccctcccgccgtcgtggctccccacta

SEQ ID NO: 531129 - DNA, 114 bp, Homo sapiens
cttgttacggtggcatatccttgagaagacaggttaacatgcatgaatatatcctcataagccacggacacaggtctagtagtatgcaagaaacttctgaggctttgcatggct

SEQ ID NO: 531130 - DNA, 480 bp, Homo sapiens
cagatgtgggagtggcgttccgagtatggtgaccatattctagatgagtgcagagaatttattcaagccaggctaagaaagctacgtggatgcagatgatgtgcgatggaaatcagtgccgcgctgatcagtctttaacctctcctcccccaagagatttattattagatatagcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcatgtcatac

SEQ ID NO: 531131 - DNA, 2459 bp, Homo sapiens
tgagacagagttttgctcttgccgtccaggctggagtgcaatggcgcgatctcggctcgctgcaacctccacctcctgggttcaagcaattctcctacctcagcctccagagtagctgggattacaggcacctgacatcacgcccagctaatttttgtatttttagtagagatggggtttcaccatgttggcaaggctggtctcaaactcctgacctcaggtgatccaactgcctcggccttccgaagtgctgggattacaggcctgagccaccgtgcctggccttttattttgtgtgtgtgtttgatttctgacttggcctttttaaaaaaatcacaaaatatataatacggccgggtgctgtggctcacgcctgtaatcccagcactttgggaagccgaggtgggcagatcacgagatcaggagatcgagaccatcctggctaacacagtgaaaccctgtctctacttaaaaaaaaaaaaaaaaaaaaagatagctgggcatggtggctcgcatctgtagtcccagctactcaggaggctgaggcaggagaatcgcttgaaccggggaggcagaggttgcagtgagctgagagcacgccattgcactccacactccagcctgagcaacaagagcgaaactccatctgaaaaaatatatatatataaaacaaaatttataattttaaccatttttaactgtaaagtggcattaagtacatccatattattgtgttatcaccataagtggtgatattccactatcaccgtaagtggaataatataatatttattcattcattccttttttttttttgagacagggtcttgctttgtcacccaggctggagtgcagtggtgtgatcacggctcactgcagccttgacgccctgggctcaagggatcctcccatctcagcttcctgaggagctgggattataggtgcatgctaccacgctctgctatttttttattttttgtagagacagggtttcaccgtgtcgtccaggctggccctggactcctgacctcaagtgattctcccacctgagcctcccaaagtgctgggaatacaggtgctgggattacagatgtgagccaccaagcccagccaatattaatcctttcacttagcataatgtcttcaaggttcatccacattgtagcatgtgtcaaatatctttcttttttttttttttgagacaaggtctggctcccctaggctgaggtgtagtggcgcgatttcagctcattgtaacctccatctcctgtgctcaagccatcctcccaccttagcctcccaagcagctgggactacatgtatgtgccaccacacctggctaattttttttttttttttttttggtagagatgttgtttcaccatgttgcccgggctggtctagaactcctgggttcaagtaatcctcccacctcagcctcccaaagtgctgggattacaggtgtaagccaccccgcctggccttcacttattttaaaaggctaaataatacaattattattattcatatcatgtatgtattatatgtaatacaataatacagacaatttcattgtatagatatacctcattttatttgtccattcatccgtagatggacacttgggttgcttccatttcttggctgttgtgaataacactgctacaaacatgggtgtacaaacatttcttctaatccctgctttcagttgttgtggatatatacccagaagtggtattactggatcatatggtaattctgtgtttaatttttttttttttttttttttgagacggagtttcacttttgttgcccaggctggagtgcaacggcgcgctcttggctcactgcaacctccgcctccctggttcaagcgattctcctgccttagccccctgtccatgtttaattttttgagaaactgccatactgatttccatagcaactccaccattttatttatttattttttattgcttttttagagagggagtcttcctctgtggcccaggctgaagagcagtagtgtgatcatagcatcatagctcactgcagcctccaactcctgggttcaagggatcctcccacctcagcctcccaagtagctgggactacaagtgtgtgccatcacgtttggccaattttgcattttttataaagatggggtctctatatgtttcccaggctggtcttgcactcatgcctgtaatcccagcacttcgggaggccgaggcgggtggatcatttgaggtcaggagttcgagattagcctggccaacatggtgaaaccccatctccactgaaaatacaaaatttagccgggcgtggtggcacgtgcctgtaatcccagctactcgggaggctgaggcaggagaatcacttgaacacaggaggtggaggttgcagtgagccgagatctcgccacttcactccagcctgggcaacagagactccgtctg

SEQ ID NO: 531132 - DNA, 718 bp, Homo sapiens
gggactgcaagtagctactcgtatatctagcggcatcttacgagtgccctactacctatatatacgtatccggaaacatggcctccggtgctggctgtacctactgatggtgtacactcaaggtgttcaacgacatgaatggtgcgtaatgtcttcaacgccagaggaggtgaagaagcgcaagaatggcggtgctctatctagcctagagaagaggacaagaagaacatacataccatggaggagggcaaggagataccatggatgggcgatagtagggccagactagtcgacgataccctaacgaccacctaagtacaagatagcagcccagaataaatggaacttgcctgcttaattggaccctactaatagcatgctaaccctaatgcaggtacacaatggaggactgcacatgcaagtggagtgatactagagttgttaataatactatactaggagaaacacccacggaagtactagacggacaccccacatataaaaagcagcgactcaacgacaatatggcagagttcataagtcaccaaggacattccccaaaagggggaagtgccccatatcgaaagcgaacgaaatgtctaggacgatggggtgcattccaaatgctattaggacactaatgccgaaggccaaaaccttggctataatggaaagggatgaggttcacatgtggaacctggctaatgacaaccccctg

SEQ ID NO: 531133 - DNA, 102 bp, Homo sapiens
accccgctacggagccgtgcatagaggtagcaccaggcggactcgctcgagagctcacggaggttcgtggtgccctcccggagcaggttgtaggtctcgaga

SEQ ID NO: 531134 - DNA, 169 bp, Homo sapiens
cagaatatatatatacgtatgctagggtgagtggttgaagtaggacataggatgagtatgagtaggtcgtcgcgggactcgggggtatgctgtgcgaattcataagaacaggaaggttagaagtagggtcttggtgacacaaatatgttgtgtagagtacaggggagag

SEQ ID NO: 531135 - DNA, 288 bp, Homo sapiens
ctgaaacccgcgtattttttggatttaaggcacaaaaaaagacgtccgtggacgtctttagatgatgaagtggtggagccggggggatttgaacccccgtccgccagtactccgctgtcggtactacatgcttagccgtttctattaagttaaccctcagcgacccgaagggcagggtgctttgggcgagttgtgtaagttttagccgcttcgtccacaacgtactgcacggcgattctgttctatatgacaatcactttgggtttacagacatcccctggtgattgc

SEQ ID NO: 531136 - DNA, 339 bp, Homo sapiens
  misc_feature (77)..(77): n is a, c, g, or t
  misc_feature (91)..(91): n is a, c, g, or t
  misc_feature (103)..(103): n is a, c, g, or t
  misc_feature (158)..(158): n is a, c, g, or t
  misc_feature (168)..(168): n is a, c, g, or t
  misc_feature (199)..(199): n is a, c, g, or t
  misc_feature (202)..(202): n is a, c, g, or t
  misc_feature (204)..(206): n is a, c, g, or t
  misc_feature (213)..(213): n is a, c, g, or t
  misc_feature (222)..(222): n is a, c, g, or t
  misc_feature (228)..(233): n is a, c, g, or t
  misc_feature (258)..(258): n is a, c, g, or t
  misc_feature (265)..(265): n is a, c, g, or t
  misc_feature (267)..(267): n is a, c, g, or t
  misc_feature (273)..(273): n is a, c, g, or t
  misc_feature (277)..(277): n is a, c, g, or t
  misc_feature (282)..(282): n is a, c, g, or t
  misc_feature (305)..(305): n is a, c, g, or t
  misc_feature (312)..(312): n is a, c, g, or t
  misc_feature (327)..(327): n is a, c, g, or t
  misc_feature (330)..(330): n is a, c, g, or t
gctggagcaaacgcggctgggcacggtggccctgctgcagttgatggaaacgccaaagctggcggggcaggaggacnctgtacggatgcancagctgaaaatnaaggtaattaaaaccatggaggcgatcagcgaggttttccaggaccttaggtttnatgcggaatntgccgagtgatggcggctccccagggatgcnccnannnaaatggnaaacggggnggatgnnnnnnaacccagccctaactgccagctggntggggtngngccccnctgngctgntgaccttcctgcagttccagacncctcccncaataaaaagctccnccnctgtaaaaa

SEQ ID NO: 531137 - DNA, 196 bp, Homo sapiens
gacgctctcttctgtggtggaaggggcggaggcctggtaagacccctggactcgttcaagggccctagagtcggtcctggatccaaaccccattcatggtttggctggtctgggtgctgcatgggcatgcctgctgtgttgcacatgtgctcggtgtcagtgaccccgacggtggccacctgtggtgcacctgcac

SEQ ID NO: 531138 - DNA, 645 bp, Homo sapiens
ttgggcatcccggggcccccctgtggtagtcgccgctgtgggtgccccccgtgggataattgtgggccacgagggaatgccctcttaaggctttgcctctcctgggctgtgacagtgcgcacgctgtcaccccccgttcccccccgtgtttgtggtagctgtgaatggtcgctctgtcgtgttttcgacaaaggggggtattttttccttgccgcgttgctcgcccccaggagttctgtaatataacgtgttgttttgaaggctcccctgtgcccagttcataattaaacacgcttataacgcagttctcttctgataatccctatgcagctgaaatagggtagattgtagtggtagttattagcgcgcccaagagttgtttattattgtgctgtgcaaagcccggcggtctaggttacacacgcgggagtgccgcgccttccgtagccacacaagagaaacaccccccttttgttgtttttaaaacaccaattttcttcattatgtgtgtattctcccctcccaaacataactgtgggcgcacacacattccccctactccctacatgtaatatatataaaacaagataataaacacccaagcagagggggattctttctccccatcaatatacaaaacaacta

SEQ ID NO: 531139 - DNA, 315 bp, Homo sapiens
  misc_feature (219)..(219): n is a, c, g, or t
cccctcacactttttgcactttctggagcttcttactgccttttcctgtcccctagtcaacggcatccatcttcctggtaggaggcttcttgcattctgtgtatcagtttgttcagcttctcctcctttatttggacagtgatcaattgaaccatgagtgtttatttacatatgtgtttccttcaaaagaggaagaactactttgtgggtctgtatgtnatgaacatgtcacaccatatatagactatgatgcttttgttaagaaaggcttcatgttttagatattttccgtgtccctatatgattttcaataat

SEQ ID NO: 531140 - DNA, 228 bp, Homo sapiens
ttggtcgaatcctgccctggcccattggtgagagcgacctgatcattggcgccaataatcgctcagcgtgttgccaccactggtctgagcgtactgagcctgttatgtaattctcgtccaagctcgaagcccccaccgcagagtgcggcgacggaagccattgttagggaaatgttccggattgcgccatccctatttagaaaccatgacgcattgactcaggcagcg

SEQ ID NO: 531141 - DNA, 342 bp, Homo sapiens
ccaatttaaacttttgttttgtcatatgcaatgattttattacctgtctttatttcagagcttatgaatttttaattattctaagggctaacatagaactttttcatgttttctactcttcaagagtaggtaagactttagtttgtaatacattacaaaaggaatcctgtggttctctaagagctaatttgtcttggcaaaaggccttagcgagctgggattacaggagtgagccaccacacccagcctctagtagtacttttatcaaaagtaaatgggaaacatgaaattaattttcacaatacattttatttaaactaatatgttcacaatgttaaaatt

SEQ ID NO: 531142 - DNA, 82 bp, Homo sapiens
gcggccgcctactactactactgctcgaattcaagcttctaacgatgtacggggacatgtatctgtctactttctcttgttt

SEQ ID NO: 531143 - DNA, 148 bp, Homo sapiens
cccctgatcgaggtcttcatgaagacaataggaagatatggaagtcaaaagagaaggtgaaatgtggtcacatctgctttgtcttggcagccaggcatttgggcacccccaccagcctaatcaacatggagaaaccgtcgaattcgag

SEQ ID NO: 531144 - DNA, 766 bp, Homo sapiens
gggtttccttggtgctccggatcctctattgcccaatccccgatgggaccatcccccctttccctggggaatggggtatccccgtccctttgggttgatagcggtggggcaacagcgctccgtgcctattcccccctttgccccctgggtcgttcctaagacaccccggttcacctggacgggcgctctccgccagcccctgggggacggccgcttgcctcaccggttcccccctccaggcgcaaaacgggggtcaccggatgcattttggtggactttctgagctttgcaatgctcgctcaaagcgcgcccccggccagcaacgcccccacacgggttttggttccaacctccctcggcggaagcccaatcgcgaggccagcgagccagggcacgtccctacacccactcctgcccgcgccagggctgggactgggatcggaggccagtgagcactccacggcccctgcgcagaccacgtacccatgcactggctcgcgctcgcaccgcccagccccggggcctgagtccgtcccctgtaaggatgccgggaagtgatcagctaccccggagtcggcgggacatggcctcagcgggatggggaccagcgcactggtccggccacggggactgtgggccgtggcgcattttccgactgcttgtccagctctcactgcctatccttggttcccaggtacccccaagccatccgcaatccccagcccgtggtcaggtagagagtgagccaatcccgcccagggaggaa

SEQ ID NO: 531145 - DNA, 905 bp, Homo sapiens
ataccagcactgtgggaggcccaggagggtggatcacttgagcccagtgcaattcagagactatgcctgggcaacatggtgaaaccctgtctctacaaaaaatacaacagaattagctgggtgatggtatgtgcatgcctgtacgtcccagctactcagggaggctggggtaagattccttgagcctgggaggtgggcacgtggcggtgagctgagatcacaccactgcattccagctctgggcaactagagtgagaagaaagaatcatggaaactctagagtgaagtcaaactgttattatgacgattctcttgagaagccaaggtgttaagtagagaacggatgctaataatttaacgaataattacacgcctgtaatcccagccactttggtcaggcccgggtggatggattgcttgagcccatggagttagagaccagcctaggcaacatggcaaaatcccagctctatttaataacaataagaagagtgtcatatgtgcccgtttggaacaaggtatctatagagacatcatatccatctcggccatttcgagataacatcttacagctgtctatggtaacattagggtgttcctgagtgcaaccaagaattctctagcggagcctagatcagtcctcggtataatgatcggcgtggcccaaatgagtttgtaaaccacaatagcgtcagcttaggaggcacgacaaatggctgttgcagcgtggggtccacccgtacccccactggaggcggacggtgggtccgaattcgggcggacaccgccgcaaaggaaccgcccacaccaagtgggacggccgcgacccccatgggggaacagatagaaccagggcgacagaacaacggaaaaaaagcggcaccacgcgagaacgagcacgcgac

SEQ ID NO: 531146 - DNA, 467 bp, Homo sapiens
gatctcagattcactgctagacttctggctcccggcgttcctagtgatactcgtgcctcagcctcatgatgtgctggcgacttactggcatgctgcaccccgaccccgtctgatttgctgatttttagtggatacggcgcgtttccccatgttggccaggctgctctcgaactcctggcctcaagtgatccacctgtttcaacctcccaaagtgctgggatcacaggcgtgagccaccgcgcccagcctccaatagtggcctggttctgagactacttggatagtccagacgtattctgatttaacaaacttagtgtgaaacaccacttcactaagtgtatttctgaaaatttcagacaaaaatccagctcactcttgttaaagttgccttgaggaacagtatgtgttaatcttttacagatgcttactgtctagcacaggctcaaatttaagtcgattatcttttc

SEQ ID NO: 531147 - DNA, 593 bp, Homo sapiens
  misc_feature (241)..(241): n is a, c, g, or t
gttgggtttatttcaacagtaaatctgaaactcttgcttaaggcaagagtttcagatttacggtgtgaaataaaccaaactctccatgaaaaaaaaaaaaacgagaagaaaaaagagacaaagccactaaaaaaaaacacacggggcggctgtccagagcgaggtaaacgctgagatactcgtacgacgctgcgccggaccagtgtcaacttatatcaacaccatcgaacgccacggttcnggtcggctattcaacaaacaaaacgcttgtcttctgcgtcagacaccactctcgtaacctaaacgacatcgtgttgagagaagcccaccacacaccaccttctttgagcgggggctagcacgctatcatggggtcgaaactcactatcccccccttgaactccactacacccgcccccccgcggccataccccactataatactacttagccagggactactgtcgtattcgaacaccaacactcgctcatttctaccctgatcggtgaaaacagcgttagtcatcacatccgacatttcattagtcgtccaccactcttattacaaccacggagagtatgtaataaggtgc

SEQ ID NO: 531148 - DNA, 220 bp, Homo sapiens
aagcgttcagagtccacaagcacacctatgccattacgcccatgaaacgcccaagtggaggaggacggggaggagaagtcgcccagcaaaaagaagaagaagattcagaagaaagaggagaaggcagagcccccccagagctatgaactgccctagatgcgtgttgaacacagctgaacgccagggactgcacgtacagagctgtgtgtcccatgactgg

SEQ ID NO: 531149 - DNA, 840 bp, Homo sapiens
ggccttatttctctgctggttgagcgaagggatgtcttccatggtctccgagatcccgtcccagctcatgccctagaattctctgagtccttgatgcactttgccttggcgaggaggcaggacagtcaggcgtgaggctctttaggggtcacccagagactctggagacagttgtgaccagttcaagcacctgaagtcagaggacgagatgaaggcgtctgaggacttaaagaagcctatggtgccacccgtgctcaccgccctggtgtggaatccttaagaagagggggcatcatgaggcagagatttaagccctgcacagtcgcattggccaaccaagcaaagatcccgtgaagtacctggagtcatctgcggaatgcatcatccaggtttctggcagagcaaggcattccgggaacttgtggtgctgatgccagggggccaatgaacaaggcctgagctgttccgaaggcagtggcttcaactacaaggagctgcgctcccggtctagggcccctgcgggtccacccccaccatgtgtggccggttccaagagagaggggggtgggatcccgtggagcataataaaggggccccggaggtgccgctgggcaagaagagtgggcgaagaccaggagcctgggctgggtgtaaagttggttggatgccacggatggcccctggggatgtctcaccggaccggagggctggtaacggtcggagggggccaaaaagggcttaaaccccgattgccaccacgggtggccaccagacaaactcgcagacgtgagcagcgaaaaactctaaagaagggggagcaaaatgtcgcgcggggacaac

SEQ ID NO: 531150 - DNA, 964 bp, Homo sapiens
agggcggcgcctccgcctccgccgcctaggactagggggtgggggacggacaagccccgatgccgggggagacggaagagccgagagccccggagcagcaggagcaggaagggggagaggcggcagaggcggctccggaggagccccaagaacggcccccgtgagggggtcgcagggggcgacctgcagggaccactagcagggcgcggtgcgttgaggggaggatcgggacccgaggcacgggccggtgcgggcgacgccggcgcagtgcatgtgttccgaccggaggaaggccgatgtaatccccgacggcgggatggagccagccgccagcgtccatggcctcccgagcgttccgcgggcaggagccccagggcgcgaagtccccggtctccagttcatgggcaacgataggagtccgggacctcgctaatgcatacgaagaaacacgtaacatgctgataacagagtcccgaggaacgagacagaggaaggaagacgatttctggaccatcccttcagagaagtttcacaatatgctgtgtctaagacactagacccggggcgtggctgttgataggtcggactagtctgtattcgtcgtccatgcgttgatacagagaagcgcccgaatggtcttcggtccgacgaaccggttgcattcgcccgcatcagttgtgcactggcaagaagcaaagattccgaccaacctgttgctgagtagtgtcgggggaaggagcatggggctacacgcggggttagataggggaagaaggcggagcgtgggggtccgggcaggtgttaatcagatcaaggatcctggccaattagtgaggcatgccctcccaattttagacggagttaagcacgatataggggtccggcttgtcgcggcggaagaacctatagaagatgggttgccgtcggggggcaccggtagcggggcgtaaaggacaagtgggtt

SEQ ID NO: 531151 - DNA, 120 bp, Homo sapiens
gaacgcagccggcggaggagttcctgaaccagagctcgcccttctacttcttttttaatggcgaccgcatcgactccctgccggagaacgaccggcagcagacgcacatgctggatgtca

SEQ ID NO: 531152 - DNA, 489 bp, Homo sapiens
gcggcgagggtcccggcgggagccaataaaggtggtgaaaatcaaaaaaaaaaaaaaaaaaaaaaaatgaaaaaaaaaaaatacaagaaaaaaaagaaacaaaaaaaaaacaaaaacaaaaaagttgttggcgggcgcggcgcgcgcccgcgcccccgaagaaactgttctataaaaccacacatgaagatcgggggcggggggggggcacccgcaggggtctcagatgagagactgatgtgggcaaaatgggcggttgctgccccgagaagaaaaacacgacgcggggacaagcagcagtgtggggtgggtggtgtttctcgcacattaaacaacaaaagcgcgcggagggcacaggacgagatttctgcggaacaacaatcacgaaggagggtcgcactgggagacaccaaggggctcaacatagagacgacgaggacacgagaggacgggacacttaaaaataataccccccaccggggagggaga

SEQ ID NO: 531153 - DNA, 283 bp, Homo sapiens
  misc_feature (11)..(11): n is a, c, g, or t
  misc_feature (30)..(30): n is a, c, g, or t
  misc_feature (73)..(73): n is a, c, g, or t
  misc_feature (145)..(145): n is a, c, g, or t
  misc_feature (183)..(183): n is a, c, g, or t
ccccaaatagnttaaaaccattttagaaanagaagaatgaattggaagtagtctgtccacccctattttaagnctttctttttagtgacagtaatcaagactgtggtattgacagagggatagacacgtagatcaatggaacagnataaagaacccagaaatagactcacacaactatgcccnattgatttttgacagaggtgcaaaagcagttcaatggaggaaggatagtttttttgagaaatggtgctttttagaactaaacatccataggaaaaaaaaa

SEQ ID NO: 531154 - DNA, 227 bp, Homo sapiens
  misc_feature (39)..(39): n is a, c, g, or t
  misc_feature (84)..(84): n is a, c, g, or t
  misc_feature (112)..(112): n is a, c, g, or t
  misc_feature (117)..(117): n is a, c, g, or t
  misc_feature (193)..(193): n is a, c, g, or t
attcaaactttaatctcatccagaaataccctcaggganactcccagaatagtgtttggccgaaagtctgcaccccatggcccngtgaagttaacacataaaagtaaccatnacatnaccctagactactgctctcccacaccctccacatctacgtgacacaaaatccagttggtttcaccttctaaatatntctcttgtctgtcatgtctgcactccagcctggg

SEQ ID NO: 531155 - DNA, 153 bp, Homo sapiens
ccccccccccctttttaaaagggggggggggggcaaggcccccccccccccccccccccgtcccccccggaaaaaaggggttccttggggggggttttttgggggtggggggggggttttttaacccccttttttaattttttggcccgggga

SEQ ID NO: 531156 - DNA, 1047 bp, Homo sapiens
  misc_feature (111)..(111): n is a, c, g, or t
  misc_feature (704)..(704): n is a, c, g, or t
  misc_feature (809)..(809): n is a, c, g, or t
gtcactggggccgggcccccggggaggacgaggaaccctggggagcggggtggagggcggtgggtggttttgggatagggtggcggtagataggtcgtcgtcgcgcgcttnctcaccgcaaaacacactgcaggcgcacccacgaaagagaggaagacacacaataaatcaaaaaaaatgaaaccacccgccagccacagtcatgaaatctctatagaaagagtcttccgggctttgggtgagagtggcggtgtggtaggacggagggtcggttgtgcgaagccgccgccccgcaggggaaagggaagggaggtagaagaaagccacgaaccacggaaccgggccgaacgaagaacagaacgtggaacgtagtgacacacccgccacgcaccccaccgcacaccatcacaacgacaagataagacatagagggtaaagagtccggggtgtggtggggggacgccgcgtatgagtgtgcgggtaggcagctactacttatgcagacggggcgatagtgaggtatgtaggggtatttcaatcgtataaactcaccgaatatctatagaagagatagagatcaggtgcacaggttagatattagaataacaattagaggtagaagtaaagtgtgaaatacgcaggtgtcaccgaggtgcggcggacgaggatagagcccagtattaagctacatctccgcagaagangtatttggagaagatggagcgcgaaagtgtccttacgtggcgcgggactggcaactcgatatttgtgaagtgatacgcttgcgttgagagacttactgtccagtngatgtttgatatatagtagcagaagaataagacagcgatgaaaggcagaactgcaagagtgaagagcgcggacgagcggggcgtcggggcgggcgggtcgcgcggaccgacacgcagacgtataagcggtggatgtaggagagggtgaacgtgggtggtgagaggcgggggtagggaggataaagcaccgaagggcacgacgcacgcgaggcacaccgatggctggatacacgtgtag

SEQ ID NO: 531157 - DNA, 519 bp, Homo sapiens
  misc_feature (64)..(64): n is a, c, g, or t
  misc_feature (96)..(96): n is a, c, g, or t
  misc_feature (102)..(102): n is a, c, g, or t
  misc_feature (133)..(133): n is a, c, g, or t
  misc_feature (161)..(161): n is a, c, g, or t
  misc_feature (234)..(234): n is a, c, g, or t
  misc_feature (267)..(267): n is a, c, g, or t
gtcccttaataacagttgcaaaaaagcgctgtccggtggattcccggattgtcgaccccggcgncgatgtttagtacttttttttacacctttccnaacatnataaggtaagggttaaaatttttaattgacnaattaatgatatgttatgggtacatggntagttttatacataatatttttttaaatgatcaaaataggctattaacatattctcaactcagacttactatnttttaaagtgtttaaaatgttgtggttacaggncgggcatggtggctcacgccctatgtcccagtactctggaggccgaggcgggtggatccctggggtcaagagtttgagaccagcctggccagcgtggtgaaaccccatattctactaaaaatgcaaaaattagccaggcaaggtggcgtgcacctgtcatcccaactacttgggagcctgaggcatgagaattgcttgaacccaggaagcagaagttgcagtgatcagagattgcaccactgcactccagcc

SEQ ID NO: 531158 - DNA, 179 bp, Homo sapiens
attgaacgcgctaacaattacccgacagtcatttctacttgcaaaagggatgcgtaagcaaagcgagtataattttcttgtcatggtatcatgcttgttaaattttaatgcagcatcttcagaaactgtgtccgtgatggtgtcttattgtgtcagcaccaaatatttgtgcacttagt

SEQ ID NO: 531159 - DNA, 214 bp, Homo sapiens
acgtagttctgaaaaaccgatatcactaacctttatgatttacaggggaagcttgaagaggaactttgctttctacacattagaatttcttttttctctttttttttttattggaaacggagtcccacccggccccctaggctgaaagtggcacaatctgggctcacgtgaacctcacacttcccaggttagaagcaatttcttgtgcctcagc

SEQ ID NO: 531160 - DNA, 427 bp, Homo sapiens
  misc_feature (5)..(5): n is a, c, g, or t
  misc_feature (390)..(390): n is a, c, g, or t
tgtgncctaggggcccaatagcccgaaacaaagtagtatcctaaagcccctctagacagcctggtcctgaaaatgatggagaacacctgtttccgcaaactttaatgtgagctgtttggaaactgagacccctgagcttgtcctctgatttatcgcccaccggtttttgcatgcaaggaccacttaagcaatgcttctccaactttcatatgccccaggaatcagctggaaatcttcttaaactgcagatttggattcactaggtggaagggtccgccagagcatttccatttcttataagggctcatgtgctgctgctgatccaggggtccactttaagaaggaaggctgttgagatgatgtgagaagaaagacgagaggcagaaaggnagagacagagataatgaatgaatgaatgaatgaatga

SEQ ID NO: 531161 - DNA, 1023 bp, Homo sapiens
  misc_feature (1)..(1): n is a, c, g, or t
  misc_feature (625)..(625): n is a, c, g, or t
nggcctcggtcttggcccgacgtgtgtcggacgaccgcgcgtttttgtggccccagcgacaggaagaaccccttcccgggtggggggtgccagccggagaggggaacaccaccagcgtggttgttattcttccaacacaccgatggggggagggcccaactcaagggaggggtttcacccgcgcttttttgacgccgccctctcccccgcaggctggaacctgtccttcctgcagatttgttagagcgactgatatagagtttcttctgtgggaccacgccctcacctgtggtggtgatcgatcacctctctaaagcagagccgcacagaccacaacacggtgggcgaccacggggcgctccggcgcagacggtgtggttcacatatttacttacaagggcgccccaccaccctggggcgacaacactcatacaaggaattttttttgtccgagcgggcctgcttcattcatacgccgcggttgctcagtagttttttttaatcaggatagtgagggaccaaccaacgcgcgggtgtgtggtgaggcagcacccgccgcgctgctatcgtatgtggggcgcgggggttggtgtttctaaacgacttgtttctcgcacacacggtntggccccccccctggggttcttctttcacataggagtgggggagggctgtgtcgtcaccaattgtgtgtggtgcggcgagtcagaacgtgttctcttcgatgatgggtgatcacgcgcccgcgtgaggcggggcgctggcttctttgtgatccctatcgtctgcccccgcgaattgttgacgcccggccccaccccgcagccacccaccccccggtcgtctttttcaacttatttgtgccgtggggacgggtcccccccacagaacccgccgaagttgttcccctctttgggagccccttacccttttttgaaaatttccctccccctggtggaagtttttttttttttgggtaaaaattttcttgaggttaaaaaaaaagggttttggcccccccca

SEQ ID NO: 531162 - DNA, 1284 bp, Homo sapiens
gctccacaacagcaagcgaccgatgagacttggttccactctttgcgtgctagcgcttggctatatgctggctcaaactcgtgaagatgtcctatacactagctgctgccgtgtgatgggagattcaaacgtccagtcatgggatggttggcaggtgtcacaaggcatttaagcctgatgtgaattgatagcagctacgggtcctgccaaatggacgtatgtaacattccactcatcgcttcagacccatcagtggagaaacctcatgagcactgacgcttcacaggtatacgttatgctccgttggctttccgtcttgtgaccttgggtctcaacccacctgcgggagaaggcgtgaggacccatcgatggcaatcctggctgcactggaggtttgtgtcacaagccattctcgcacgtttttgtccaatcacactgttctggatagttgtgtgcatatgcaggctctgggaactgttgcgtcgaaggcgtgcagacaactgctccaacatttgtatgtcgaacatctttttgacgtccataatgacgacaaggatggtaatgacccaagatccctgaaggaaacacgagaatgacaaggacacagaaggacgcccctgctgacatgggagcacatcagggagtggctgtctctggggattgctccttatcgctataggggcgaggacgattgctgcaacagatggcattacgaaacctttggcccaccttgctgcagaatactggtggagcctacactccgagagcgtgctgtaaccttatcagcactggcccctcatctctgtttccaaatcccctactcaatcgatcctggataactctaaggcagatttcactcattgatgctgattccagaacatttcctatataactcccattttttgccatgggctttgggtgggcaggtggtaaccaaatacttgcccgtccttgggttgcaagttgctgcgcccagttagctcaataatcatgccaatgggacccaaaaacccctctttcctgggctgcccctaggccccagggggcctgtaccccgtgttcagtggaactgggcccccttaacccatctgtccctatacgccaggcagacgggccgcttttaagccacgtggctcgtgtcctgtactgtctcccatggtgctggctcttaccttggctgttccgcgcgtgattcccaggcacccccatttttttttgattgcctgtctgttgtcactccgccctaatgttcgctctcttcttcggctccctcgcacgcactct

SEQ ID NO: 531163 - DNA, 150 bp, Homo sapiens
atgcactaaacctggacatacattctagctcttcctgaatctttgcttagcagtcctactgtagtgatagttctggctttgggcctaagggtttattaatgattaccgctgtagtgccagtgccaagttttggcaaagagtccttatttg

SEQ ID NO: 531164 - DNA, 876 bp, Homo sapiens
  misc_feature (32)..(32): n is a, c, g, or t
  misc_feature (67)..(67): n is a, c, g, or t
  misc_feature (75)..(75): n is a, c, g, or t
  misc_feature (157)..(158): n is a, c, g, or t
  misc_feature (160)..(161): n is a, c, g, or t
  misc_feature (163)..(166): n is a, c, g, or t
  misc_feature (198)..(198): n is a, c, g, or t
  misc_feature (220)..(220): n is a, c, g, or t
  misc_feature (222)..(223): n is a, c, g, or t
  misc_feature (228)..(228): n is a, c, g, or t
  misc_feature (334)..(334): n is a, c, g, or t
  misc_feature (338)..(339): n is a, c, g, or t
  misc_feature (382)..(383): n is a, c, g, or t
  misc_feature (523)..(523): n is a, c, g, or t
  misc_feature (699)..(699): n is a, c, g, or t
  misc_feature (724)..(724): n is a, c, g, or t
  misc_feature (801)..(801): n is a, c, g, or t
  misc_feature (803)..(804): n is a, c, g, or t
  misc_feature (806)..(806): n is a, c, g, or t
  misc_feature (838)..(838): n is a, c, g, or t
ggctggctcctgtttttgggcaggaggccagnatggggacacaggagatatcaggcaggagtcaggnagggggangaggggacacgggttggggtgacagacaaggtagtgcaagggcagaggcttctagctggaagtcctggacccgcagcataannanngnnnngttcgggggggggctcatataaagcgggagancctgggccccgacacaggtggngnnggggngggggcgcgggttgacgaggataaaaccggctcttaggaccgtggcttctgtcctgggtctcagggcacacgcgcgcacacatatacaacacaagatgcttctggnatgnngggcagggtcccagagaccccaccctcattcaagctaaaaatnnggaggggctgagcaggggctgggaccaagacccatgttttaccagtggggcgagtttttttggtttttctctccaaaagggaaatttaaaaatctacaacaaatcacaccaaattcattaaaagtgataaaaacccagcntccccctcctcacttgagcttcagaccgggccagaaaagctcaacgatgaagaaacaggaacatgcccaggtcaggtctccccacccaaacacaagtcccggagtgggaagcttggagctgggatggcatgggcagccccagccgccagcgtctgttgactgccaagagctgcgtnttgtgggggcagagtgagagagacnaccccaagcgaaaaaggtttccgaggacaaattctaaaaatatgaaagatattttagccgaagtatcggagggcttnanngntgggcgaggtggcagcggggtctccgcggggncgaaatcagctgtgctgctccaggtaaaaaaaaaagag

SEQ ID NO: 531165 - DNA, 899 bp, Homo sapiens
tcttttgctttagacttagataccatgtagtggtctgtgtgctacaggaagctggttctgtcctgcttccacacgtctgcttcaaaaacactgtcctgacttcgctgaactactagagaccaagtttaccacttctgatgaacgcagaccaattaagattcattccctcattcctgctttcctttccagctgcggcacgaacgagtccccaatgaacataacgatgcaaacctgccttccaatgacacctagctaccaatgctacgcggctcttctcaacattgctgccaacagccctatacgcaaacttacgctcagcgcaacaactattggaatcctctcataccgatcccaaagcacacacaggcaatgtgctcctagacccagcgacccatacagccctatctccgatcccccctctgccaccctctacgaaccctctgacaagctccagcactaaactcccgttctacaacacggcgccattctcactatacgactttacagcccacgcaacccgtaataccccaccccaaaagcaccttctcgcaacatatctctaacgacgcacatttaactgccttaaggacccaattggcacatcaataaccccacatctcaccatgcgccacactttctcaccacaggcaccttgggcaccattatacaggcgcgatacctaccggttacgctactcccacgcatcaccggtcttcaacactccactcctcctcactttggttcccttcaaattgcaaaccgctctagacacccccactcccctaaccataccaaccccggcgggacgacgaaacaacgcgggcaccacagtactaataggatcctttcatcccttaaagtggccttcgaccaaccgtctaccacaacactccctctcc

SEQ ID NO: 531166 - DNA, 419 bp, Homo sapiens
  misc_feature (52)..(52): n is a, c, g, or t
  misc_feature (57)..(57): n is a, c, g, or t
  misc_feature (70)..(70): n is a, c, g, or t
  misc_feature (73)..(73): n is a, c, g, or t
  misc_feature (89)..(89): n is a, c, g, or t
  misc_feature (91)..(91): n is a, c, g, or t
  misc_feature (219)..(219): n is a, c, g, or t
  misc_feature (247)..(247): n is a, c, g, or t
  misc_feature (276)..(276): n is a, c, g, or t
  misc_feature (279)..(279): n is a, c, g, or t
  misc_feature (295)..(295): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (318)..(318): n is a, c, g, or t
aagcgcaggtatacaactttactttcctattactcttatgttatgctcaggnacatnttctagaaaaccnacnaaggttactgacgaananatatacattctttattctcccccatcatggagcacttttctgcacttgggtactgagtaaaaactttacacaaatgggatttggcctggatcctaaaaggcatgcagaatttggatactaaaaaccanatctactttctccctaaaatctttccangcttgtgtcactgacagtttccttgtaantcntaaagcccttccattntctcttcttttcanananttaanatctgtgcttttttttttcttttttttttggagacagagtctcactctgtcgccaggctggagtgcagtggcgcgatctggctcattgcaaccacggtaaa

SEQ ID NO: 531167 - DNA, 857 bp, Homo sapiens
gactgacagaatatttggtggggcagtcctgattaaaactaagactggctggtggtaaatgaatatgtccagttttgaatttaatagtaactccaatacagtaaatggtatcactgttaacccctttaaagatatgataagacttcgtaagtaatgtcaattttcacaaagatggtgagtgccatcttaaaatcttactgagatgagttaatattagattaatataactgttatgtgaatatatttaaatactgggaaatggcttcatgtcttagaaccaagcaagattcacctgtgttttgtgtcatgtccattgtgcctcttaagggcaggggttgaagataaatacggtagcaatgtctatagttgtgccttaatatgccaatctaattataatcccctgtatttaaaatggtttcttttacttatggaaaggcattaagtgtggtaatgtgtatattaaagattattcaacactctcaatttacagatctataggtcacatgcttttaacactagtagcatgtaaacttcatctgtgaattcttaccaatctagtcaactaagtaatacattaggattgttttacacagcatcagaagcaaatgtgaactggtattggatggaatgggtgttggcaactaacaggataagatagggggtattaacaattcacattttggtggtcagattagggtattaaagaaagaaaagagaaaatgtgggggtggtgaagtttaaaaatgtgggcggccagagaaagagtgaatgtcaagaacgacgggtgggtcaacaaaaccggagggtgacaggtggttgtaagcgccacacgggagggagaaggagagagagaaaga

SEQ ID NO: 531168 - DNA, 1510 bp, Homo sapiens
  misc_feature (119)..(119): n is a, c, g, or t
  misc_feature (1068)..(1068): n is a, c, g, or t
  misc_feature (1293)..(1293): n is a, c, g, or t
gcccaggtgtgcactctccatccagctgtgcgctctcgtagggagtcccagccatgtccgatgagagagaggtagccgatggagcgaccggggaagacgcctcttcgtccgccttctcnataaacctgaggtcatgcgtaggcgcacccccagacatcccgtcggttctccgtaagggggccgtgcgttcgaccgtgctgtcctcgtcactgactactgactgcagtctgccatatttgcatcaccggcgtttgagaggtcgtacaaacggaggtgcatatgctgctcgagtcgcgagcactggccagtcgaccccccgtgtcccacgtgaggcgccgagtcacgtctgaacagactgacggttcgtgcgcggagccctgtcgggggctcagacttcgtcagaggctcttggcctgagggctcggggcgctgatacagaggcagtacatcgccggcgcgtcttgcactttgtgccaacctgcccgggtggcgactgagaggagcggccgtccgagtctagttctggctttgaattccgcccaatgctgggcgtcgaaccgggcgcaccgctcaatgttggaaccgctggcaataggggctagttggaagaaaccccagtgggattggacatggtgcatggtatcgaaacaccacggggcttccaagggggaatttgtattgggacgacgaggcaaagggccagtcgctggtaaacttaggttagacccccaattacggtgggctcctctaaggaaacactgctctccctgtgtgaactacacgttgtacagaggtccccaagtggaaacacatattctttgtccgcggcaaaaagtccggtggcggttgacaccgtgtaggctttctcaagttggtcaaccacaattctaaacgatatctcaactgaaggcccccttctaccccaaatgtgcgcctcacccctcccattgtaatggagcacttttccgtgggcgggaaagtagccgctgtacacccaatgtgcgccccgttgtgggaccccaaccctttgggtcggggtccgttttggcagttttgaagccaccctgntttgtggggcgttcggtcccattcgggcgctgggactggcttagtgtcggagatttacctccgcggttggttcgctcctgtgatgcctaggcgctgtgcggtttgggccccagagatgagcgcactgtgtggggcagtggtcacaacttggttggccaccatcgccccggtttacaggggcgatataggacagagagcaggccagtaccagacgcgccttcaagncattgggtgaccagttgggagcgccgttattacctggtataagttgcgcccgacaaaactgtggcgcccggataaccacggaatggcatttcacgcctagggtttggagaactcattttgagaccccctggacccctcgtatctcttagcacgagatcgaggacctttggcgccattcacattcgtatagagatagttattcactccgcagtgaaaa

SEQ ID NO: 531169 - DNA, 202 bp, Homo sapiens
gggtgacgagatctggaagtgcgcttcggctatacggcatcgtcttcgcctccgacatcgagggcgcggatttcgccttgaccccggccgatgtatggtccgccctggccgcgcaaaccgtgcaggacggcgccctggccgccaatgccgccaagacctgggccgatgtgaatgccgagctgcccgcgcagcgactggggca

SEQ ID NO: 531170 - DNA, 197 bp, Homo sapiens
tacacaatgatacgagcgcataagtactgaatggcatccgtcctaccggatacctaggaaacggcgccaatgctcatctttgtgtgcttgcagtccaacgtgtgatgagcctcatgtatgtcaacgttgcgtggaggcccgtttggtgctgaacatgcaaatcaacctatattaaggttgatgacaacaacgaaact

SEQ ID NO: 531171 - DNA, 238 bp, Homo sapiens
ctggcaggacccagtgaagacaccaagggcttctttgaccccaaaactgcactgagaacctcacgtaactgcagctactggagcgctgcgtgtgaggaccccagagatgggcctgtgccgttctgccactcacggtataaggctgccaatggcggggagcttggtctacactgactccgaggcccggtgacgtctttgagaagtgccaccgtgtcttgcgcctgttaggccgatctga

SEQ ID NO: 531172 - DNA, 341 bp, Homo sapiens
  misc_feature (179)..(179): n is a, c, g, or t
ggcccccccccccccaagggccttgttggggaaccttcccccccccccctgggggccgcccgggggcccccctgggcctccggttttttttccccccgccgggccggtcctggggccctgggctgggggctgtttcccccgggtttttgtggccccccccccgggggggcttttctttntccaaccagggaaaaacaagggggccaggggccccctttttttgggccgttttttttggccccccccccccccccccgggtttttttttttgttttcccgggtccgggcggggggcccgttcccggttttttttttgccgggggatttatggccccttggga

SEQ ID NO: 531173 - DNA, 206 bp, Homo sapiens
tagccggtacctcaaaaaaaaaaaatagtcgggcatggtgggtgcacacctggtaatcccaggtagctggccactacaggtgctggcaccaccacgcccgggctaattttggtatttttagtagagacaggtttcaccatattagccaggggggtctggaactccggacctggtgatccacccgcctcggcctcccaaagggcggg

SEQ ID NO: 531174 - DNA, 208 bp, Homo sapiens
cttagaggatcttccccgactagcccgacaggctctacctctgaccccagcttctctctggttcccacaggccccatgcatcctccctgacccgtcctccagccctaactcctccctgaccagtcctcctgccctaagtctcctccctgactggtcctcctgccctaagtctcctccctgactggtcctcctgtcgggctagtcgggg

SEQ ID NO: 531175 - DNA, 278 bp, Homo sapiens
ctttatggggtgatgggtcctcaccccccttttagtttttttctggtcgtgggtttcagtgctgtttggggatgatttaagatatcccccgtggttatgtcagctaaagggcctggggaatatccgcttttggtttattttcttccatagggcgccttgaaatatggagtgtttcctctcagggaagccagtggatcccctggggttgagaggatttttttagtttactcttattttaaaaaggtaacctcttgaaacattaaaattgtaaacgccca

SEQ ID NO: 531176 - DNA, 224 bp, Homo sapiens
  misc_feature (5)..(5): n is a, c, g, or t
  misc_feature (12)..(12): n is a, c, g, or t
  misc_feature (50)..(50): n is a, c, g, or t
  misc_feature (109)..(109): n is a, c, g, or t
  misc_feature (151)..(151): n is a, c, g, or t
  misc_feature (202)..(202): n is a, c, g, or t
gcctnctgtacntcggcccagcaggccatatgaggggtcaggcctgcagnactcacacttggcacctgctccaaaaccctttcaggtctttgaggatctgagccctggnctgggtctcccgccggctcggaaaagctggcctgccgggcanagcagagaaccacacgattcagaaaagcagtgccttcagcagcctctccancgtctgggctccccaaaggcag

SEQ ID NO: 531177 - DNA, 289 bp, Homo sapiens
gcccataccacggtcattcattaactcgtgatgagaaatctagatcgactaagaagaatgagagatagttgtcactcggaaaaatatctggagaggaagaatggaggattggcattgagatccatgtggacaagctaagtggtctctgtctaaaagctgtcattcatccacaacattaaaaaaatatcaaaatgcgaggggctgtaaattaaaaagaccacacagaatatactgctctcataaagatctgattgccttggcacaggccctgtggccacacattatggag

SEQ ID NO: 531178 - DNA, 235 bp, Homo sapiens
  misc_feature (34)..(34): n is a, c, g, or t
  misc_feature (67)..(67): n is a, c, g, or t
  misc_feature (69)..(69): n is a, c, g, or t
  misc_feature (94)..(95): n is a, c, g, or t
  misc_feature (143)..(144): n is a, c, g, or t
  misc_feature (160)..(160): n is a, c, g, or t
  misc_feature (172)..(172): n is a, c, g, or t
  misc_feature (182)..(182): n is a, c, g, or t
  misc_feature (186)..(186): n is a, c, g, or t
aagaaaattatttctaaataatatgatgtttaanataagcacttgaagttaggggaacatgaagatnangaaatgggggttttgaggagataanncttgtgaacaaatgtactccagcagccaggtatcccagatttcctgtnntggagggtgctggggnccctggatcccnaagagtgagnaggnagatccccagagccctagctcatccatttatccattcctcataatccag

SEQ ID NO: 531179 - DNA, 365 bp, Homo sapiens
tgccgtcgagcactactggaggagactgctgtggcagagacttccatgaaatggattcgccttggctcagtgatctcctggttcttgtgagacttgcaaaagtcctagatgttggcgtcgatgtctgtaagataggttgggctggcttgtcgtgtgtggcagtgctgagtggtataatcatgcaaggttatggattcttgtgatgcttgtgatgctgtggattctttggaaagtactgtgggagcttgtttcctctgtgtggagtgtgaccagttcacttgctgatgaataccccaaatcaccacctccaccatcctggttcatctgatccatgtattccagagagcttggcactccaatgggct

SEQ ID NO: 531180 - DNA, 116 bp, Homo sapiens
gtcgcatctcagcaggcacccctgtcatgttcttcttgcatcatgcatgtcaccagcatcaaccatcactttggtgtgtcatcactgccagaaatgcaatcaacgttcacattcaa

SEQ ID NO: 531181 - DNA, 426 bp, Homo sapiens
  misc_feature (18)..(18): n is a, c, g, or t
  misc_feature (36)..(36): n is a, c, g, or t
  misc_feature (43)..(43): n is a, c, g, or t
  misc_feature (88)..(88): n is a, c, g, or t
  misc_feature (278)..(278): n is a, c, g, or t
cggccctaataaaacttnccgggctccctaaaactnaccccangtgtggccccatgccggttaaaccaccttgacggaagaagatganggaaccccgggaatatttaccccccaagaacagtgatggccgccttcaccaagcattggcaactcctaccttcccccggcttccctgatccctgccctcagcttctccctctcccacagagaagaaaaaattcctgccctaaagtctgcaacatcgtttcctgcctgagtttcagcctgcccagcttccnctacggattctggacttgccagccccacaatcatgcatcgtcacaggtgtgaagtggtatctcattgtggatttgatttcgattttgcagatggctgatgatgtcaagcaacccttgatgtgcttattggccatttgtatatctcctt

SEQ ID NO: 531182 - DNA, 452 bp, Homo sapiens
ggaattcccgggtcgactactactactaaattcgcggccgctcgacaaaaatataaaaatcagccagacgtggtggcacgcacctgtagtcccagctactcgggaggctgaggcaggagaatcagttgaacccaggaggcagaggttgcagcgagccgagatcatgccactgcgctccagcctgggcgacagaacaagattctgtctcagaaaaaaaaaaaaaattagcctggcatggtggcgtgtgcctgtaatcccagctactagggaggctgaggcaggagaatttcttgaacccaggagacggaggttgcagtgggccgagatcaagcaactggggtcaaggctggcccgaacaaggctggggtcactgggttaccccaaccatgtccggccaaaatgggactacccagtggtagtgaaccatctaattaaaaccaaaactcccccag

SEQ ID NO: 531183 - DNA, 1644 bp, Homo sapiens
tggaccttggacacctgctagtgaagagccttgtgacccttccagttgcgtaaagccaacctagcccgtgatctctgtgcttcagacgccagtggggcagtggcagccctggggccctttcccttctgtgaggaagcacaagcctcagggcacaggtgtgcagccaggcatgcggcagggccaacagcccgaggacctctcacttgcaaccagttactcactgggagcaggcttgtgtttgcaactcaaggcacaacacctgtacaatcagtgtaccgcatgccctgaactcccaggacttacgacaacaacacctatagagcacgcgcgaccccctttacacacacatatataccaaccgacagacaagtgacagtacgcttaggcactgggtggacacgtggtacacaagcaccccagcccttgggactacgggtaggatagtagacacacaatgaaatgggagcacctctacggaaggaacatgtgagtgccatacatcacaggtaacacggactataaaattccattggccattgggcattctcagagccatggctgaccgcaacgcatgggaatatcatcggaatcccatacaatggaattccccattatccatggggcgaaacatccgtggattatacacccaccacattacaccgttatgtacagaggccgtggctgaatacacccatacaacgacgaaggataatcccatatgtgcccacaagtgcaatttacgcgattctcaggatatatagataacacaagataggccccacgaatatgggacaccatccataaggaccttattatagacccccttatgtgagaagggtaacgccacccaccagaatgtgacgaatagcacatgtgacgtacccacatggaaccggggtatatacaacacgttagacacactgggacccacaacggacgaccatggacacagttccaacccttgcctatatcacaattccatccacgacaaggccacagtacaccttgtacccaacgattatagcgagcaccccccagtacaaagcaagccacatagggcaatgcgagatccaaagacacaagtggaacgaagaaccaacaggggccaagcgcaagacacacgagcacgacgtgccacacggggaaacgaaaacgccgacgattggaggaagccacaaagaagcacaaggggcaagaagccacacacaaacaccgtcagatgcgcatatacacacagcaatgggaccagtccaccagacgacacaccacaagcgagtaaacgcacccgattacgagcacccccaccaacatcagagagccaccgcaaccgaaacacatgagacgaaaacgtcccacagcacagatcagaacaaggatcacacaacaagagcacaacgaaaccacagggtggcacacacaaaagagacaatagaaacgcaccccatgcggaccacatacaccaacacaccagacaaacacacaaaactggcaccacacaccaacaacagacggaggccacaacaagacgcgacaaacgaactacagacacaaagagcacacgacaaaacacacagaaaccaaaacgcaacacgaggagcccacgaaacaaaagacccgagagagcaaaaacacaagcccaccaca

SEQ ID NO: 531184 - DNA, 894 bp, Homo sapiens
gcttatttaggattttctcggtcaatctgttcattcctggtgatttcaaccactggtggctgaacagtcttcaacaggggaaagttcaactgtatcgattttcaaggtgggagctgttcgatcccgttcgcttctaatgatcagcgaatgactgcataattagaaaaacctagctgccgtgttccccaggtaacaagtggcttagcttcaaggaaaacttagcgctttgctcagaatccatgattccttcccagctggtctgctactgatgggcttatcccgcatggaggcaggagcgtgtctggccctggagtactggaactgttctgagtgaacaactgagaccacgttacatgataccttatgcttcatggttccgtgttgagcttgcccgtctccgaatatccagccagtagatgtcacattgcctcggcctagtcttcagcctaatcagttatccatatagtgattttctgagtgtgctcagggtataaggcgttccaagttcagccgtcagtctatttctagaccattcatcgccatcgttaaatttctttagcttcctggttcttaataatatgcacaggctttaccatttccgtgtcagtaaataaacctagaggcctcttatatagatgtattctcctcttctgtaagctcacgctagaggccatcaggttgctcatgtccgttgtcaccatgagtactactcacgagttcagtttcgtatgagtggtgatcacctgattgtttttcacaatgatatttcttgacgggaatgggtgggagtgtctggtgtaaagagcgctgtaaatgtggttgtatgagccaatcatatttgtgattttgtaaaaaaagctttacaaggagatatctgcttctgaaccccactta

SEQ ID NO: 531185 - DNA, 408 bp, Homo sapiens
agccttaacaccgcatctgagaggtccgggtgactttatgtgatttaaaagttaattaaactgagtggtatgaagtataacagccccaggtgtttatttccaaagagactttggaaggaaaaggggagaaatctaataaaaagctttgcgagatactgcattaggaagtaatcataccgctaaatcacccggtgtcggcacaggccttgtaatgactccggacttgctgttcccctgcctcctgagcccacccagccaagaacgccctgctgggaccctcgggctgccctctaaggccaggagagccaacaaatgagactctgagagccgcacgtgctgagcctggaaagggcgcctccgaggacgggccgctgtccctggagcccctgtctgagattgcggtgttag

SEQ ID NO: 531186 - DNA, 147 bp, Homo sapiens
  misc_feature (93)..(93): n is a, c, g, or t
aaaggggcccattttctgacccacttactcaggacctcactcactagccccgcttggggccccctcctgtgacctcagggtttgccccatggngccctcccaggcccctgccccaactgattctgcccagataatcgtgtctcctgc

SEQ ID NO: 531187 - DNA, 883 bp, Homo sapiens
  misc_feature (53)..(53): n is a, c, g, or t
  misc_feature (92)..(92): n is a, c, g, or t
  misc_feature (306)..(306): n is a, c, g, or t
  misc_feature (428)..(428): n is a, c, g, or t
  misc_feature (451)..(451): n is a, c, g, or t
  misc_feature (543)..(543): n is a, c, g, or t
  misc_feature (549)..(549): n is a, c, g, or t
  misc_feature (555)..(555): n is a, c, g, or t
  misc_feature (563)..(563): n is a, c, g, or t
  misc_feature (565)..(565): n is a, c, g, or t
  misc_feature (573)..(573): n is a, c, g, or t
  misc_feature (579)..(579): n is a, c, g, or t
  misc_feature (615)..(615): n is a, c, g, or t
  misc_feature (652)..(652): n is a, c, g, or t
  misc_feature (682)..(682): n is a, c, g, or t
gcgctccaggcgacagcatgcagacgccattatcctctgtttctctgctgcancgacctcgacgtcttgcctgtgtcccacttgttcgcggnctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttanaagatctagaaacactgatgagatggttgaattacgcattctgcttcagagcaagaatgctggggcagtgattggaaaaggaggcaagaatattaaggctctccgtacagactacaatgccnagtgtttcagtcccagacagcangtggccccgagcgcatattgagtatcagtgctgatattgaaacaattggagaaattctgaagaaaatcatccctaccttggaagagggctgnagttgncatcanccactggnancagccagntcccgntcgaatctgatgctgtggaatgcttaaattacagantataaaggaagtgactttgactgcgagttgaggctgntgattcatcagagtctagcaggaggaattntggggtccacaggtgctaaaatcgaaagaacttcgagagaacactcatacaagcatcaagctttgccaggaatggttgtcctcattcccactgacagagttgtccttattgaggaaaaccggaaggttggagagtgcatcagagatcatcctgatcttatatcttgagtctcccgataaaggacgtgcccagcttatgatc

SEQ ID NO: 531188 - DNA, 336 bp, Homo sapiens
  misc_feature (2)..(2): n is a, c, g, or t
  misc_feature (6)..(6): n is a, c, g, or t
  misc_feature (11)..(11): n is a, c, g, or t
  misc_feature (18)..(18): n is a, c, g, or t
  misc_feature (26)..(26): n is a, c, g, or t
  misc_feature (40)..(41): n is a, c, g, or t
  misc_feature (53)..(53): n is a, c, g, or t
  misc_feature (59)..(59): n is a, c, g, or t
  misc_feature (92)..(92): n is a, c, g, or t
  misc_feature (95)..(95): n is a, c, g, or t
  misc_feature (101)..(101): n is a, c, g, or t
  misc_feature (103)..(103): n is a, c, g, or t
  misc_feature (116)..(118): n is a, c, g, or t
  misc_feature (120)..(120): n is a, c, g, or t
  misc_feature (163)..(163): n is a, c, g, or t
  misc_feature (169)..(169): n is a, c, g, or t
  misc_feature (172)..(172): n is a, c, g, or t
  misc_feature (174)..(174): n is a, c, g, or t
  misc_feature (203)..(204): n is a, c, g, or t
  misc_feature (207)..(207): n is a, c, g, or t
  misc_feature (215)..(215): n is a, c, g, or t
  misc_feature (229)..(229): n is a, c, g, or t
  misc_feature (259)..(259): n is a, c, g, or t
  misc_feature (318)..(318): n is a, c, g, or t
gntgcngaggnggaggcngaggcagnggcgagggcgcccnngccggaagaagnggacgncttcaccgccccacactggcggaggaagcagcnggnggggcncnacggcgacaagcnnncnaaaaccaaggggtccaacaacaacgagggccgggcgcggcggnagtcgntgnangcgacgggcaaggagggcaaaaggcatgnnttnatttgaanaggaagataggttngtggtgtttgcgttgaacaactgcagcctntaccattttattaagtgttactagtgtgtgtacatagtaatactgtcttccgtatgtangtgcggtgtatgcgcgtg

SEQ ID NO: 531189 - DNA, 945 bp, Homo sapiens
  misc_feature (53)..(53): n is a, c, g, or t
  misc_feature (92)..(92): n is a, c, g, or t
  misc_feature (306)..(306): n is a, c, g, or t
  misc_feature (428)..(428): n is a, c, g, or t
  misc_feature (451)..(451): n is a, c, g, or t
gcgctccaggcgacagcatgcagacgccattatcctctgtttctctgctgcancgacctcgacgtcttgcctgtgtcccacttgttcgcggnctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttanaagatctagaaacactgatgagatggttgaattacgcattctgcttcagagcaagaatgctggggcagtgattggaaaaggaggcaagaatattaaggctctccgtacagactacaatgccnagtgtttcagtcccagacagcangtggccccgagcgcatattgagtatcagtgctgatattgaaacaattggagaaattctgaagaaaatcatccctaccttggaacgagtaccaacactactaaaggaagctgactttgacctgcgagcttgaaggctgttgacttcaatcacgacgtctagcacggacggacacttactttcggggtgttccaaagaaggggtgggccttaaaagagaagtccaaacaacggaaaacgtttcccggacggagaagcagcttcaaataccacgcaatccaaacgccttttatgtccgcccaaggcggaaaaaacttggccgttggatccccattcgaaattgtccccagcagtgagaccccagggaagccctctgggtatgtccgttgataacattgtggggaaaggcgggaaaaataaaaaccccccgcaaccttaccgggcgccttccggccttcacggaaacgggtttggggccgatctttaaaacacacggg

SEQ ID NO: 531190 - DNA, 155 bp, Homo sapiens
atccaaagaattcggcacgaggtgcctctccaccctcggggatttttacctggacacggaccatttagacctttaggttcacttttgcccaaaaaagtactttatttcttggtaacccattaacaaccccaaacccattggttcccaaggaatta

SEQ ID NO: 531191 - DNA, 184 bp, Homo sapiens
aggacagatcccacagtgagccaatgttaagagatctgatggcattatgaggaagagtcttaaaggcaaattttacaaaaagaacttctagaatcttgaaatcgacctgactgaggaacacacattgatgtcagacttctttgtggacattgtttaatctggttttgcagtgccaggaacaatt

SEQ ID NO: 531192 - DNA, 229 bp, Homo sapiens
attgagcccctgtgatgcccactttcacttccaccagatccggctgcagagcttcccggggcactcgggggccgtcaagtgcgtggacccctaagcagcgaggacttcttcctgagcggcagccaggatcgtaccgtgcgcctctggccgctgtacaactacggcgacgggaccagcgagacgggcccacgcctctgtctacagccccagcaccgcaaagagccgtctt

SEQ ID NO: 531193 - DNA, 322 bp, Homo sapiens
tctttcagttttcatttttttttattttaaatattttatagagatggggtctcactgtgttgcccagcctggtctcaaactttcgacctcaagcaatcctcctgcctcagcctcctgaatagccaggattacaggcgtgagccaccacatctggcctcttccagcttcctgagacattcaaaattattacatcagaaaggctgggcgtggtcgtcacgcctataatcccagcactttgggaggctgaggccggtggatcacgaggtcaggagatcgagaccatcctggctaacaaggtgaaaccctgtctctactaaaaaca

SEQ ID NO: 531194 - DNA, 884 bp, Homo sapiens
  misc_feature (2)..(2): n is a, c, g, or t
  misc_feature (86)..(86): n is a, c, g, or t
  misc_feature (100)..(100): n is a, c, g, or t
  misc_feature (184)..(184): n is a, c, g, or t
  misc_feature (192)..(192): n is a, c, g, or t
  misc_feature (221)..(221): n is a, c, g, or t
  misc_feature (226)..(226): n is a, c, g, or t
  misc_feature (264)..(264): n is a, c, g, or t
  misc_feature (323)..(323): n is a, c, g, or t
  misc_feature (362)..(363): n is a, c, g, or t
  misc_feature (371)..(371): n is a, c, g, or t
  misc_feature (375)..(375): n is a, c, g, or t
  misc_feature (382)..(384): n is a, c, g, or t
  misc_feature (387)..(387): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (424)..(424): n is a, c, g, or t
  misc_feature (427)..(427): n is a, c, g, or t
  misc_feature (436)..(436): n is a, c, g, or t
  misc_feature (457)..(457): n is a, c, g, or t
  misc_feature (463)..(463): n is a, c, g, or t
  misc_feature (472)..(473): n is a, c, g, or t
  misc_feature (475)..(475): n is a, c, g, or t
  misc_feature (477)..(477): n is a, c, g, or t
  misc_feature (479)..(479): n is a, c, g, or t
  misc_feature (488)..(488): n is a, c, g, or t
  misc_feature (497)..(498): n is a, c, g, or t
  misc_feature (500)..(500): n is a, c, g, or t
  misc_feature (513)..(513): n is a, c, g, or t
  misc_feature (518)..(518): n is a, c, g, or t
  misc_feature (523)..(523): n is a, c, g, or t
  misc_feature (529)..(529): n is a, c, g, or t
  misc_feature (549)..(549): n is a, c, g, or t
  misc_feature (552)..(552): n is a, c, g, or t
  misc_feature (562)..(562): n is a, c, g, or t
  misc_feature (578)..(579): n is a, c, g, or t
  misc_feature (620)..(620): n is a, c, g, or t
  misc_feature (676)..(676): n is a, c, g, or t
  misc_feature (686)..(686): n is a, c, g, or t
  misc_feature (879)..(879): n is a, c, g, or t
tnaacacctcccaacatcaccacacctacctttcattatctcatcaacacttttacctttccctacacatctacatcaaatctcantcctccaatatacnactcaaccctcctccttcaaactacctcaaaaactactctctcttatttcattttccattttctacccactatttttccatccnctttaaanacacacccaccacccttccaacaccacanatccnattacttacatacaatatcatcacaactctttcatcanatacaaattcacataccacaactcattaacatactacaactctttactctctacaaaanataaacttacactcaataaataaacacctttctatatcnnctcatctntccnctataannnctnctcacnatntatatntccctatacatatatatataantcnccatctccnacactataaatatactatatncttacntatttcccnncncncnccattctcnccccccccnncncttttctacattnccatntatcncccacnccccctctcccctcacctcnccncacccacccntcctctccccattccnnccctacacccaccaccacactcccccctctccatccatccntctctcacactctctcccctcataaaatccattcttctcccactctcccacctaanatttcccatntcttctcctcatctctcctctcccttccctaaactctctaccactctctacacttctattccccacccctccttccattttttcatcttcctcacatccacacccttccacccatcatacctactcatcccctcccaaaccatccaatcatcctcttcacaaccccccatcacatccaaattatccaccaccncctcc

SEQ ID NO: 531195 - DNA, 1037 bp, Homo sapiens
ggttgaaccgctaaccagagcaggagacaagctgtggagcatctattctgctgaaatttagtccatgcttctcgaacctgggaatactgtgcagagggggctgggcgttcagtgctacaagacttcatcctcgcaccccgttaggagcatgaactgcgcaagcgcagtccatgagccgccaggtgctctgtgggtctcgctgaggtggtacctcaggtcctccgcagggtgtcggatgtggcgaccgaggcagcgacgctgggactgatgctcctggaggctgtgtggctggggactcctgggccctgtgagcccctagagcgggcagtgctcgcagtgaaatgtgcatgaggatagtgatcgaggggaacaccgtttgccccacgtctggctgtgacctcggtgaaagccgacaggagagcacgatgggaccctcctcctcagtagtggctgccaggtccctcgttgcatggacagggtcatcataaccatagataacccttcacgtgtcacctgcagcttccactctttatttccaaagaatcagtgtcacacatgcagatcacaaagcgggtctccctgtgctgcttccttctgtgtattctagtctctcccccaggggctgcccagggccctcaggaactgagtgtgggcaagacactgctgggcagagggcacgagcccacgtgggccgtatttgccaggcatttggcagtgcagagcccccgcagctccagaggaggcccttggcatgagctctcccctcagggtcctgagcaacgtcctgcagggctggtgggtggcacgggggggaaaaactcgtgaagccctgggaaagttgagcgttgcagtgcgagacagttcgtcagagcagcctcacgggacgggtaaaagcacgtagggggccagaccctccaagggctcccgtaccgagagtagaaggccagagcacgctgacccgagtcatacagcgtaaggccagcacacgaaagggggccccccggccagacagcggcggtcacgcaagcgcgcgtggt

SEQ ID NO: 531196 - DNA, 115 bp, Homo sapiens
tgtcatagctgttccagagtatcccgagcgacttgaaacgtcagacagaggttgcagtgatgtcgagactgggccactgcattccagcctggatgagagagcaagactctgtctc

SEQ ID NO: 531197 - DNA, 139 bp, Homo sapiens
gtcgacaagccttcctcaggccagccgtatagctagaaccttgttgtattctaggacaataccatatactcctctatctgtctatctatctatctatctatctgtctatctatctaatataaattaaccagacatggtg

SEQ ID NO: 531198 - DNA, 221 bp, Homo sapiens
atgaagaggaaaacaggtgagagcttgctttagttcctgatattattgttctcttccccattcccacctcagtccctaaaactacaaaaaaattagccagccgtggtggcgggcgcctgatagtcccagttactcaggaggctgaggaggagaatggcatgaatctgagaggcggattgcagttagccgagatcgtccattcactccagcctggcgacaga

SEQ ID NO: 531199 - DNA, 685 bp, Homo sapiens
  misc_feature (669)..(669): n is a, c, g, or t
tattaccattcctcgcgtcggacacccgactccagcatgctgcctgtggtgacgtgtgcggtgttcacgctcgcgtcctgtcagcatgtgcgaggtgctccatgttggagcgctgaggttcccgggctctgtagctgagtgggcggggcaccgtgtggagtatgcctgagaagaaggcgcgcagagtaacgtctcaacctgagccccgcagtcgtgctccagcaagctggaagtcagacgtgtgctactcaagtcaggagattgggcacgacaaatctgaacttccggcagtagcacttcgtgaatctgatatccaatagctcttctgctctaaggaactctgatttgcatctaatataacttgtcatgaaggggactccttcaaaagagttttctcaggaggtgcacgttcatcaatttgaagaaaagactgcgatcgtaatttgagaggaatgtgaatggtgcattcatgggtgcccttggaaactggaatgatggaatacatcacacgtgaatttctgttcaagtttcccagattatcattctttgggatgagagaacattataaaaccactttgtttattttaaagcaagaatggaagacccttgaaaataaagaagtaattattgacacattttcttttttacttagagaatcgttctagtgtnttttgccgaagattac

SEQ ID NO: 531200 - DNA, 110 bp, Homo sapiens
atctcatcttctgatatcacacaaaagagaaaaaggaagacaatagctatggatccccaaaaagggatgtgatgagaatttgaaccagttggctgcccagtgagaactag

SEQ ID NO: 531201 - DNA, 692 bp, Homo sapiens
aattgagaacattgaatatagactgcatattagataacaatgccaaataactgttttctcaggtgtgataatagtatatgtagaaaatgtctttttgtttgttttatttgttttgttgtttgttgtttaggagacaagagtctcacctgtgtcgcccaggcctggaagtgcacgggagcgggcgatcgggaatcaggggagaagtcatcatgcctcaccaaggatacaagtagacatcacgaggcactcgggacacacacggcaagaagtcggaaacacaagagagcaacgagaaaacacgagatgagaaaaaacacgggacgagaagacaaggaaagaacaaagaaacaaagaaaaaaaaagcccacaagaaaaacgagccacggccacccggccgggacgaggcaacaacgaggacatcaacaacccgaccgccagccgcctcaccaacacaaccgtgagatcgacagacacccccccccaaacacccgactcacacagaagccagagacacagccacaacaccaaacaccagcgcagcgcacccacacaacacttgagtccggcgcccaaaccagacacagtagacacaaaccaacacacaacaccacacgcacaaacaaaacaacgggacacaactggccacaacggcgccgcaaacacacaggcgaacaaaacaggacaaaaagata

SEQ ID NO: 531202 - DNA, 1149 bp, Homo sapiens
tcccccagtgtttggatgtgcttatcgctttttgtctccgggttgtgtcgttggatacccccgaaattcatgccctcgtgtttttttcgtaagttgggtgagccgactgccctttgtgtaattcctggggttgtttttcaagccattgcggtgcttggggccccgttgttgtggccgctggcccttgtttctgccaccttccccgccgtgggccggataccctcttgcttatgtaggcgtttcctgggtattatggcccttagccccggtgtattgtccaatattgggcgattctcccaggaaagtaatgtgtgtgtttgcgggaggacccacgtgtcgttccttgttgtggtaccccggggggctctttttccgcgctttttctttcaattcggatgacgcttcccagtgtgtcaacgggtggggcccccttgtccacgaggaaatcccatgtccgttcaccaatagttggggccccgcttggcccgttccatcccagtttgtggcgccctgatgtccagtctttgccacatccccacctattttatccagtaaaggccccctggggagctcccctccgccactttgttgtgttagaaggggtttattagaaactttctaccccagtgtgagaaccttttacgagagtagcataatgtgcgcttacacgacttgttgctgctgcgattctatatccagacgcccacttgtggaaataccccggaaattggcgcccaacaccgcctgtttgtgaataccctaatgtgttccttaatattaaacgccacccgctcacttgtagacacccgacgccaaatggccaccctctctcgtgtgaggagcccgtgtcttctgtctcccgggcttattactttgtaaactccccacaaatatgaaactgaccacactcttcacgaaattagcctaaccacaaccacgtgtaacttattttctaataatgtgataatgattcttgtggtatatatgccaaattattcctgaccacaaactttgtatacttggtctgtccttttcctttcaccacttctatagtggatctgttccccatcgttgaaatggaccgtgtaagcctttgagctagcttggagtcgaataccctatttttcactccccaagaaaaaaaaaaaa

SEQ ID NO: 531203 - DNA, 681 bp, Homo sapiens
  misc_feature (15)..(15): n is a, c, g, or t
  misc_feature (107)..(107): n is a, c, g, or t
  misc_feature (185)..(185): n is a, c, g, or t
  misc_feature (198)..(198): n is a, c, g, or t
  misc_feature (202)..(202): n is a, c, g, or t
  misc_feature (207)..(208): n is a, c, g, or t
  misc_feature (223)..(223): n is a, c, g, or t
  misc_feature (227)..(227): n is a, c, g, or t
  misc_feature (230)..(230): n is a, c, g, or t
  misc_feature (243)..(243): n is a, c, g, or t
  misc_feature (252)..(252): n is a, c, g, or t
  misc_feature (262)..(263): n is a, c, g, or t
  misc_feature (266)..(266): n is a, c, g, or t
  misc_feature (268)..(269): n is a, c, g, or t
  misc_feature (278)..(281): n is a, c, g, or t
  misc_feature (292)..(292): n is a, c, g, or t
  misc_feature (303)..(303): n is a, c, g, or t
  misc_feature (308)..(308): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (331)..(331): n is a, c, g, or t
  misc_feature (333)..(333): n is a, c, g, or t
  misc_feature (338)..(338): n is a, c, g, or t
  misc_feature (352)..(352): n is a, c, g, or t
  misc_feature (403)..(403): n is a, c, g, or t
  misc_feature (449)..(449): n is a, c, g, or t
  misc_feature (458)..(458): n is a, c, g, or t
  misc_feature (489)..(489): n is a, c, g, or t
  misc_feature (575)..(575): n is a, c, g, or t
  misc_feature (612)..(613): n is a, c, g, or t
  misc_feature (617)..(617): n is a, c, g, or t
  misc_feature (639)..(639): n is a, c, g, or t
attctatttataaanactttaccattttttatgctgaaacagcagcatgtcctttaaattattcattctaacatgtagtttgtgttttaattgtcttaatgcaaggnaagtaaaacagtttgaaatatgatagaaagtataaacacatttcaatcagtagtttatattaagaagatttctaaganggtgctaaatttnaagnaattnnccgtcaaattatggnaacngtncagattatttganttgtttttnaataggtggnnggncnnttttttttnnnngggcaattttnccaagacatgntgganagtnagcngncaaatatcatatngngttcngggtactgtggggnatccaaatccccctcccttggcaatgtactggggccatttgggggaaaaanaaagtgggattaagtgttaatattgactaggggtaagtcctttacntcatttttnctaggaacattaatagtggcctttgttatgntaatggcacatctcattttaaaaatgaaatgctaaatatgttagaaacagatcacaacattttaatgactgggataagcaaaatgngtccaacctttattctgataatagccagtaaatttgnnaagngaggagacaaactgtaattgtntacataaaaacacctagtcccactttaaaattttaatatcta

SEQ ID NO: 531204 - DNA, 156 bp, Homo sapiens
agaaatttgcattacaaacttaccagttgagcacccttaatccccaaatccaaaattttccagtcagcatttcctttgagcatcatgtcattgctcaaaaagtttcagattttggagttttgaatttgggatactccccttgtattagcttaagta

SEQ ID NO: 531205 - DNA, 838 bp, Homo sapiens
cacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaactgcttgagcccgggagacagaggttgcagtgagtcaagatcatgccactgcactccagcctggccaacagagcgagactgtccccccccaaaaaaaaaagagagagactgctttcaaagaggaccaagactacagtgaaattaaaactggtttggctgggctgggcatggtgggctcacacctgtaatcccagcacttggggaggccgaggcggttggatcacctgaggtcagaagttcgagatcagcctgaccgacatagtggaaccctgtctttactaaaaatacaaaaattagctggggcatggtggcggcacctgtaatgccagctcctccagaggctgaggcaggagaatggttgaacccagtaggtggaggtcgcagtgagccacagttgcgcattgcactccagcctgggcaatgagtggaaactcgtgtctcaaatacacaaattacaaataaaaactatttggtggacttttcgtctctccatttagtttgggcacaagactattgtgcaaaagctacagagttatcttcagacaagttactttcacaacttagatgggctcccacgagtggccggagaacctgtctggcaagatccttattagatgccacaggggaccaggggattcggtaaccatggg

SEQ ID NO: 531206 - DNA, 644 bp, Homo sapiens
cgtaagtcttcccgatgttccctgtctctggactctctggaacttgttaacatggctcttaccaccccctctttgatgataggtatgaagagtgtagcacatctgaatgatgctggggtgaaactgcttcataacacttccattttctcccctatttatttccatatttttcattttttcactaatatccccacggttttactatactgtgttagtaattcacatgttgctggactaattctttttaactgacttgtaacagatatgttaaaccgtttaaacactttggggggtcatttttcaacctcactttaagttagttcaagttaatccagtctacatggcatataaaccttatgattacatcaaatcttcaatgctggtcgcctgagttggaagcccaagacgtacaaaaacagctgaagtgtcaggtttaatgtgataagcttctcttactaacagggttttgtaatagcagcaatagatatatgcacatatatgtgcctatatttagcataccttattggatgtccatatcacactggtgtacaagttcaatttcctgccacactttctggggagtgccatttgaagctgatcctaagtggtgatcgtagtctgcccactggggctagttttgcaac

SEQ ID NO: 531207 - DNA, 139 bp, Homo sapiens
ctgaaatcgtggagacagaccacagcttgcatgcccatcgtgctagtaattaagttccccgtaaaaatctttgatatatggcccataccggtacatgcaagcccggtacatgcaagcccggtaccccggtacatgcaag

SEQ ID NO: 531208 - DNA, 202 bp, Homo sapiens
gctgggtataggaacaggaggccagcattcagaggatcgacgagaacatgctaggagcccagttgaccgtagcggccgtccattcagagatcctcaagtacttccagtctgtcacctaccaagcggtggctcatggtcacaatcttcctcatcctcattgtcttcttcatcatctatgtggtctatccttgcatgaacccgt

SEQ ID NO: 531209 - DNA, 180 bp, Homo sapiens
ttaattagtggtgacaagttccttattggtgtgtgtgagattactctagcaactattacatgtataacacagatgatcttcatccacacaccccatcacccagataaatttacgagattctgtgtaacagtgagggttggattaaagtattaactggatgtagaagaattaatctaaggg

SEQ ID NO: 531210 - DNA, 764 bp, Homo sapiens
agcgggtcagcaggcaacatggccgagaggccggggcctccgggccggcgccgatgtcctgcgaccgctgtaccctgacacccccggctggaattccctccgcagctccaggcggatgcgatgcggcgccgttttcgtgggcgtattcaattgctctggtgcgccgagtcgctggtatcgagggccctgcgccgtcgacgctcacggccgaagcatggactcattcgagtcagcagtagatgctcactgcacgcacgaggaagcccatgtagacactcaagccacgcgttactaagccccgagcacgatgtttctctcggaaacatcgagccggttggaacggcaagcgctttatgatcctgacgatctgccgttcaaagctcggtttgctagagcaaatgcttcctagatgctcagacagaaaacttttgatgactctgtagcacatggagagaaaggatttggttactaagagttctcgtgctttcaacctgaattattcctaggggtaattgatgtgtcagggtggtgaacttcatacgtccatagtggcatctggctggcaaagtccatcgtatggggagaagtctgctgatgagaacttcatcctaaagcatacaggtcctgtcttgttgtccatggcgaatgctgggaccctaatacaagtggttcccagattttgaatctgcactgtcacgactgagtggatggatggcaagcttgtggtctttggcaaggtgaaggcttgaatcttgtggaggcca

SEQ ID NO: 531211 - DNA, 163 bp, Homo sapiens
tcgctattcaatcggcacccacagagacacacagagtcacacacgagtcacgaatcacgtctctctctctctccctctgtgtctctctctcgtctctctcgtctctcgtctctctatctctgtctctctttctccccctagttgccgctctatagtgagtgtg

SEQ ID NO: 531212 - DNA, 368 bp, Homo sapiens
acgaacatacggtgtattctcgtgtgaatgagggttatatgttgttaatgtggtgggtgagtgagccccattgtgttgtgggaaatggaacgaacacggcttgacaaaaagcgagatttgcaaatgcgcgatgcaaggcgatattacacgttattcgattactatacgacgcgaagcaggggtgcgcgcaattagcagcggcaattggtcgtccattatgccgacaaagcggcctcgtttgcatcgtgatcagcaagcagaaaaaacgcgatcgtcgatgtctggaacaaaaatttaggaagagttttataggcaaaacgcaaaatatcgactacgaggcacagcggaattgcaaagaccaagatagg

SEQ ID NO: 531213 - DNA, 1046 bp, Homo sapiens
gcgcgagtaggtctacaagacgctacttccccatatcatgagaacgagctgtatcacacttatcagtgatcagcgcccatcaatagatcatgtttcctattatcgtggcttacctaggtccatgatagtgcccgtgtttccgtaagcatctcacaacagaagactaactaatactaacatcttcagaggctcaggaaatagaaagcgcggttcgtgaacgtatcctgcgcgcgccatcgatccgtagtcctgcatcgccctctcgcatcgccttacgcatccttttacagtaacaagacggacggtcgaaccgaatcgcgcgtccgcattagcgcagtcaagattcaatttgtgccaccaattggctacgtgaacctagcgagtacacacgaacatactggcgagacttaaatcattacaactgcctagcgataacttccacccaattattcctagaaccagggcgagcctgcgaactcctatgacggttgacaaagtcggagtagtactcccgatttgaagcccccattcgtataataagttacatcacaagacgtctttgcactcatgagctgtccccacattaggcttaaaaacagatgcaagttcccggacgtctaaagcaaaccacgtttcaccggctacacgaccggggggtatactacggtcgaatgctctgaaatctgtggagcaaaccacagtttcatgcccatcgtcctagaattatttcccctaaaaatctttgaataggggccgtatttacctaatagaccctctaaccctctagagccataaaaacagagacacggaaaaaaagaacaaaaagaacaaaaaaaaaaaagaaaagcgggaaacaaagcgccacgggagcaaagaggagaaagtaaagaggggaaaggggaaatagagagggaggaaaaagagggcgaaagaaagacagcaaacacggagaaagaacaccaaaacaggaaaaggcaggaaaagagaaggaaaaaagacgaaaaagaagaagaaaaacgaaaaaacaaaaacagcaaccaccccct

SEQ ID NO: 531214 - DNA, 215 bp, Homo sapiens
taaacacaaaacatctttggggacagacatggatgacaaatggtttactagtgtaaaatttaagaatagaggcagacaaaagtatggaaggccggttaattttcccctaccttactcctgcttccagtttcgtctacctataggtaatccgatagatccacaatagtcaacgttgtctactcacgtaattagcattcattaagcgtgctgtacta

SEQ ID NO: 531215 - DNA, 389 bp, Homo sapiens
tcttcccaattttttttccttttggagggaaaacactaaaggcaatgacatccacatgtgtttaagtggctacagccacttctggtgtttatgatcattagatgcatggctagtaaatgatataaatagtgatataaaggttgtgtcctaatgaaaatgtctgtggactactaaagaaatgattaactttaattttaaaaattgcctggattttctaaataatcccctggggatgactgatacagtcaattacatttcagaaaatctaatccttagagtggtctctgagagtgatttgggagacaggccatatggaatacaatagagaaacgaaagtcagagattaaaaattcctgatattgtatactaagcaggactttaatgatcac

SEQ ID NO: 531216 - DNA, 809 bp, Homo sapiens
  misc_feature (201)..(201): n is a, c, g, or t
tccacttttatacataccctttattaagtctacccacaaagagctaaacagtccacaggaagtggtatggtggtacaggaatactaagtcaatgatctttctctttgccatgttagcgcttacattttaaagagcgcaagaaagaatatgtattactttacattagagattatactactgggtgcggtgtaagaaagtttnaatattagctggcaatgaaatatttagtctaagacattgccacctgcacaacatagctacagagcctagtgtattatactaggggcacgatataactttaccaagatgattgttctctagtgctcctttatacaatagtagaatcatggggcagatcgcaagaaacgcttggtcggctcataggtagagctgcatttttctttcttaatgggcctcagatttagaaataggcttttgaaggaatctcactagcctggtcaagattgacggtgtatgcttaggtagacgctggaggaagagccttcacaggagggttgtagacatcctgaaggctagacccttatgggaggaaagtccctgtactgcttttcaagacaagtttttagtttaattcagcttttgcgcattaagttactattgggtttgctgcattttcatctttttcaagaaagtgtggatgccccaggtagattccaattgagacttttcagggctctctacctgggcctccaaaaggcctgtatacctacttaaaattatgcataatctcccatgaattgcttgagacaatctacacacctttttaaaagcaaacattaatgaatctg

SEQ ID NO: 531217 - DNA, 205 bp, Homo sapiens
aggatatcctgaagcgcagaataattcatttttaattgtaaaaagtcaaaagcaacctaagtgttcacatgtccctagtagggaaacactggggctcaaagcatgcacatttaaaaatctgttttggccaggcaaggtggctcacgcctgtaatcccagcactttgggaggccgaggcaggtggatcatgaggtcaggagattga

SEQ ID NO: 531218 - DNA, 664 bp, Homo sapiens
gggcggccggtctcggagaataggggagagtggaggggcgttgaataagtctgccaaaatgatgcccacaccagttgatcctattgaaagaggggactgatagtctcccaaggcatcccccagcttgtgagtaacatcagtgcctggccagcgtgatggctggaggctgtcaagaacgtgaccctggagtcgccgcggccagtgggacaaggcttagtgtgacgactggcagaggcaaagccaacgaagtttctgaagtgatgggtgccaacaatatctgagaagcgttctatgatggttggtccatcctgcagcgaacagacttgtggtagacgattgccaaagtcccaaggatgctgaggtgggtgatggcagcacctcagtgaccttgctggctgcacgagttctctgaagtcaggtgaagacccgtatgtggacggaaggttgtagcacgccccagtatcatcatgtcgagcgtttgccgcacaggcatcccagctggtcagttaacaagatcagaagagattgctgtgaccgtgaaggaaggcagtatacgagtggagcagaggaagctgtgggaagaggtgtgtcatgagcgttctgagctccatggtctgatctctgcagcgagaaatgctgtagctttgtctgaagcatggtggtg

SEQ ID NO: 531219 - DNA, 293 bp, Homo sapiens
agtggccccacatggatgtgtcactaattcactgtcccatgtctacgcacggaatctggctgctctgcatactgtgacttcttcctgtgtaatctcagtggggcccgtgtccacccgcacatcgtgacccacttaggggagaggttgctttcctttggtgggctgagagtaggacaatgcaattgaatgatctctagtagacagaaaagaacttggtctcttttttaaaatttcaaagagccagaagttctatgcctccttcagagtaggcagaacaacgcagccaagatcta

SEQ ID NO: 531220 - DNA, 541 bp, Homo sapiens
aaggtccccagtcggagtgagtagtgcacttgaagctcttttaggcaggatttgacgatggagcagaaaggaggaaaacctggggcgtgcttgcaaacttcgggggttcccccaacaggagaggaagctgaagaaactgggggaggggcggaatgctatcggtctcccaatgagggcatataagacaggccataggggtcgctcggccccagataggagggtcacggagggaagaggaagagagaacccctaaacggtacccacctatgctcaaaaacaaaagtaaggggggaattattaaatccagatggcgcgcccctaaaggcgcccccaggtcactcatccccagttccaagcggaagggctgggataaaggggatggagggatggaggcaggcagggacaaggccccaccccccgacttaggaagggaaagggagcccaagctcccagctgggccctcctaccccgcaccatgccggcttggcacccccacttagcccccctgcccttcgccgccctgaccttgcagtgccgcaag

SEQ ID NO: 531221 - DNA, 452 bp, Homo sapiens
gggtcgtctctagcacggatcccctacaagataagagacgagatggagagagatacagcacgtaagagggtatataagctcacctacgataagtatgacgcggggtggaggagcatcagcaggaagagggtatataagatgcttcatttttgaaatcttgcatgtcttagaatttctttaatcttctcattttctttaagttttttctatctttcatctcgctttctctcttgtacatctcgtctcttctcttgtttgtatcaactatgaagtcgtttgttgaggcatattctgtcggggtgacgggcccataggtcggagctcgtccgcattgtgctgatttgcttatgatcttcccagtttccccatagtccgtgcctttctcttttttatttatttatcttgtctacagtttcccttggctttcttgtctcatctattttcccatctcg

SEQ ID NO: 531222 - DNA, 1590 bp, Homo sapiens
  misc_feature (293)..(293): n is a, c, g, or t
  misc_feature (393)..(393): n is a, c, g, or t
  misc_feature (1278)..(1278): n is a, c, g, or t
  misc_feature (1590)..(1590): n is a, c, g, or t
tggaaagggagtctcgctctgtcacccaggctggagtgcagggggtggtgactcctcggcttcacgtgcagcctctctataacctcccaggtttcaagcatatttctccgtgcctcagccttcccaagtatagcgtggattatacaggcattaacaccaccagcgccgtggcatagtgttttggatatttttctctgataaaatatatagggttttacaccatgtgtgtgtggccagggctgtggtctctctcaaactctcctgtgacctctcaagtgtgatctccaccccancttctcagcttctccacaaagcaactgtggagattatcacggggtgtgtgacgcccactgtgtgtgcccccggccgaaaattctgtttatatcacccttntataccgagaagaggtgttgtgtgctcttatattataagtgtgtgtgaagactctcacaattatttctcttgtgtggtatcacttatgtgtgtgttcccccccgagaatttgtggggggcacaaacatatttcaaaaattataatctctttttataacaatgtgtgtgtgtctgacgccataataatgtgtctactgtgggcgcctctcccccacttgtgtgcgcgggtgtgcatgtgcaagaacacagtctctctgtggggacactatacgacataatgaggtggtctccatgtggcgtggttatttcaccaaccatctctatataaaaatgtggcgaaattatacccggtggcgccagctgtgacatgttgtgtgtatgttgttcttaccaaacaggggggggggttctaaacaacactgtggtttacgaggtttcaaaacgttgggtttctatatattatcacccaaactttttcttctaaacagtggtggttgttttaaaccccaaagcctttttaattaggtctaccatataaaatctgttaattaactttcctccaaaggtaaaagaacgtcgtgggtttcaacatctacagtcctacaacttctccttgggggttcaaaaacactttcttttggagacactcctaatatacaacaaatgacgacataccagacgatcaccaccaacaagaccgggggggggggggacgggcggcattataaaaaaagatatatcatccgccccagggggggggggccccaacgtgatgtctatacggcgcagtaaatcccccccgcggtcttcttctcctcgtctcatacacaggtgtggtggcccccccaaaaagaggaggaagcccgcgacatcaaaataatacgncaaggacgcacgcggcagccgcgccggagttataacacaccgctgctcgccgcgtcggggcaaaaaacgtgcgtcgtatcgtcggggaccactccgcctgggagaagaaggagccccccactctctggtccggcggcgtgccgcacaacgctgcggaccacacaactccctcaccggagaacattataatgcccctcgacgcgacgcatatacaacacaccgcgcggcaccatgcgtgccacaccgcgcaactcgtgccgcggaagaattgttcttggatatagacaacaaacacacaagaacatcacggan

SEQ ID NO: 531223 - DNA, 350 bp, Homo sapiens
  misc_feature (170)..(170): n is a, c, g, or t
cgccacgtaattagaagcgccgagtcactatacacactcactggttcttctctgtggagcctcgtggcactgtccgtacttttggtcctaattatttaatgggatggtgagcttgttggtctcccaggatccaacacttcaccttcagcttgtattacaacaataccagnctttcaagctactccgggtgaccccagaactcatctgaactcagaagcccaagagtttcatccctctcactttaggggactaagtgcccctggtcagcatgaagtcgatacagaagcatgacctccatccctaatccctcaagaatgaggagtggaaggtgttggcaggagggtgggacg

SEQ ID NO: 531224 - DNA, 213 bp, Homo sapiens
attagtatcttgtactccacgtagctgatccagctgcagatagagtacatctcatttaccctggatcacatgtacgatattttaccttccaattaaatatattgccagaatctttcaaaatagatagagaatatgctacttaaaaattcaaataaaaatgtttacataatacaaactggtggcctattatagagtttctgtctaaatgcatca

SEQ ID NO: 531225 - DNA, 346 bp, Homo sapiens
ctttgctggggcataggatgtgctcctaggcctgcagacgactgattttgcaagacagcgtgctgatgactgtggcgagatgctactgagacttgtcaatacgtatggaaccagtctcgagaactgctgcgccgctctacaacctgatgaaagctgtgccaaatcggtcgacgaagtgtaaacctgatggggaagaccctcggaatatcctcaagcgtgcatgttacaccaagatagatccctaagtgtcaactacaactcttgtcgaagtctgaagagaccttcgaaatgtggtcaagctatgtagtcaacattaccatacgacagggcccttggcaggacttct

SEQ ID NO: 531226 - DNA, 1364 bp, Homo sapiens
taataaactgattttattagaaaaaggcattttaatgccaactgctggaaacacgcattattaaattacattttgcacaaccaaacacaggtgccctctccagggggcagggagaaaaaagaattaggagaaggggtgatagtttgctgggctttaacaaagaaaaaaaagagcgagaagcgcggccaggggaggttagttaggtctcaagtgtggatgtggtctctgtaccaaggaacacagcaaaggctcctcaggcacgtgatttcacatttacccaaagttcaccaaattaattagagttgtgttttccggtggcttagacatttctctttacgcctttgcccttcaaactttggcaagagagaggagcgcaacgcctcgttataaaagaagggagaagagggagagagaagattccagggcaattgtggccataggggtttggctttgtgaagaagaagaaattaggttttgaacccttttcctgtcggaaagagaagcggacacaggggggacaaccgagggaacgccacgaaaagaagaagaagagaggttgcccagcgggaaacacctccgtgagcttgccgaacttccgcggctctttctttgggtttgacagcgacgttcgaggggctttcagggttgttgacacagtgtggccgcacgattgaagggggcctttttggttacccacccccagaggggaaggtctcttgcgtgcgaggttcattcacagaaggcccaaggcttgggcttcccgcctctctacgaaagagttagaatttatggcaggggctaagggttttgaagccagccaaagaaaaaccctattgtttggtgttaagtcggtgcccccatagtcttttggaaagcccagcggaaatttggggggggttggacacccccccattctttaagggtgttcggctttgcgcccggaaacaataaacgccgggccaggttgtatgcgtcttgaaacaaggtcggcgaaaaacacttttttttcaacaaaggttataactcaaggaaagggggagcccacgggaactgttgagggaaaaactaaagcactgaaggcatttgttacaccaaaccgcgcactattggtcactgaggagggaggagccgggtatcatcaacaagaggactcacagccccatagtgacaaaactttcactagtactacgcactctggaggggcatgatgagaaaaaactataagacgtagaagagcattcaccccgtagtatacatcgttccacaagacctttgtgagtggtccgaaactactaccggactgagacgacagtgtgctagtataccaagaccctggcaagaaatctccccagaggcgatccaca

SEQ ID NO: 531227 - DNA, 679 bp, Homo sapiens
acgaggctgtgaccggaactttatttctctccgcgtgtctcacccttttctccccatatctgtttggacatgagctgagggcacggtcgcgggcggtcatgtgcctggttcgcagctacggcgatggaggggcgcgattgttccttggttgccgctccgcttagtggccgcgtcattccgcgcggtgtcccgattttaggggtacgaggagaagtgtcagccttcgaggcatctgcgaatggcgtgcgctggcccgcatggcacccggctgggatgtgctgccccgcggaatggtacctgctgttacagtcggcaagaggaaatccgggacaggacttcgttgaccgaggcgctgcagcaggcagacttggagctgatgctctgtgctgtcctccggctctctggtccactcaaggtacacagtatgctcaggagcatggcttgaacttccatgagactcctggtacatcgcatggcacctacagaggaggccttttctggtaaggacatgatcccgtctggggagaggagaaacgccaggctgacccgaggcttctttcgcacggaagattgtggagggctatctcccagcccatctggctggtgagtgactccacggagagtgtctgacatccagtggtgtcgggaggcctatggggccgtgacgcagacggtccgc

SEQ ID NO: 531228 - DNA, 111 bp, Homo sapiens
agaagaaacctcggcctctttagggatcacacccctatcaccccatctcccagcaaggtagggtcgaggcatgtagagaattagcgtagcctcaatacattactggcagaa

SEQ ID NO: 531229 - DNA, 471 bp, Homo sapiens
  misc_feature (336)..(336): n is a, c, g, or t
  misc_feature (469)..(469): n is a, c, g, or t
gctgtgccagcttctcggggcatcacagccttcattgtggagaagggtatgcctggttttagtacctccaagaagcttgacaagctgggtatgaggggctccaacacctgcgagctggtctttgaagactgcaaggttcctgccgctaacgtcctgagccaggagagtaagggggtctacgtattgatgagcgggctggacctagagcgcctggtgctagcaggtgggccccttggatcatgcaggctgtcctggaccacaccattccctacttgcatgtgagggaggcctttgcaagaaagatcggccaattccagctgatgcagggaaagatgnccgacatgttacacccgcctcatggcaagtcgacagtacgtctacaatgtcgccaaagcctgtgacgaggggccacatcattcccaaggactgtgccggtgtgattctgtatgcagccgagtgtgccacacangg

SEQ ID NO: 531230 - DNA, 168 bp, Homo sapiens
gttgggatgttcgatacagcggataaggttctaggttgacaaccataacatgtattgcactgaaatcaaagcacataatatcaaggcagagttactactgacggagaaagcaggaacacagaactacattacatctttgcctatcaaaagacgagggtaccgagctcg

SEQ ID NO: 531231 - DNA, 426 bp, Homo sapiens
  misc_feature (186)..(186): n is a, c, g, or t
  misc_feature (200)..(200): n is a, c, g, or t
  misc_feature (211)..(211): n is a, c, g, or t
  misc_feature (266)..(266): n is a, c, g, or t
  misc_feature (319)..(319): n is a, c, g, or t
  misc_feature (345)..(346): n is a, c, g, or t
  misc_feature (359)..(359): n is a, c, g, or t
  misc_feature (383)..(383): n is a, c, g, or t
gggagcccagggtacccgcctcctttttgtaaaactgttccccccggtcagcccattaagccctgtcctccattcctcaggccatttccatccccattttaagtcctggaacggccctgggggcctgcccctcactgtgcaactttgggaacagcccggcaggttggggggttttccaaaaccttncccttttggagccnctttgcactgnggggtaaacatgtttccagtgtgattccttccagtgagccaaacccggtgggtgntttatgagcctgaatgccttttgcctgctttcagcaggaagggacccctggancaggctggcccggggtggttaagtanntggagcccgatcncagtcccccggtttgtcagggggncccccttttaaatgaccccttaataaagtgatggccccccaga

SEQ ID NO: 531232 - DNA, 150 bp, Homo sapiens
gcagtggtatttctagtgagggggactactaaactgaaagataggaagaaccttcaagcaggcagaggccaggctaaaagtgaccacaagaggaggatacgtctgtaacacatggggtctcataaacacttgggccagttacagggtaag

SEQ ID NO: 531233 - DNA, 169 bp, Homo sapiens
tctgacatatgcgctgctggagctggtggctagtcttcctgacggggtacatgttcatatggaatgtgtgaggtgtcacccaacctctttgaagaaattgacaatggatggcaacggacgaagtcctcctaggaagagttctcagacgtacattcacgcccaggtggca

SEQ ID NO: 531234 - DNA, 733 bp, Homo sapiens
gtatttctttaaggaaaatgtttatatattgactataagagcaaaggctcttgaacatatcctagattatggaacactttttcccttccctttctctggaaaaattaaattttgtttctgtccactgagactggagtgcagtggcgaagatcgatagctcacatgcagcctccaagctcctggggtcaagcgatcagtcctgcttcagactctcccaagacagcgtaggactacaggtgtgcaccgaccgtttcctggctaatttttgtttatatttggtagagatgggggtctcactttgttgcccaggctgaccttgtagcgtatgtggcattcaaatgatcctccgtgccttacctcccaaagtgttgagattacaggcatgagccagtgtgcctggccaaaaaacattttaaattcccttgtctgggggtcagatcctctaaatatccctcagatttcagatgagtactttcaaccctgtcctaagcatagcaggtctgcagataatcttttagaatataggtggtcgaattagagaatggttttaccccagatgtctcataggagacattattatttagaagcctaaggtagacatgtgtaagatcagagtccctaagaaagcagaatttgtggaatagctggcaggaaagtggtttttaaagtctgtaagttggcgacagagactgtataggaaagtaaatgcatgctaattcccgttggtatccta

SEQ ID NO: 531235 - DNA, 471 bp, Homo sapiens
  misc_feature (440)..(440): n is a, c, g, or t
agagatatgatcattcctgcgccgaggctacagtgcggaggatcatgactagctgactgcaggctcatattgctacgtatcaagcgatactccagcgtaagaatccggcgcaactataaccataggagaacgccaccatgacagtcataactaacaacagttccgcaaagaggggatcgagtgatacagcccagcctgaggtggaactttagatctccgacaacctttccatcatggcttgccaaagcattgcgactacagacatggactatcttcatatgtcgacgagaggccataaacagaaccaatcatactcaaggcccttggctgctgggacacaatcagctattaataacatccacgaaaaagctcacacttctgagtcaggaaaacctgtgctggagtcctggctacactggtcaccatctgtagaagcctgngctagatgctgcacatccctgtgacccctgt

SEQ ID NO: 531236 - DNA, 414 bp, Homo sapiens
  misc_feature (171)..(171): n is a, c, g, or t
  misc_feature (174)..(174): n is a, c, g, or t
  misc_feature (278)..(278): n is a, c, g, or t
  misc_feature (297)..(297): n is a, c, g, or t
  misc_feature (316)..(316): n is a, c, g, or t
  misc_feature (333)..(333): n is a, c, g, or t
  misc_feature (349)..(349): n is a, c, g, or t
  misc_feature (371)..(371): n is a, c, g, or t
  misc_feature (376)..(376): n is a, c, g, or t
  misc_feature (398)..(398): n is a, c, g, or t
tgagacctactggactgcatccccagatggttagacattctaagtcacaggatgagataggaggtcggcacaagatacaggtcataaagaccttgctgataaaacagtttgcagtaaagaagctggctaaaacctgctgaaacacagatggtgacaagaccgacctctggnctnccttcaatgctatggacagcactcaatgctatgtcccaggcactagggacagtttacaaatgccatgttcaacattcagggaagtttaccctatatgggtcttnaaaagggggagggcttaantattccatcccttgttttnggcttattattccaggnattaccccttaaaatnggggccaccagccgccctcggnttttnctttggcccttaggggtttggnccttctttttatttcc

SEQ ID NO: 531237 - DNA, 251 bp, Homo sapiens
  misc_feature (179)..(179): n is a, c, g, or t
  misc_feature (206)..(206): n is a, c, g, or t
taagagacagagtcatgctctgtcaccagggctggagtacagtggcctgatgatagttcactgcagccttgaaatcctggggctcaagtgatccaccttcaacctcccaagtaggctggggacttgcagggtacacaccattcatggcccagcttaatttaaaaaaaattttggccgcnggcgttgggtgggcttcatgcctggtnattccaggcatttgggggagggttgaggcggctgggattacctga

SEQ ID NO: 531238 - DNA, 1106 bp, Homo sapiens
cccacgcgtcgggacccgagtgggtgccgaggccagtagccccgtgtggccctgagcagaggcctgtagcttgcagcctgtaccctgctgtgccatggctggagccgaaagatgcctgtgccgtctgctgctgctggcccctgccctgtggtccctggtgcagcactacacgcctcgcgccttccctgcgtactgctagctggcgggtgcgtgagctggccctgtgtactcctgtgccagagatcccaccgcatcgtgtgcccgagcaaccatcgcattaccaatcgtcatgaggcatgacctccgtgtcatcacacctggattcgcaagtacccatacacacaatacgaattagctcctgtatctccatatgtgggatcacatgcactccgcagcaacacattatagtgttaggcctgccacgaggacacacagtctatcggcctataaatcacctgcacccttcatcagggagaggagaacccctgcaggacttgacctgcgatggttacctagagtgactcacaagaccagacactgtagtgaagacaaaggcaacagacaagaggggagacctcgagagggacctggaaaggacacactccagccagacgatggacagacagtaaatcgaaaagctgacctgcgactgtacaagagcctgagcaatggccagggacatcacagtgtccatgcaggatgtagactagtgaaacagaaccttgaagcctatgggagcaggtgaactccccaatcattaacttggacaatctaaactatacccagatggcaaggggaggcatacgtatctcatgcatggaatggtgccataaccgaccaccaaggaacagtacgaaacacagagcgtgaaatgggtcccccttcaagagcagcttcacacgaatggactggcaaaagaagtgacactgagcgctgatacgaagagaacaaacgagcaggaacacccaaggccacaagaacctgagaaaaaaggtgaaaataaaaaagacaaacaattaagaaccgccaccggaacaatgggacacaaaacacaacacacatgcaagaacgggagagacaaccgaaaaccgcgggggacacaccag

SEQ ID NO: 531239 - DNA, 203 bp, Homo sapiens
tgcaaggatttgcgacacctcaagctcgaagttacgctgcagatcacgccggagagaaaatcatcctcgacgtgacatcaacaaggacagccggggtgagaccacgctgcggattcggatcaacaccaagcacgtgaagacccaggtactgctcgagaacggcggcacggtggtgatcgggcggcatcttcgagcaggtcgac

SEQ ID NO: 531240 - DNA, 937 bp, Homo sapiens
  misc_feature (854)..(854): n is a, c, g, or t
  misc_feature (937)..(937): n is a, c, g, or t
tctcttaatattccacccgctacagccagatagcagcactgaagaaaatgatgctagatgggagacaaaattagatgaagtcagctacatcggagggaaatactaatcccctcataccagagcatctcccctatctatagtagaaaaaactctagaatcttccgccacgcaatgcccttcccccgagagagatggaccacgtctccttctttcactgtgcatagcgctttctgtccgcggttctagcagtcgtcgatgtcgcatggcttctcattcagatcctgtcgatcccgcagatagtgtgccacggagtagtttataattccccgcacgcccagtaacccagcgcccgcgcaacattatgatgtatgatgcgcgctcacacctccccacatccacattcccgtctcgtagctcgcgcatgttctaaaaatactatataacctaccatccaactccgccaacgcctctgattctattatgagtacgattccgccctccaaatcgccaccctcccgcctcccttcatttagatatgtagacccgcctgatctcgtaagacatacccaattgccaaacatcccatttctccagcctctgccacgtatacactcccccccaaagtcgtcccgctagattcttattatcactactgccccatcccatccatactctgatatagtgctcgccccactaagagtaatgtgctcacctatacgcattaccaagattcgtgttatgacgtgcccgtaaccggccgccgccatgacacgcattgaggtgaagccgcacaacctgaagacaccacagaataaaagtcgtagagcagtcacgtataaatcaaccacatcgcncgagttcatttgggcgccgcagcgttgttgacggcgtggatagaacgccaccacccactaatactgcccgcctgtaccaccan

SEQ ID NO: 531241 - DNA, 403 bp, Homo sapiens
tatgtgcacaggtacaattatatatatagctgactcttgaacacacaggttgaactgtgtggggcacttacacgcagatattttttttttccataataaaagtgacattgagtggggctgggtatggtggctcccacccgtcatcccagcactttgggaggccgaagcggacagatcatctgaggtcaggaattctgagaccaacctggccaacacggtgaaacccatctctactataaaaattagctgggtgtagtagtgggtgcctgtagtcccagctactcaggaggctgaggcaggagaatcacttgaactcaagaggcagaggttgcagtgagccaagatcatgccactgcactccagcctgggcaacagggtgagactctgtatcaaaaaaaacaaa

SEQ ID NO: 531242 - DNA, 290 bp, Homo sapiens
ccgggtcttggcacaaaattatattaagggtcttaagagacccacttccagtctccagaatccaccgcccaggaagcccttgttatcttgtgggaccggcttgggcaaggccagccgcttctgccttcccccctttgtgttttaaaatgggggtggtggccagtatctcatctttgggttccccaatgctaacttggtcagccattgtcacgtaggaagttacagggtctccgctgtggatcatcaggccatccacaaacttcatggatttagccttctgtcgtcttctc

SEQ ID NO: 531243 - DNA, 589 bp, Homo sapiens
  misc_feature (412)..(412): n is a, c, g, or t
  misc_feature (421)..(421): n is a, c, g, or t
ggctgtggtggtgcacacctgtgagtctccagctacttgggaggtgaggctgggacgtcgcttgaaccctggaggtggaggttgaagagagcaagatctacgcgatgcagttcaggctggtgacagagcgagacgtctgtctcgagtgaaagagagagaagttgaaagaggcgtattgtcgagctgggctcaagtgattatagcactgatagtaaaccagccactgatagaatttctgtgaactgttagctatgagagcagagtcgtccgagcataggaagcaacacattcagtttaggcacttagcaaatggtgtattgagcacagtacgtatgtgccaggccctggtgctgaagcaagatgcaggattatacgctgcgtgaatcgaggactacgatcgtggtaatccccnttcatgaanggtccgacaaaagggaaactataggcgaagttaagcgaatcaagtagaagcaagaagagtggattggttgtgtaatgtatgtactgtacggtctaatgaaatgttgtagttgatcttctaaggatgtagatgcttatcatttacagcttacattgaggagatttgatc

SEQ ID NO: 531244 - DNA, 815 bp, Homo sapiens
cggccgcgtgtccgggccggtcatgggccgcggcgagtggcgagcgacggggcgccggcccgaggccggttcttgaggcgggcgttgcgcccgtgccgcgcccgtggagccaccaggtatcgagctctcacatgccgggaactccacgccagcaggttcttcgatccagagacctgatggcgtgcctgtgacccccccccccgtccggatacctccccgtggctgctgtcttccctggtcggatgtccctgaagagaggtcgatgacccagatgcttaacgtccagaccagaccagccagctactttgtggaatggatcccccaccaatagtccagaaccagccgtctgtgacataccccacctcgtggcctccagatggccagtcaccttcattggccatagccccagcccatcccggagctcttcaagcgcatctcggaaccagattcacatgccatgttccgccggaaggccttcctcccctgggacaccggcgagggcatggacgagatggagttcaccgaggctgagagccacatgacgacctcgtctctgagtatcagccgtacccggatgcccccgccgaagaggaggaggatttcggtgaggaggccggaagaggaggcctaaggcacgagcccccctcacctcagggcttttcaggttcccttaaccgtcttactcaactgcccccttcctctccctcagaaaattgtgtttctgcctctatcttgttttttgttttttcttctggggggggtttagaaccatgcctggcacatagtaggcgctccaataaatacttgtttgttga

SEQ ID NO: 531245 - DNA, 404 bp, Homo sapiens
acctctcatccattcacatacgggtcaggtggctgaggtctcagcccaaggctaaggaagcccattttggaccaggccatttttatctggagagaaccaaaactttacaaaagaatttctggctgggtgcagtgtgtcacacctgtaatcccagcactttgagaggacgaagcaggtggctcacttgacgtcaggagtttgagaccagcctggtcaacacgatgaaaccctgtctctactaaaaatacaaaaagttagctgggtgtggtggtgggcacctgtaatcccagctacttggaaggctgagacaggaaaatcgcttaaacctgggaggtagaggctgcagtgagccaagattgtaccactgcactccagcctgtgcaacaagagcaaaactccatctc

SEQ ID NO: 531246 - DNA, 254 bp, Homo sapiens
cagagcatcccctccagagtagctgtgactacaggcaagcaccaccattcctcatatttttgtattcttggtagagacgaggtttggctcaggctggtctcaaactcttgggctcaagcgatccacctgcctcggccttacaaagtgctgggattacaggtgtgagccactgagcctggccctaaaaactgtgtggtgccaactatgaaggactctgatctgacaataagcttgtacttggctataatggcgtg

SEQ ID NO: 531247 - DNA, 410 bp, Homo sapiens
  misc_feature (38)..(38): n is a, c, g, or t
  misc_feature (45)..(45): n is a, c, g, or t
  misc_feature (83)..(83): n is a, c, g, or t
  misc_feature (90)..(90): n is a, c, g, or t
  misc_feature (149)..(149): n is a, c, g, or t
ccacctaggctggacggctcacacctgtgatcccaacnctttggnaagttgaggcagggggattgcttgaacccgggagtttnagactancctgggcaatacagtgagacctcatctttaaaaataattaaaaaggtcgggtgcgtgtntcacgcctgtaatcccaacattttgggaggacagtggatccacaaggttaggagtttgagaccagcttggccaatatggtgaaaccctgtctctactaaaaatataaaaaattagctgggcacatgcctgttgtcccagttatttgaggggctagagcgggagaatcgcttgaacctgggaggcggaggttgcagtgagccgagatcgcgccactgtactccagcctgggcgacagagcaagaatctgtcttaaaaaaaaa

SEQ ID NO: 531248 - DNA, 263 bp, Homo sapiens
gctacagtcccttctactggtactaataatcatgatagaccattgtttattacccttagggcttcttcgaacaaggtggctggtctttcctggtagcctgcagtggtgaggggagtgatgctgacacgaagggcgtagttcaaagtctgaaattgaagatcatgcacttttaatccttcagaagattctataaatgaggaagaggaggactgtgatgaagattattcatcagaagcaggaacggtttcaagaagcagaactgg

SEQ ID NO: 531249 - DNA, 106 bp, Homo sapiens
gcggccgcctactactactactactgctcgaattcaagcttctaacgatgtacggggacatgtggaatgctggacaataaagcgagtgctgcccaccctccaaaaa

SEQ ID NO: 531250 - DNA, 1031 bp, Homo sapiens
aaagcgagatgaagaaaaagcgaaactgcggaaggctgattcgaccacaaggacgagttagaaacaggtaaaaaggatcagcagtaaacacaaaggaatctcaaaggacaattggcaagaagaaactgtaaaatccaaagtgactgtggatactggagtaattcctgcctctgacgagaaggcagatgattcccaaagctgccgcacagatgacaatgaagtgagacaaaaagcacgcaacgataagaagcaaaaagcacggcgcaaaagggacagacaacgagaacctgagcacagacaacaaaaggggaccctaagccaaatgccactttgttaaatgcttatgcaagaaagctcttggctaggcttaaccgaggaagacacgaccatgccacgaccgagacgacagaggtatagaaacgggtttttaaaagctggtctttttaactgaattttagcagatgcaaaaggcgtatactagacatgatggaaacagaattgtggaagccaatgtacccaactagtatgcacagggacacaacgtgcaaaaatgtaaaacagagaatgcgcaatagcaggaaagcgtacttgtgcaaaacaccaagatagcgggcacacactttttcaacgcataaaaattcccccagtacgtagcatagtccatggacggccctagaagccgtaaagcctacgaattcttaaaactgttgttaacaaagccttccagggtgtgttcgacaggtttgccactcccaaacaaagaacgtcctttttggcaccagaagcaaagaagtcccacactttagttgaacaggacttaacaacaggagggaaacaaaactaattacccgtaattgcagcgcttacaacagagttaaaaggcaagggttctttaggaccttccaaatggcaaactagagttgtaagaggagccttattgaaacggattcttgggaacaacagtggaatctcaccagaataacttgtgactgactaaatccacacacctatgtgttggagaccacttataa

SEQ ID NO: 531251 - DNA, 207 bp, Homo sapiens
agttctgcggtcgctctagaggactccccgaggtactgaagcactgggcttaatcttctcaccttgtcgaacctcattttcctcttctgtactgtgagagaattgaactagatatctgagtcccctacttaagtaattttgagtttgtaaaactgcattttttctgagtactcaaatcccagtgcgagtcctccccagtgcttagac

SEQ ID NO: 531252 - DNA, 458 bp, Homo sapiens
cgggggactggtaacaaatgtagatagccagggggtgctgtgccacttggagccgacactagatccccctctgtcccagaaagatgacccgaaggtgagaccaaagtaccctttaacccccacccttccaatccggtgtgagggcctgaccgggcccagggcaagcttatgtcgcaagccctatttattcagtcttcactataactcttagagttgagacgctaatgttcatgactcctggccttgggatgcccaagggatttctggctcaagctgtggagctcagcatagacccagctttctggggaaggccacctggggatttcaagagggcatccaggaattacctgagcaacagaccatggggaaagtttggtcagaggttccgtggggatttgggaaccacaaggaccaaccacctggtaagcttgttcaaattcaaagaatggcttgaaacc

SEQ ID NO: 531253 - DNA, 355 bp, Homo sapiens
  misc_feature (109)..(109): n is a, c, g, or t
ttttgtagagacaggtttgccatgtggcctaggctggtcccgaactcctgagcccaagcaatccacccacctccacctcccaaaatgctgcgactacaggcgtacgacntgtgcagtggcctgaaataaatagactcttacccaatgaaatagggcaaggaggccaggcgcagtggctcaagcctgcaatcccagcaccctgggaggccaaggcgggtggatcacgaggtcaggagatcgaaaccatcctggccaacagtgaaaccccgtctctaccaaaaatacaaaaaaaactagccgggcgtggtggcgggcaccgcagtcccagccactcgggaggccgaggcaggagaat

SEQ ID NO: 531254 - DNA, 206 bp, Homo sapiens
  misc_feature (121)..(121): n is a, c, g, or t
ggcgtgataggagatagtacggcgcgatcgtcctattcgcgccggcgctccatacattggtccatcgcgtgcttgtgtgtactggctctggttttataaatccgccatcgatacgactggncagctttttacacgatatttgccgcccgggtcctgcaggtcccgctgtattttgccgttttcatcaaacgccacgtggcgtctgt

SEQ ID NO: 531255 - DNA, 209 bp, Homo sapiens
cgatcgtcacccgcaatcccgctggagatacgccgctcggcacttacggcctgatcgccgcgctggctgggcgcactacggctccgagaagctgctgccgctcggcagcttcgtgctggcgctgtatctcccctgcgcgctgcacatcgtgcgtggtgtacggcagcctgctcgccgcgcacggactcaatccgctgaagcttcttccg

SEQ ID NO: 531256 - DNA, 1341 bp, Homo sapiens
acatcaatcagacacatagccctcgtagataacagccattctcatccaaaccccctgaagcttcaccggcgcagctcatatctcataactcgcccacggacattacatcctcatatactattcatgcctcgacaacactcaaaactacagaacagcccatcccagatcgcactcactaactccatctctcaaggccacttcaacaaactctacctcccacactacactacgactattatgagtgacctctctagaacacagcctcgcctaaacctcgagccttaacccccccaactacttaacacctacaatgggacgacactcatcatgatatgcatagctaaaaccaacagttaccatacacatacaatacacaaatcattcacacctcacttcccataaccatataaacatggaactaccaaacaaaataactaaagataacaccaagacacccctacctaccttccaacagatcaatacgccacgataattatcatcaccaccaaagacagacaccacacccagaaactgcgaccgcaccactcgatcgctaccagcacagccagcccacaaacagtagagacagcaaccaaattcagacacaaccccacaatacacactacacaacgcaacatggaaatgaacaacacaaccacaccaaagatcaacatgcataacaacattacaaaaccccaataaacatcacaaccacccaaaataacacatcacaaatcaacaataacttcaccacacatacaaaaacacacaccccaaaaacaaaaaaatacaaagttataacacacaggagcaagaattttataatcaacacctcccactaatcaaccaaacacacacaactacacaacaacacacccaacacaccacaaaacgacagcaagaacaaaagagaaagacaacaaagaaagaacagaacaacaaaaaaaaacaacaaagagaaaaagaagaagacaaaaaaaaaagaaccaaagagaggaaggtaagagagagacagaaagacaaacaaagaagagaaaggcaacaacaataagacaaacaaccgaaaagacgaaaaagacggaggagaagacgaaaggcaaagagaagaagaacagacgaacacacacaaagcaataacagaaccgacggcaacacgaggaacggaaacacagcaagagcacaacgacaacaacaaagagcaacaacagagaaaacaaaaaagacagcgtaatcaaatcaacgacaacagcagaagaagacaagagacgacgaaacacaaacgacagcgagaaaacaagaacacacaaacgaaaacacacaacacaatagaagcgaaccaac

SEQ ID NO: 531257 - DNA, 124 bp, Homo sapiens
ccatccagcagtcagcatccattcctttgtttggcggcttctgccaaacatgtgtctccacccactcactgcagattgttcagcccctgatgtatttgtcttgatttgtttctggtggtagctt

SEQ ID NO: 531258 - DNA, 128 bp, Homo sapiens
  misc_feature (10)..(10): n is a, c, g, or t
actagcgatntcagtctgaccacaaactgatatcattgaaactgtgtggcaagtaatggcactcactatctattctgggccaggctggttttcatgccagtatcctagcactttggtaggcccaggtg

SEQ ID NO: 531259 - DNA, 338 bp, Homo sapiens
  misc_feature (38)..(38): n is a, c, g, or t
  misc_feature (335)..(335): n is a, c, g, or t
ctgctgggaagcctgggctgtttttttttttaaacccnttttatattactgaacaaccaaatttaccctccccggccctgaggccttatcagttcccctgattaaaaacttttttttccccggactttaagcccggtaggaaaaaaaaaggaggagggggaaaaagccaaccattttttttccaggcccttgactgctcctttggggtgggccaaggtttgtatgtacccccccatgcatgactcaaatgccctcaggtccctttttttatggtatgtatactgcttgtgtttgggttgaagccctccctgccattaaaggaaggacttggaganaga

SEQ ID NO: 531260 - DNA, 306 bp, Homo sapiens
taaatattcaccactttttttttgagtagctatggctataacatatgctcacaagtccagtaaaaaaaagggattggaatttcataatttttacgaatatgatagctttcaaatagtttaaatttgtgtgcctacaatacctaaactctactttttagtagacattaacataaagccagggtggctggaatagcattgatctatctcaggtcctttgcccaggacaagataaaaatcagaagacgaaaggagcaggcaagcattaaggggtcgagggtgtgaatgcgtccgtcgaagttggggtac

SEQ ID NO: 531261 - DNA, 113 bp, Homo sapiens
cgtacgcccggatcactcgggtaggcacacgcactaccgtactgtacggtatactactagtacagctatacccctactatgtagagtactacgcaggtacgctcaaccctacc

SEQ ID NO: 531262 - DNA, 734 bp, Homo sapiens
  misc_feature (595)..(595): n is a, c, g, or t
agagagagagagagagagagagagagatagagagagagagagagagagagagagagagagagagagagacttcgactaccccacaggctctcgccgcgttccatatcatggggtctcgcttgttccctcctttcgcgtgctctgtcactgcacttgcccttacattcgccgcgcctgacatacctgcactttccgctacaccctcagctcttacctccgtacacgcacaccgctctcataacaccttctttaactgtcctgatctctctgcgttccttctcatgtatacctcgcgaatacatgtactggtttccactgaactgcatgaatacttgataccacctttgtctatggactcttactgagatggtcatctgtctcatgattaccatcctgcgtacttgtcttatttaactcctgattttgatggccttccgcatggtttcgtctctcctgtgactctggatgttgtctctgtccttttcctcgatgcacactgcagcatgcgttgtcttataacgtcttgtcgctctacatgacgcttcgttcatcgggcacgtctatcactactttctgatacttctgctacttccgntgcagtatcctatagtagtcgcttttctcgaatatgttcgtgttacgtcgaacctctcttggttttacaggctcccaatctaattcctacgaagatgtctagcttttctgaaccagctttgtagagttccattttctct

SEQ ID NO: 531263 - DNA, 202 bp, Homo sapiens
gcatgcattgcacagtcctgaggcatctattacattaagtctgttgtccagccatcaccacccttcatctccagaactttttcatctttctaaactgaaactccatacccattaagcagtaacttcctgttgctgtctttctccatcccttggtacccaccattctgctttctgtctttatgaatttgactactctggaaag

SEQ ID NO: 531264 - DNA, 103 bp, Homo sapiens
actggatccgcctatcccacaagaactatccaagtatatcatatcctatataaggtagccctatactagacgtccaatagcagcgtctataaccgagtagcta

SEQ ID NO: 531265 - DNA, 410 bp, Homo sapiens
tggtagacttgcacaatactaaccttgatttccaggatctggaagttctctttcctgactgctcaatagatgttgaatggggcatattttgatgcgcagtcttgtggttcctgtggtattctaacacttgcttggaaatgagatagttggaatgctatacgcaaccaatatagttgtgtttctaacacttcatggggagaggagagaaaaaggaatccaagcttatataacccgctgaagtttccagttactcattacttaatcatacccttaagaagtatgatttcagttcttctccacacactacaaattaacgagtttcactagacaataagctgatcaattaggctgattcacatttagagctgcctttccaattactagcacatggcgagggttctcaggaaaat

SEQ ID NO: 531266 - DNA, 215 bp, Homo sapiens
ggggtttttccccaaaaaaattttttaaaaaaaagggggggggaagggcccctaaaacggggccaggggggggccttttttgtttttccggggggggtttttccgggggcccaacccccaacccggtttttctttccaaagcccccccttttgtttccaaaagggccccaaaaatttttggtccgccaaaaaaaacccaattttggggaccccca

SEQ ID NO: 531267 - DNA, 1821 bp, Homo sapiens
  misc_feature (377)..(377): n is a, c, g, or t
agttaaaactgagcccaggaaaccctagacacggggtcgctctcgagcccctcctaatgacctacgcggactaagccatgtgcactgtgcacttaccacaccataagcgctcctcgatactacgggcctactacaccaaccaccattatccccatagtacccagactggatggcagcgtgatgctaactacggagcaacagccacggtacacgacggtgcgactctacgacaagcgatcactgtcccatagagaatggcacgttcagcatttagtggcgcataaatcgcctacttgtatcgacgcgtacaagaacgcttactgtagcgtatacgcaggagattgatagctatggaggcccgtgtatttatgcctcgntcaacgaaaacaataagtcgcgcctttacacgcgcctccatagtcttaggcgcaggggagtccaagcgtgagccccgcgccgcagagcaagggttcgactccaacgcgccgcgttattcacatactacctgagcattaacaaaagctcatcacaatgggtcacccatggatacaccacaaatgcaccgggtaagtcagagcactccggactcagtcccacgggcaaggtaatgcgagcacggcgaccctccggtgaacgtcattccgaacaccataataatggtgccttacgatctaccttaaaaaagaaggcaaaagaccggaaagagaaccacggataggggttgaaactagggcgacactagcaccaagggtgagactcttccggtttggatccaagaataggtggtatcaacccatgggcggtttcttacaataaaagtactaaggcaacgcgctgtgactcagtgaagaaaaaaggacactttcggacgacacgtctaagacggttaccggaaacgttgacattccctccttctgcaaaacgcgacaataccccacgaaacagaggcaattacctgaacacgggggtatgccaacagcaaatttgtggtcgggtaacgggcgcaagcaagggggctacttacgccaagcagtgaaccgtattccacacctgtccgaatgtggataacagcggccgtacaaacgttgactaacacgtacccaagactgaaatcacctagccctaagactcatgacgctgagttgcagaaaactgaagagttgaatttcgctccaccagttattgtgatctagcttgctcaaagaatcaatttccaccatatactagggggtgcactccccgacaaaagtgcgccgacaacgaggcaccgtggtaaattaaacgatgggcaccacgtattggaaggcctagagacacattcagttggcagcacacagaggaacacggttaaactgtcatgtgccatagtgttcacattggttagcagttcacagaattccccataaatcatggataattggcacagcgacagagataacaggcagcactacagacaacagcgcactgaagacgaacactaccaccccagaatacgaatacacccgcacgagacaagaggagaacaaggcacgacacaacgaacaacacgatcgctactaaaacacaagtcggaggggacgacggtcaagcgagacgaccatctacagcaagcattagttaccacgacaacggagtggacgcacgcagcaaccagacacactagcagcgcaccaacaccaccacacgagcgacgaaaacgccgatcgtgcaacaccacagacacgtccgcccccaacacacgagtggagggcacaacgacaaaatgaaggacaaacgaagcaagaccgacccagatccgaagacgagtgagtatacgaacac

SEQ ID NO: 531268 - DNA, 867 bp, Homo sapiens
  misc_feature (620)..(620): n is a, c, g, or t
ctgagcgtgcctaccgaaaagcagcccgaccatctttcaaaagcaagaagagaggtcctgctgggagaaactggcaaggagaagctcccgcggtacctacaagaacatcggtctgggcttcaagacacccaaggaggctattgagggcacctacatttgacaagaaatgccccttcagcgtggtaagtgtgtccatctcgagggcggaatcctctctggacgtgtgctgaccatggatgaagatgcggaggatccattgtcatccggcgagattatcggcacgtacatccggcaagtacaacgcttcgagaagcgccacaagaacatgtctgtacacctgttgccctgcttcaggttacggtccatgatctggtgacatcgtcactacgtgggctgagtgccggcctctgagtcagggacagtgcgcttcaacgtgctcaaggtcacgcaagggttgcggcaccaagaaggtaggttccagaaagttcagaggctgggacatcgggccggtccccacaaggatatgaagttgttttcgtcattcgcagaagaggaggcttgtcagtgaggctatgcttgtgggggaaccccgtcacagataacttgcgtcaacagggtgnggaggaacgaccacgggacgagaagcccgctaagtggcctgggaaccagggaccgcaggcgtgcggtcaccaagtaaaacgcggggacagggatgccaacccagtgggcgggcggcaggctcaacaggcccgagtgataaaccgcgcgggggggtgcgagcaccgcgtgcgcggaggcataagggggggcacaccagagccgcagaacgcaagacaacgagcggggacggcacacacccaacatcat

SEQ ID NO: 531269 - DNA, 674 bp, Homo sapiens
gtacaggtggctaaggagctgaaatattgacatcatccccattccctcagtgtaacgtaccctgacttgggtagacacaggcattggcatgaccaaagctgagtctcataaataacttgggtaaccattgccaagtctggtactaaagcattcatggaggctcttcaggctggtgcagacgagtctccatgattgggcagtttggatgctctggcgttttattctgcctacttggtggcagagaaaggtggtaagtgatcactaaagcacaacgatgatgaacagtatgcttgggagtcttctgctggaggttccttcactgtcgcgtgctgatccatggtgagcccattggcacgcgggtaccagaagtgcatcctccatcttagacagaagatcagacagagtacctacgaagcagaggcgggtcagaaagcaagtagtgaagaagcattctcagttcataggctatcccatcaccctttatttgcgcagaaggcacgagagaacgggcacattaggtgatgcatgaggcagcaggaagagaaaggtgagaaacgccgaggaagatcaagatgctgcagacacagcccaagatcgacagatgtgggtcagatgcaggaggatgacagcggtaaggattaccaagaagacaaactaagaagatcaagaggaat

SEQ ID NO: 531270 - DNA, 144 bp, Homo sapiens
ggggcccccccccccccccttttttttttcccccccaaaatgggatggggggtttttttttccccccgggggggggggggggggcgggggttcctttccccttcttttttcccccgcttttttaatggggccccccccccctta

SEQ ID NO: 531271 - DNA, 137 bp, Homo sapiens
ggaccgttttcctcatagaaggagactgtcagatggataacagacaaaactgccgttacagccgcgcatgaagagggcaacgccctggtgatcgcgggtgtgcaggtgcgttattcagaagccacgattggcgatat

SEQ ID NO: 531272 - DNA, 181 bp, Homo sapiens
tgagttcattatacagagtgtcatggtgtaccatttgtttcccttcttaataataataattattattatttttgagatggggtctcgctctgtagcccaggctggagtgcagaggcataatctcagctcacagcaacctttgcctcccaggttcaagcaattctcctgcctcagcctcctg

SEQ ID NO: 531273 - DNA, 227 bp, Homo sapiens
ttcccccccccccacacccaccctttttaaaataattggctttttagataccccccccaaaagctcagaaattggctttaaaaaaacccaccccccaaaaaaatccattggctaaaaaaaaaaagtattaaaaacgaattggctgagaaccaattggcaaaataaaggaatttggcccccgctagaagtttatggcagagctttacaaataaaaaaaaaactggcca

SEQ ID NO: 531274 - DNA, 632 bp, Homo sapiens
ccacgcgtcgcccacgcgtcggaaagacaggctattttatttcaaaaaaagaaaaaaaaaaaaaaaaaaaaaaaaaaaaaaaaaaaaaaaaaaaaggggaacacaaaaaaaaaaaacacaaaaaaagggaccgggggcgtgccgcctctgtaacgttttttttgtggtggcacagcgggtggctccccatataacgagcccgtctttattttataacgacaggggtgcgccatcatgttgggtgtagtagcaattattacgacaacagcgcgaacacgagcgcgccgccccttgggaaaacctctggtggagaaagggacacaatccttctcgggaggggcgagacccattttgtgaggggagacgacacaccctctctctctatctagcgagggagaggtgatagagaacatctctttgagggggaggacaactcttatccacaattggtgagaacttgacgatctgacagcaggggcggagaaacactaatctacgagcatattatggcgctaggcgctatgactgggagagaagatcatagcgcatctaatgagagatattttatatcgatttgtaggagaaggaaatatattttagcacgcacacagggaggtgatgttggtaaaaac

SEQ ID NO: 531275 - DNA, 428 bp, Homo sapiens
gctgagcgcggccgcacggtgcgcgagcgagctgccgtgcggtgacttacagtctggcggggggacttgagaacgtatcacatgctgacggcttacataagagcgctggtcctgctggatgacggagcacctgagatggacacggtcatgcctggacatggcatgaggcgcgctgaagttcatgtcaccgatgcaggcctgaatggaacagacctagtgcagggtcatcgagatgagggcattagagctgaggccaggcttgacgatgcgacagaggacaccatatgacgtggtggttctaccacgaggtgatctgtgcgcacagaatgcatctgagtctgctgctgccaaggagatactgactgagcatgacaagcgtcaggctctgtgagctggcatctgcacaggctactgctctgctggctctg

SEQ ID NO: 531276 - DNA, 1370 bp, Homo sapiens
  misc_feature (292)..(292): n is a, c, g, or t
  misc_feature (568)..(568): n is a, c, g, or t
  misc_feature (789)..(789): n is a, c, g, or t
acaagtaccatgatcagctgactagggaagtactatgttatatcgctcacacctcattatcctcccttactattgcctatggaaggaagtaatactaatcgctgttcattagtgaggctactcatcagtaacggctctaacaacacactacccatcttgaggcaaatagttgtgcactatgagcctattactattcttcgacgcctgcgaatgcaggggtgggcctaggcgccctaactagatcacacctcttccaatcacaatactggttcttacgacctaacgttaccantatagccttatataccctaccatctcaacatgacatatacataacatatatcgtattccaatgcaaggtatattatatagctaccccactgtagcactgtaacttatccccatgtaatagacacagatatacttttgaacatcaagcagcaacctaacctctatctatgtccactaaaatctaattatcctatctcagatccctcaccttaacataattgtctattatacctctataaattctatatacagacgacacccgtacgtgtcgtacgcntgtgttttcgcgcgctaaaaacacatgtggtatccctatccctttgaacgcccctccctaaagatatagcgacttctctcgcttcaacaataaatatagcgtggaatctatagcgcatagacactacaacgatagcgcccctatcgaaccaaactccatactaggtgcggcattgcccaaaattgtgcgcgaagacattataattcgctacgcttcgatantctcttatgtgtacctttcagacgaaacgagtcatagtgtaatgtctgcgtacacccttcttttcgtaagataaacctcacaacttcttttcccatctttaaacacaaaaatgtcttcgcctcttaaaattttaactcatacgccagttgtcccacccaggtttcacaaccaggaaaaacccctaaaaacattccatgttgagtctcatcaccttattgccgtgattaccttcttctcaacgagagtgggcaccaaccttttgaagtttccccccgagttgcgtttgtggtacatactttgaagtgcgagggcgcccggaattgtaagaggccgaaaagcaccaagggcgaaggaaaaaccgctgccttgtaagacgactataggcaacccggtgtaacatattagccgtaaattttcctctagcgagggcactgtagaaaaagaagggcgttccgcgatttacacacattaatagttaatccggcggcgcaacaatatagagaacactctttgtagaagcgccatttagaggggtgtcgccataaaaagccggttgctagagctacctccgcagaccctg

SEQ ID NO: 531277 - DNA, 338 bp, Homo sapiens
ggggtcgctctagaggctcccctcttagcctgggcaaaactaggaaaaaacgcatacataggaccaatgaagagattctctcgacatcaacaaaatcaagactgattattacagaggactttaccaagaactgctgtgtttcccccatcccatctgctgcgcattcacccagagcatctagcaactttgtgtacatgtcaaatgtccagctcagcagcatcctagcgcaaagccaacaaaaaaacaaacaaacaagggaaaaaaacgggcacccacccaaacaaaaacacccccaagcccccgttccccgcaaaagtgtgttaaaacagtaacacccc

SEQ ID NO: 531278 - DNA, 638 bp, Homo sapiens
agcgggcgggaaggcgggggaggggagcctgcgctcgttttctgtctagctccgaccggctgaggcggcgcggcagcggagggacggcagtctcgcgcggttactgcagcacatggggtgtcagttgttggtccgacccgagaacggcttcagattctgctctgcaaaggatatgtaatattagatatggtgtgcctagtttatataaacagaatatggaaactgaacagcgcagaagaaaccttaccctaacactgtaaaccagagtggtgaatttggtagagacgccctgcagaagatagtggaagaggaacgaagcatttaaaagagtctagaaactactgatgagatggtggaagttgacagcattcgtgcgttcagagcgaagaatgctggggcgagtgattggaaaaggaggctaagaatagttaaggcatctccgatactagactacaatgccagtgtatcagtcaccagacgagcagatggccccgaggcgcatattgagtatcagttgctgatattgaaagcagataggagaagattctgacacgaaagatcatccctacctttggaaggagggcctgcgagtgtgccaatcatccatctgaaaccagccagctcccgctcgacatctg

SEQ ID NO: 531279 - DNA, 222 bp, Homo sapiens
gggcccgggccttttttttttttcccgggttaaaggggggccctttttttgggggaaaaccccccccttccccccccccctgcaaaaatttaaaccgcaaaacaaaagggggggggccccggggccttgggcccctttttaaaaccccttttcgggccgggccccctttttaaagggccccgggttttttgggccgcccggtataaattttttttttttcga

SEQ ID NO: 531280 - DNA, 473 bp, Homo sapiens
gcccaggctggagtgcaatggtgcaatcttggcttcctgcaacctctgcctcctgggttcaagtcattctcctgcctcagcctcccaagtagctgtgattacaggcatacagcaccacgcctggctaatttttttgtatttagtagagacggggtttcaccatattggtcaggctggtcttgaactcctgacctcaggtgatccaccacctcagcctcccaaagtgctgggattacaggcgtgagccaccgtgcctggttgccactgcatatgtcatacagagtagctcatctttgcacttttgattaggagtagtgtgtcatctctcacttgcctagaatgtcctacatccctatgcttggtctattaagacttagccagccccatctcctgtctaatgccttattacaccaaccaactagaagggatctcctcctactccagatccccatagtaatttgatctattggggt

SEQ ID NO: 531281 - DNA, 188 bp, Homo sapiens
gttgtctgctcagcaagaccctcaggtgtgcgaggttgtgctgctcctggctggtgagccctcccggctcgagtgcaccctgtgacagatgacctgaactggggatgcctgccgcagtgggcctggggctcccatgtcatccccctgtgatcttgtgtgtacacagtgctgtgtgggtcttggtactc

SEQ ID NO: 531282 - DNA, 923 bp, Homo sapiens
atgagtgtgtcagactagcgtttcaacagatggggcacttctggtggctcttcctcctgcacaatgttggccaacgagtgttgttattgcaggacaagtgtttcccagagggcgaaccccggtcaccaggcgtgccaccacgtgaatttgggcccctccattggaagccgctttccacgaaattcctgaggtccggcccgcccggagttgcaaaaaggggtgaaacccccgaccacccaacgagtcgttgcccccgacattaaaaagtcccagttcgcgggccacatgccggccgctgctaatgggagacacgctgccaaaacaaacgacagaaacacagggttgccagagcaacacccataccaaattcaggggcattaatacagactcccggcacccttttcacccacggagtacaacttgcgccccgtcccccccattggtcacaaggcgttgaactccccctctttaacgccctctctacttcgcgaggaaaaacaatttgcaccgccctaaccatttctctcaccaatcacccccttctccaaagtattttaactctagattcttcttaagtttctctatttataccccttggagagacaaagcattcatccattcctctatgctatgtaaaatagaagtaaagaccacacctgcgtcggcacccaatatttgtacacgcagcatacccattccacacaaactcgaataccacgtctgcccaacaaaatattctcctcaactttctcataacacgtttgattttctccacgtttatgaggaacgcttctttttcgtaacctcttaaggcaatttaaagaccgcatatcgaacgatccgaccaactctttcacaccttaaattgtttccccagaatcaaaagacaaacaacttacacaaaacaccacttctatcaaaac

SEQ ID NO: 531283 - DNA, 439 bp, Homo sapiens
  misc_feature (1)..(1): n is a, c, g, or t
nttctgtacaatgtctcagcttcagcacatacacgttgtcgcataggcacatcgatatctgcacatgttaaacatggtcatgcagaataggtgcaatctacactgtgcacaatgctgtggtccagtcacgtgcacacaacttatctcgatagtctgagcccttgatcttggcaatagtgtcatatatgtatcgaaaaggttcatgtgtgctgtcccaatggtgtccattgtaaagcccgccaatcacggcatccagtgatactaagcaccagatgtctgatgagcataagaggctctcacacagagtcccgtaagcagcttaacattcacctaagaatgagacgcaacatcctctaccgtaagcctacagtgcatatgcattcgaaggcgcctgcgtattcctattagcccatgtattatattgggtggaccacccagc

SEQ ID NO: 531284 - DNA, 903 bp, Homo sapiens
tagcaaatggcaacctgtgtggctatttttgttattttcatttttttgtgattgctgtcatgctttcgccactttaatgaatatcgcgtaatgacgcgaagaggtggagataaggcatgaaaattaactatccgttgctggcgctggcgattggcgcgtttggtatcgggacaacggagttctcgccaatgggcttgttgcccgtcattgcgcgcggtgtggatgtctcgattcccgctgccggaatgttaatcagtgcctatgcagttggcgtaatggttggcgcgccgctgatgacgcttctactttctcatcgtgcccgccgcagtgcgttgattttcctgatggcaattttcacgctcggcaacgtactttccgccatcgcgccggattatatgaccctgatgctttcacgcattttgaccagcctgaatcacggagcattttttggtttgggttcagtcgtggccgcaagcgtggtgccaaaacataaacaggccagcgcagttgccactatgtttatggggttaaccctggcaaatatcggtggcgtgccggcggcgacctggttgggtgaaaccatcggctggcggatgtcatttctggcaacggcggggctgggagtgatttcatggctaagtctgttctttctcattacctaaaggttggtggccagggggcacgaccctggaagtgaaacaaaagagcctggcggtattaatagcgtccgcagggttgcctggttctgcattgctgacgacgggtcctgggagcctggtgccattggttactcttctacacctattatctctccgggttctgcaagtatttacccacgcatcaccggttttcggcccggaatgcttgtgctgattggggtcgggatcctatcggaactatttc

SEQ ID NO: 531285 - DNA, 129 bp, Homo sapiens
tcaggcagccttcgggagccacggctttttttggtacctaccccagggcgtaccaccagccctttacggggggcaatttatttttacccacccaccaattcgcgtgttaacacagaacttcttctctgc

SEQ ID NO: 531286 - DNA, 129 bp, Homo sapiens
aacgaagtcaggaagggaatgtgtaatatgtggagttggaggtccctttgacacccttgaagtatacatgtgaaagaggcagttgaaaactgggtagtggatactgcgagagaggataaaggctgatga

SEQ ID NO: 531287 - DNA, 316 bp, Homo sapiens
atatggaatctttacagagactcttccaggcaaacaatgaagattaggcatagaaatgctgtaccttaaggttaaaatatactgtatcaccaaatcaagtttcactagaagtttatacgatttttatgtaatcaaaaatcaacttttggccgggtgcaggggctcacccttattatcccagcactttgggaggccgaggtgagtggatcacaaggtcaggagttccgagaccagtctggccaatatgctgaaaccccatctctactaaaagtataacacattagctgggtgtggtgggacgcgccatcgtgcgcat

SEQ ID NO: 531288 - DNA, 447 bp, Homo sapiens
  misc_feature (342)..(342): n is a, c, g, or t
tgtgcctggatggcgactcccacttccagtatgctaattacctctacaaaactctcaacccactctctgttaaaccagtccaacccttctttggcaaaggacgctggctttgcatttctctatcagctaccacttacgttgccactctcattcccacaaaaaactgggtagttactagcttaacctaccaccctcgtaatgaaggaaaaagcccctcctaactcctacatatgcagtcattggccaacttctccatcaatgaaatgaccgaaaataccctgacaggtcgtgcagttcaacttttacgctcctacatgtccagcctcacccattacacaagtnatgaaaagcccatacacggccctgtgactacaaacgctgtcttaactttccaagcccctttatgcatccaacacaacctgtcatcaggcctacctctaggtcacc

SEQ ID NO: 531289 - DNA, 516 bp, Homo sapiens
cacttaccccttactgctgcagcgtgggcgctgctcagctcagctctgaccacacctcgtctacaccagggccacacaggctcccaggccgggcccctacaagaaggagggccaggccatgccgacgtgggcacgcaggcgtgtgcaggcagacggacaactggggtgaggagggggccccaaatgggaggagtgcacgggctctgccaatttgggtgaggggcaggactgtacaagaccccctcacaccctgactgtcctggtcctgccttccagagcctttctgctctcctcagtcctgctcctcccatgctcctataggcagacagcttcctcctacttccacacctcctccctggcagacgcacctgtccccctcccaccacctgctcccttttcagcccccacgtgcgaggccttcctgggaggtgctcccaccctacccttgcacaggatcctgggctcagatggaaacctggtatctacttgggcgccactgatgagaaagaattcaag

SEQ ID NO: 531290 - DNA, 807 bp, Homo sapiens
  misc_feature (530)..(530): n is a, c, g, or t
gagatgggatcgaacccagcaagggctggggcgcttgggaggctcaaggctccagcccagccttgggagtccagcacagccaagccagccagctacacctggcctgggccagagcttcgatcatgcagcctgcagagctgtggaagtgcagaggcaaggaatcgtagaaaggattttggaagtgacattggcctccgcttgaatgcttctgctgacggggagctcactacctccagagacagcctacattgtctctgggcatctctatgagttagcaagcacattctcatttttagcggattctgtctccctatcaccaccacctcccacgtccaaacccttccccatggtttccaccaatgacccctggaaccacacacaccgcacacatttatttgacaaacatttattgagtgcctactgtgtgctggaccataggcatgaacacggagatgaggccagacctcttgcggctgtctccttagaaactgaggcatggagggagaagggaccctccaggcctgcaccgncaaaaccagaggaggcagagaacacgcctcagctctgcatctcctgcgtgtcagacctcagccatcatcccaacaacgtggtggggggtgtcatgattatcttcaatttccagatgagaaaactgaggctcagggggtcacggccctgggtcgggcaccatgcaggctgcatgagccatgccttgtcttggctacatgatgggttcaggggtgatcacgtgacccagttcaggccagcgagtcatcagtgaaagccaaagctggccccttttcctca

SEQ ID NO: 531291 - DNA, 345 bp, Homo sapiens
cgtccttaagcctgggaggtggatggctgcagtagcaagattgttccactgtcctccagcctggtgtgacataatgatacccaaccgaaagaaagaaaggaagaaaggaagaaggaaagaaaggaaagaaaagaaagaaggaaagaaagaaggaaggaaggaaggaaaggaaggaaaggcctgctgagggcctgaactttactgttcttgctgggagtgttgttgttctggagcttgctgttcacggttctggagctttctgctatgtgaagcagaagcctgaaactgctctggggatgtgtagctgagggcttagacattgttggggcttaagggacccttggg

SEQ ID NO: 531292 - DNA, 162 bp, Homo sapiens
tctaggggccagcgccgcaagatggcccaggagaaccccaagatgcacaactctgagatcagcaagcggctgggcgcggagtggaagttactgactgatgctgagaagcggccattcattgacgaagcaaaacgcctcagggcggtgcacatgaaggattac

SEQ ID NO: 531293 - DNA, 86 bp, Homo sapiens
tccccaaggttgggggcccttgggccctgggggggggtaggccccttttaggggggggcccgggccccgattcggaacccggggcc

SEQ ID NO: 531294 - DNA, 200 bp, Homo sapiens
agatgggaggatgacttgaggccaggattttgagaccagcctgggcaacaaagcataaccccatctctacaaaaagatagaaaaattagctgagcatggtggtgtgcacctgtagtcctggctactcaggaggtgaagcaggagggtcgcttgaacccagaagttcaggacttcagtgaactataatggcaccactgcac

SEQ ID NO: 531295 - DNA, 521 bp, Homo sapiens
tgtgtgtgtgtgtgagtgagagagcgagtagtgagtgagtgagtgtgtgtgtgggggggactcggcttgttgttgtcggtgacttcccgctccccttcagcacttggctctccccacgacgatgcagtggccgatccgtgaggcgctaggatattagcgataacgactgatcatcgaggtggagagcgacgactgacagactggctcatcataagtgcactggaacgaaaacgtcggagaccgatcgaaagacagctttcacgagtttgcgggactctagtcccatcactccaaggagagaaggcatcccgggcccaaatcctagacaaagccacagaatatatccagtatatgcgaaggaaaaagcacgagacaccagcggagatattgacgcactcaagcggcagaatgcgtcttctggagcagacgaagtccgtgcgactggagaaggcgaggtcaagtgcccaagtgcagaccaaatacccctcctcagacaagaggctctacacaaacgccaaggg

SEQ ID NO: 531296 - DNA, 804 bp, Homo sapiens
caacctcccctttttcccccgggttcttaaagcaccgtgttgcaaacataccccctaggagcccccccacttctatggtcccgcaccatttacttgaaaacctctctctagtcatcccggctgtcatttcacccatgcccctctatattataaaaggcttaaaaaacacgactgtgcactatcagacgcagccctccttaatactgtattgtcccccagctccatcatgtttctcaagcccccaataactttgcgatgcactacccctcctaaatccccctcccctctttgggggtaccctactgtccgactaggatttttcttggaagactgttttgagtttcaggcgccccttcattgtggtggccctcccttgcagcttgcccgcctatggatttggacgtattatcattattggcgtctcgcgggcgtcacccatgtggttacttgcgcgccgtcgatgctctgttaccccctctctgtggagcggccggcgacctttgcccgcgctgaggggtcccccgcgcagaccacccgggtgttcctcacgcccctcccctgcgcccccgccaccgggagactcctctcgttgttcgtctttcgggacactcccacgctttttccccggagttttggttggggggctccctcttgcgtggccagccaatcttctgtggcggtgcggtgtgccacaggggtactcctttgccacccgctgtgggcccgaagttcgccgaggagacccgtagatttcgtcctccctgtaggcccagtaagctggggctaccagcagcccacataaca

SEQ ID NO: 531297 - DNA, 315 bp, Homo sapiens
caaaaatggggcccaaaacccccccccccccgcttttttgggtttgcttcccagggggcctcaaacactccccccccccctgtcaaatttgggggaccaaccccagtgggggtgttaggtcccccagttccaaaccagtttagggacccccctgccctgtttttgggaaatccccccccagagaagcaaaaagggaaaaatttcccccccttttttcccctggccaagaccccctttatagggggcaaatttttttcccgtttttttttaggcataggaatatttgtttaaaaccttataaaggggtttatccta

SEQ ID NO: 531298 - DNA, 166 bp, Homo sapiens
ctgtaggatccccggtagcgcggtctctcctgatctttgccacagggttgtcaagactgctccagccagatggaaaagtgacaaaaggctgggatgaggtcgacatggacattgaatggcgggccctaggtggactatactggatgtgtgagagagcagcctatac

SEQ ID NO: 531299 - DNA, 192 bp, Homo sapiens
gaggacctgagcttacgaggcactatatctatttccatgtcctctttctacatgcttccagtgaaaaggaaaaaaaaatacatttttagttttcaaaaatcttaatcatattacattatttactgcacttttgtctttgtggtatcatctttctctttgattcacccctcgttaagcttgggtaccggagct

SEQ ID NO: 531300 - DNA, 308 bp, Homo sapiens
tggatcccttcgatgtgggctagagggggcgcagctcaaacctgctttcctttacttttacttattatttttttcttgggacgagagaagaacagagttgtcgattctgccctatttatgtttctactcgggaacaactgtgggtggtgtgtgtgtgtgtaccctggtgtgggtttttaacagaattgggaagaagaaaaaaaattctccgcccttttcctcgatctcgctccccctttcggttctttcgaccggtcccccctccttttttggtcctgtctgtgttttgtttggctctgagcccactt

SEQ ID NO: 531301 - DNA, 982 bp, Homo sapiens
ggcgctgcacgtgctgggacagccatggtttcagacgacagatgacttgacatcttctggcttcttgtagcttgatgccaacccaattggtggggaaagcaagcattacaaggcatctcagcttcactattatccaaatgcatagcatgccgttgcatgcgctgcctgggcacattcgccattctattccatgcaatcgttccaacaaacttgctgtgcatagcaaagtccaccattcaagaaagccgattccttatatcctggaaagaactggccacgactctggacgactactatcggagaccctggcaaccctcctgaacttcaatccctctgggagtacaagatggcacacatacgcaaccttccaaccctcagccaaaatgcacgctccattcgctcgacagacgatcaacacgcactctaactgacccaaacagctgaccctaccagtggctcaaacataccagcaacctacagctgcgcagggaatccccctggaccgaaaagcccctaaggccctacactgccataacgacatgacacacaggcaacgttcaacaagacacaactcagcgcacactgccactccacggctactgggtggcattacaggctgccagcaagaccagcggccgccacgccagacatacatccgacccatccatgaactggccatctccggcaggcacaagcacaccagcaaccaccccgcaagcgaccgccccggcggcaccctagcactccacgaccacagcggctactcccaacaggcctgcgcacacaaccgggaagacacctgaacccctgaaggtgccaacagaatgccaatccgcaccggccgcaaatggccaggagggggatccagcccgaccaagactcaagaacttcagacaacccaacaacccggtacaggcgcaaaagacactctgcccaggaatcgagacgcgcggccgggcacgacagccagagacgcaaaatg

SEQ ID NO: 531302 - DNA, 211 bp, Homo sapiens
gatgatcttgatgtatcccggctgtcagattatcacacgcacagcagcgaaacgtgctagtagatttgagatcagtctccattcacttccacgtagcagcacagtccagagtgaccggaggcagagagctcttgtagggtcagctttctaatacgcatgtcaagtgaaaaagaaccctctaacagcgcactgatttgataatgtgataacc

SEQ ID NO: 531303 - DNA, 235 bp, Homo sapiens
gactcttagaggatccctctctgctcccagtattcgacaagaatgagatcaatagtaactgctatacctaccgtctgtcgggcagtctgtccatctgcaataccaggctagcatggattagcaggcgcggcttctggtagtgcaggagcagactcgtaggggcatctgcagtgctgccaggaggatctccgccagttcatggataacaggccttctgttgtccacacgaagcccg

SEQ ID NO: 531304 - DNA, 236 bp, Homo sapiens
aagtaatatagtcgcaacactatctaacgttaatagacctaagattcaccttccaaccatctgctagatcgactctatcctatagttgacattctcgatgacatgaccttgacatgtcacacgaaggtgctgatcgcactcttcacctagcacgtggatctgcccatacctgcagacaacctcaacctgcgaacttcgccgaagctaccgcactactcttcacttgacacgaggca

SEQ ID NO: 531305 - DNA, 135 bp, Homo sapiens
aagtctgcagcaagcatcacaaggggcagcaacatcccatccattcccagcccaggtgcaggggtcagtgcattgtttgtttttcttattttatttacattttccacacaccatgccaaacaccagttcagcaag

SEQ ID NO: 531306 - DNA, 439 bp, Homo sapiens
tactcatagacggatacccggatggcgctggctgtggcgaaatcacgcgttagaatatgatgcctctagaaagctatactgaagcagatgtctggcgagctgatgctggcaccacgtttgctgcgtatagtctgaaatacatcaaggctcattccccagctgaggcctgggttagaagcactttctttctcgaggggctttgagacgtgtttctcattattctgctagcttttacattttttcagagtactgcatctctgccctttatcgggaatttgatactctataatatgtagtcaatgttcacacgatatgtggtgcagtgatgttttcccctaggagcctgtgggagtgtgagaataatgaatgtgcgacctctggcaatcggaaataaagtaagagtataggtgcgcgctgggtaaacatccttgtgcttaca

SEQ ID NO: 531307 - DNA, 964 bp, Homo sapiens
gatggttccctgcgggacttggccatcaaatccgcgatctgctatgccgcgctactgtgtcgcacggatggcgccgtagggcgcagggcgatgtgccccctgctcggaggtaagtcgtgggccttgcctcactcccacaggctgactcatgcaggtctcagttacaatggagatccttcgccaggttaggaggttgaagcacagtcgctaagaagtgagatctgctgacgatcgggcggggagaagaagggctcgcaggatccacaggtcgcctgcctaccccagagtgcttcgaccgcctgcctttgtgacatcactgacggagctccaaatgctggggaatgtgtcaggctatcgttggaggaactcccggggatgggcagagcagagtatggggcgagaaatggatcgagacactttattcactcacatttcgggtaccgagaggtgtctttgccgtgcatgtttttagcgggtccctgtattggtggcatcttcctcattggtaaccacacatcaggatcttgtagctttgccgagcctatgaagaagattggctatcgaatgggatgcttgggacaaggcgccttcgaagtgccatcgggcgtactttgggcgaaattttccatgctgccttttcgaagatggaccctgaagggttatgggcgggtgatcacggattatccttctcggaggcagctgatctcagtctcagtccagttgaactggagtcatttgaccgccttggactgtccgataggtttgtggacagcagactacattgtcgcgtctacttacatggggggacgacctggttctggagtcacagctgtgcgggagaccatggtacgggacggggcataacggagcattctaagccgttaaccggaattgtggttttcccacccaccaagcgggcctccggtccaacttggggaacactgctcttgacggattaccagat

SEQ ID NO: 531308 - DNA, 483 bp, Homo sapiens
aacataagaaggtgacatgatggagacaaacactactgatgatgagaagtccactgccaagagtcttttggtgaaggctgagaagcgcaagtctcctcccaaggagtatattgatgaggaaggtgtgagatatgtgccaatgcgttcaaaacccccccatactttgcttccgcaatatttgaacccctgtgaagcgtgttaccaccactttcagaggtacagtgacctaccggttaaaaaagaaaaaaaagctttgcttccggaaaatactaatttgcaaagggtttcctttttagctccaggttgagaagataccctttgtttgcgcactatttaagtggggatagaaaacttgagtcttttaacaacttttatacccccggagggtgttcccacgaaacaacctctgcggtatggatctttctcggatagcacaatgcacccggtaaatttctctgggaaacattgtatcgaacatattta

SEQ ID NO: 531309 - DNA, 137 bp, Homo sapiens
  misc_feature (7)..(7): n is a, c, g, or t
  misc_feature (48)..(48): n is a, c, g, or t
cccaaangcgtctgcctctggtttcctagtccagtttaggattatttngaggaagggattactgatgtgtgaattcacatctgggcttcccctaaattgcaagtaagggcccatgttaaagattttcccctaaactc

SEQ ID NO: 531310 - DNA, 587 bp, Homo sapiens
  misc_feature (33)..(33): n is a, c, g, or t
  misc_feature (86)..(86): n is a, c, g, or t
  misc_feature (112)..(112): n is a, c, g, or t
  misc_feature (117)..(117): n is a, c, g, or t
  misc_feature (126)..(126): n is a, c, g, or t
  misc_feature (134)..(134): n is a, c, g, or t
  misc_feature (139)..(139): n is a, c, g, or t
  misc_feature (142)..(142): n is a, c, g, or t
  misc_feature (153)..(153): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (195)..(195): n is a, c, g, or t
  misc_feature (206)..(206): n is a, c, g, or t
  misc_feature (209)..(209): n is a, c, g, or t
  misc_feature (248)..(248): n is a, c, g, or t
  misc_feature (258)..(258): n is a, c, g, or t
  misc_feature (281)..(281): n is a, c, g, or t
  misc_feature (286)..(286): n is a, c, g, or t
  misc_feature (305)..(305): n is a, c, g, or t
  misc_feature (314)..(315): n is a, c, g, or t
  misc_feature (317)..(317): n is a, c, g, or t
  misc_feature (323)..(323): n is a, c, g, or t
  misc_feature (325)..(325): n is a, c, g, or t
  misc_feature (339)..(339): n is a, c, g, or t
  misc_feature (348)..(348): n is a, c, g, or t
  misc_feature (369)..(369): n is a, c, g, or t
  misc_feature (379)..(379): n is a, c, g, or t
  misc_feature (414)..(414): n is a, c, g, or t
  misc_feature (509)..(509): n is a, c, g, or t
  misc_feature (517)..(517): n is a, c, g, or t
  misc_feature (564)..(564): n is a, c, g, or t
ttgctcatgttcctagcatcacaaatctgagtnacaattttgcttctcaatgaaaaacatatactctgaaaagtgattaggaagtnctaaaaattttaatcatttatagagnatctnaaaaatccntatcaagnaaganatnaactttacctntataaatctttgtgtnanangaaaaaaaaatcaaggcatacnaatttcattgngtnctacatttttaaataccatcctttgtctccgttaaaagnttttcatccntttattcaaaaaccttttaagtncaacngtccgttttaagggggggngggggggtnntngggtgncngggcgaggcgttgncttggctgngacggggtaagagctcaatgngagtccttgngggcctcccagtcatgcctttccgtagatagggancttcatctttgttggtcatcacgcctgctatgtctaaatgtgcccacttaggatgagttacgaattctttcaggaatgctgcagctgtacatgcncctgcggntctgtattttccaatgttgttaacatcagcaagctggcaatctacancctgtccttgtatatgttcgaag

SEQ ID NO: 531311 - DNA, 304 bp, Homo sapiens
gttatccatggacacatttaaggagtccttatcattaggtatacaagtagttatattgtaaaactgatgtgtacctatatctttggggacaggacatcaatcaatacatgcagattacgtagtgtgtggacagaaggtactttcgacattcagttttgctatatagacacagaatgaataaatgaacttttaacttttttctaatttttgcaagaggtaagtcaaagattcaatttgattcttctagagaggggaaaaaggagttgaaagtaggtcttcatttagcagagctgttgtaactgga

SEQ ID NO: 531312 - DNA, 652 bp, Homo sapiens
agggccgactcacccggcacgaggtcaccttgttgtgaccgccaccatggagtccaggagcggggcgggcagcttcaggcaccgcagcgtggacagaacgctgcatttcttgagcttcgcctcggggtggctgacgtccctcacggtgcaagatgagatcctgtggggccgggccgtggggtcagagcttcggagcctcttggtccctgaccccaagcttgcagacaggcccaggagaggggctcacacgagctcccaacgacaggctgggcatgggaggtacgcctgtgtgcaggcccctcggacaccccaggacgggggctcctagaccaacagtggacgcgagcccacccggctgcacttacccaaccttccaagccacaggcagcagctccgcacccccagacccacacgcaagggggtgccatatatgagcacccaaccaccacccacccacccagggggtcttcattcaaagctttagggcggcttcatcctcctgtgaaatgtcttttaacagcggaattatttcctctttaaaggatgctttttttctcacgttcaaaaaaaatcttacaggcaggctccttacacaaaatttgaaaaacacagggaaaaaaaaataaagccgtgtgtaattctccaacttaaa

SEQ ID NO: 531313 - DNA, 266 bp, Homo sapiens
ccgctgctgctccctcttcactaaaaacacaaaaatcagccaggcatggtggtgtgcgcccgcaatcccagccacctgggaggccgaggcaggagaattgcccgaatccgggggcagaggttgcggcaaacagagacgacgccactccactccagcctgggtgacagagcaagactccatctcaataaataaataaataaataaataaataaataaataaataagcaagctgggcgtggtcacatgtactcgcggtccctgctact

SEQ ID NO: 531314 - DNA, 765 bp, Homo sapiens
gagaagaatctggatactctggagaatacagagtgaagaataatgagtgattaatgtaaagtttctgaatccagatttccccactgccataagtatgaattccaaccctctcttcactgattttctggatattgattgggagactggaaaatcccacgtagacttcagggttcttctgttgagctaccatgctgctgttgatgctactctcctcagcagcagatctcttgctgactgacataccctccccactccatgactagccccagctggaaatcttatttagaggttaaataaaatgtgttccagagatttaaagataaatgaaatattataaatttgttcagacccgtagaatgtacaacacaagaatgaaccctaaggtaaactgtagacgttgggtgatagtgatgtgtcagtgtagattcatcaattgtaataaatgtaccacttttggtagtggatgtggataatgtgggaggctatgcatatgtaggatggggaatatggctgtaccttgtggatttgtgctgtgaacttaaaaatactctaaaaaatagtatttaaaaaatcttaaaatagggcggcacggtggtcacgtctgtaatcccagcaattgggaggtgaggcaggtagatcacgaggtggggagatcgagaccatcttggccgggggggggagccggtctctggtgaaatgcaagggtggtggcgggggggtggccgtacacaggtggcgggagggagggggaaggtttaccgggtg

SEQ ID NO: 531315 - DNA, 129 bp, Homo sapiens
ggctgctctgaggatccctgcactgttgttcatacccccccccggatacagcgaccaagttttgaacaacagttggaggtttgaacaacagtgcaggtttgaacaacagtgcaggtttgaacaacagtg

SEQ ID NO: 531316 - DNA, 996 bp, Homo sapiens
gaggagggggataatcagagctgaggcgggcactctgactgagtggcttatcccagaacagcccaagggccggaagcagcacggtggcttctcgagctcctctgggcctggagtgacacaggaaggatctgctcttcgctctgtgctgcttgccagtccttgcagttggagtttaatgcagaggtgacatctggtagacgcctcaggtgaaaatctggtgtattaaaaatgtaacttctgtcacaggctcacttccgtgtcttgtatggctgggatacgatgccccatggggtatgggggtgctgatttaccctcatgcgcatggtggtagggaacggcttggtagtcttgtaactggccccaggtaattatggccaggatgggacagggcgaatggcagcgtatatggacgctggggcgagcagcactctgtatggcctcctccgtctctactgaattcaggggtgggactagtgccccatatgctagagggagggccactatgtactggtcgtgctacccctctggtacgagacaatcgcactctgtaaacatagatcattccacatttatatcctctggcacgtgggtgctagaggcttccctgttagtgatgggactacctagctacatgattcttcttaggtgcatgcgactaggttgactatctatgacagaaaaggctatctttctaattcacatcaacaccacggtctgagtggggttgactagtcgagaaagggtggggcttaaaacaagccaagtcagacacgggcgggaaaggcttcacgtgacgaaaaccctaagagtgggccagagtgggaggatagccgccccacaaagaggcctggataggggggcggggaaaacgcgcgcaccggaccggagagaaccaggcagtttgtcagcaagagcacgcggggacgcaacaaagggcacacaaggcaggaaaaaggcccccgagatgccgaccacagaacgccaccctagggcgga

SEQ ID NO: 531317 - DNA, 546 bp, Homo sapiens
accattacgagatcactgtgagacgcggtgccgggatctggtaggacggggcctcggggtggtgctgctgttgggctcagcccgtccctgactgccgtccccaagtggggagaacgtgtagggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccaggtcgatgagcggatgcacatgcacgcgggccactgcaga

SEQ ID NO: 531318 - DNA, 390 bp, Homo sapiens
  misc_feature (11)..(11): n is a, c, g, or t
tcacttttccnacagggaagtccatggctaactctaccctgtacctgaatgctgatcacttactttcaggacaggggctgatagaggacggtcacggggaaggatccaaatagtgacgaccaaacgctactacgaccacaagctaaaagagagagcaatttaagagagagttataaatgaacacccacttgctttcatatgacaagcttgtagtcaacgtggtgttaaggaggtgacagattcctatattatagcctagaacccccaaaactaaacaaatacagtggtttttctttcctctcagtaatatgattgctgtttacctggtgcaggaaacagggtacgaatgggaggaagagacatgctctaagatgcataatggtttagtta

SEQ ID NO: 531319 - DNA, 123 bp, Homo sapiens
atatggatatcacccgcccgatcatcgctctcgatcttcccagcgccgaggcagctcttgacttcgtaggtcgattcgacggggagaaccttttcgtcaaagtcggcatggagttgttttacg

SEQ ID NO: 531320 - DNA, 531 bp, Homo sapiens
tggtacctattctgtcacaggcggtggaggaggaagaggaggatagatatagtagggtactggagaaaagaataaagaagaggatgatcctataggaattcatgactattttggagtaagtgtgtgtatgaatgttgatacagtcattcttaagattgataattattatgatgctattctgatactcttgacatatattaatgcttaagctgtgcagagtcccggcgagccccatcagttgcgcacgagaatattcatgtcgaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctca

SEQ ID NO: 531321 - DNA, 179 bp, Homo sapiens
tgtcaactcacaagtcatcatcagtaacaaatgatccacgaaatgcaagcatgcacggagaacacaaactcctctgtccaggcatgtcaaggctttctgctcctgcttctcaccctctgccctcatgacagtaccggctagaaccagactctctgttcaaaccccaccgtcggccatga

SEQ ID NO: 531322 - DNA, 686 bp, Homo sapiens
  misc_feature (55)..(55): n is a, c, g, or t
gacccaaagtgcaattccactcctgaagggtttcagatacataggaaaggggcanctattgttgtaacatcctgaccaaaaagattgcccttccaaaagcaaactatccggggtcatgaacaatgtagtggtgctgactgtgaaacaccagtaaggtgcaaaagcctccgatgctggccgaaaaccttggggaacaagcggcccctgcttttaacctttgaagccgattaaacaaaccgtccacaaacgtttcattgtggacactccacctttcctgcagaaaattgcacactttctaggaaaggagggcgaattctgttaccagtgctccctggttagcttggtaaaccacaggcctaggccaccaaagaacccatgaaagcttgtaaggattgtttcccagcctttggaaaaaagtctcgcaaggcctaccaataggaaacctggtttccccaggacggtaaaaaacctgtttgcaccaatcaaacctccttaagcctaatacctcccctttaaaaggctccccgccttccttggggttcatggcaaggaaattgaggtccggaggctaacccgcgggttttcctttgcggtgggggcaaacccacccccgggccaaaagtccgaagtttctttaaataaagttcatcctcccgcgcgcttccattgattgaaaatggcaaaaa

SEQ ID NO: 531323 - DNA, 464 bp, Homo sapiens
  misc_feature (292)..(292): n is a, c, g, or t
ctactctgggaaggtgatctctacggccaccggccacagggctccgtccctgagctcctcacgccgcagtagctaaagcacccttagctgcaaggaaaacacaggtgggaaaacagtttcttaatgaggaatatttgtaagctctgttggcgctcagcaggttgaagattgacaatgaaccacctaagggtgcagatttagcctcagggtgcagctcggatccctgggttcagcggaggtgggtgccgaagcccgaactgaattggcacgcaggtccctgcccagcgctganccgcgcctcgggaaagactgaaagctgcccgtgccgctgagcatgcccagtttctgcctgagtccctggagggttgcaagattgggggttgatttggtctccaggtgccgtaggctgcgaggaagatgagacggccaaagatgagaaggccaaagattgcgagcgactagta

SEQ ID NO: 531324 - DNA, 1244 bp, Homo sapiens
ggagagagagaactagtctgagtttaaatagtggtttctaggaaacgaaattccactccttgtaggccaaggctggattgcaagggcttcctatcagactcacatagaaacctctgccttgcagtgttagaagcaattctcctgcctccagcctcccaagtagctgggcatcaacaggactattgcgccaacaaagcccggactatattataatcggtattttaagtaagagacggagatttctccattgtgggccaggctgggtctcaaattccatgacctcaggtaagatcctcccagactactgcctccccaaagtgctggagattacagcgctctagaagccatctgtggccccggcaccaacatatgtggtataatacacagtacagaacacagggtgtttaaatcaacgtgagtaagggaccaggatggaattctatgaaacttcaccgaacacaacgaggggatcccaaccacggagatcaaataccaacccaaaaatggcatgaggacacaacaggcgacactgagaggccaacacaaaagaccgaggggaccacgcaaaacaaaacgccgttcaaaaacaagggagaataacgcacaacttcagggcagtgaagtgtagaacaaagaccccccaatcgagaaacccgagggaacaaaaaacacagcaagaaggaggaaaaacaccccgatggaggctactacagaaacacaacggcacagaggaacataaaaggagacacccaaaaacttgcgagaaagaaactgcgaacccccaacagacggcaacacccccgagagagaactcccacatcgaacgagtggcagacacagcgcgaacatggggaaacaaccaaagccaaacaacagaagcagcccaattgaaacaactacacgacacacagaaactatgagaacacaatccccagaagagaacgaacaccgagagggagcgcccaactcaggaccaacaacccaacctagaagagccagcaacacacagcactgagggaagcacctaggagcgagacagaggagaatcgatagaaacaacgagcaaaactgaagaaggaatcgacacccatagagagacagcgactccaaacaggacgacagacacacacaaagaagatgagagcgcgacgacgaactcaatacaaccgcccgcggagagccacaggagatacaaaaaatgcgtaaacatcgaggacgagtgaacgcaaccacaccaacacaac

SEQ ID NO: 531325 - DNA, 376 bp, Homo sapiens
ataaactttgcgagtgtgttgcttgcaacagatatagagctgaaatgtaatacacttggttttaatgaacagatcctgttgactaagcatgcctgcagaatagcatagccccaggtggaacctgatcccgtggctttctagtattcattcaccgtaatattagtcttctgccttgtatgaggattgggcctgctcccataaatttcttttttctgttcacagatagataatgtcatttgaggtaatacaatagtcttgtttcagaaattaaaactgtccagtttaaattgttaattaactccacaattttccttccagggaggtttgtttcaggcatgcacagttgtttttcttctgtaaagtgaagtcgacgcgg

SEQ ID NO: 531326 - DNA, 609 bp, Homo sapiens
gagagttgacccgtgagcagagtacgaatgccactgaaagggatcgtgagcagcgacagtgacctgagcatgtgctagcgttgccatgtggtctcacaacaatggactggatgggactgattctgaatgctgagataagcaaatattgaagaaatatctggaggatctatatgcatacaggacatgagaagataatggggaaggaagcaaaaaactcgaaacttataccataataagaactctggaccagatgagtgtgatgacgggatttcttgcgaaaatcacaaccaccattgatatcacacaactgataacgggcccagtgcattattaccccaaaagccaaactgactcacacattacatcacacgccacacacatgtgacatcattgagcaacacaacgaagactgataccgggaatgaccactgcgcgtgaacacagacttacatcgagcaatgggaaattgcaaattctatcaacaaggcaatgacatcgataaattaatccccaagtcgaaccatactcaacccaggcaggaccacagcccctcgggaaaccccatactaaaagggcgcgcaaatgcttgacctatgaacggaaggcaag

SEQ ID NO: 531327 - DNA, 366 bp, Homo sapiens
  misc_feature (34)..(34): n is a, c, g, or t
  misc_feature (131)..(131): n is a, c, g, or t
gaggaatccaaggatgttgtggactaccacttgntaaagagattaccatgactaaatggaagccaggcgctaatagtcaagactatgggtaaaaggcccaatcacaggcccagagacctaagaagacagantggttttgggagccaggcccaggttctgctgtcctgtgctgtctcaggatgttccttcctacatccccaccacttcggctccagctgtggctcaaagggccccaggtactgctcaagctactgctccagaggacgcaagctgtaagccttggtggcatgcatatggtgttatatccacaggtgctcagaatgcaataggggttggagtccccacaactggtgcctactagggcag

SEQ ID NO: 531328 - DNA, 880 bp, Homo sapiens
cctgtagtcccagttacttgggagactgaggcaggagaatggcgtgaacccggtaggcggagcttgcagttagccgagttagcgccactgcactccagcctgggcgacagagggagactctgtctcaaaaaaaaaaagttggcaatttctctcacacttccaatttatctcactcttaaaggaataagagaaaatgtttggttgttagcacagagaggtgtctttttctaagatatgcctcagccttggtagagttatttgggagtggaatccgcattttttgtgcccagtgggtttgggtttaccccaaaaaaacttaggttcctttaatcacagtcattcttgttctcattctccaattggttcctcataagactcagagagagctttcagtggtcttaagtttctgttgtatagaaatgctgtggtacagcctgtcctgtggttcggggtcatttatatttaatcttttcaggctcccccaagttaatgtgatcaatttttttttgcacagttaaaattagttactgatggataaacaattttatgattagttattgtcagcatgtatttatgtgtccagtacgtattgtggcagcctgccaatgtaatgtaaggagaaaatagattaagtaatcaggagatctggggttaaagccctaggtttactacctgagaagtcttgtacaaattatttaaggaggctgtagggaaggttaatgtcctttattggagcatttactgtgtcatgtctttacatgtgttatttcatttattacttataagagtcctttacagtagcatgtaatttccccatagagatactattttccaatttttggttgaagccagtgacaggtaaataattaaccaagatacc

SEQ ID NO: 531329 - DNA, 183 bp, Homo sapiens
cagtccatggatacttgcccagggaaggaaggagaacagccccatgtgcctgtcggtgctcctattacctaccacagaaatcccctgaaattaggtattccccaccaaatacacatacgctgacatccactaagcaagtgacttttaacaacaaaactgacattcagagggaaaggaatcatt

SEQ ID NO: 531330 - DNA, 305 bp, Homo sapiens
  misc_feature (131)..(131): n is a, c, g, or t
  misc_feature (151)..(152): n is a, c, g, or t
  misc_feature (170)..(170): n is a, c, g, or t
  misc_feature (195)..(196): n is a, c, g, or t
  misc_feature (234)..(234): n is a, c, g, or t
  misc_feature (268)..(268): n is a, c, g, or t
  misc_feature (280)..(280): n is a, c, g, or t
  misc_feature (304)..(304): n is a, c, g, or t
cctaaaactttacagcatctcttctcagttaaaaagtactctctactaaaaatatgaaaaaagtagctgggcatggtggctggcccctgtaatcccagctagcagagatggggtttctcccatgttggtcnaggccggtcttgaactcccnngacctcaggtgatccacnctgctcagcccctcccaaagtgttnnaggattacgggcgtgagccatctgcaccctgtctcacnattatatgagttctatgatgtttatgctgttgtntggaaaatcctnttgttatcacaaatctaccgtggng

SEQ ID NO: 531331 - DNA, 369 bp, Homo sapiens
  misc_feature (6)..(6): n is a, c, g, or t
  misc_feature (15)..(15): n is a, c, g, or t
  misc_feature (45)..(45): n is a, c, g, or t
  misc_feature (66)..(66): n is a, c, g, or t
  misc_feature (367)..(367): n is a, c, g, or t
ttgaanacccccaangatttaggggacaacagcagtggctaaggnaattcagccacagaaactgancgggaaatgccacttgtattggctgtaaagaaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccancc

SEQ ID NO: 531332 - DNA, 158 bp, Homo sapiens
acgactttggaagctaagaccgtgtgacgcttggactgacttctgagagttcaagccaacctgccctgtggccttctcgtgactttgttacggacctgacggactcttgtgcctgccggacacttcggggactcctctacgacgtcgaccctgcaggc

SEQ ID NO: 531333 - DNA, 497 bp, Homo sapiens
accattctgacttcctgtaatgtgtgaataataaacctctgttggtttaaactactcttagttgggtttctgtccttggagaacaaacatgtaatgggtgtagtcctcctcccctggagtgactgggtcaggagcaagataagaaggggaaagaaaaagaagagtctggttaacagttactctgaccctgtaggaactctgtcccataatttggaaatcaaattatagccgtgtcttatttttccaacctaaatttttaagactgcagataagtactgcatcccataatacacagtataatgtcctgtagttctctctctctctttatcttctttcttcttcctttccagactggaaaaaaaaaattttgtttataatagattgtgtatgtcatgtgttgtgatagattatcaagatgatagaggtagctcctgcctaagagaatttccagcttagtagaagagacaagcaaaataataaacatacatatgatatgt

SEQ ID NO: 531334 - DNA, 150 bp, Homo sapiens
cagctctcagctcaagggcaaatggacacagctttgtgaacctgatcaacaaggggtgggggaacttccttgcggagggactctattcccattctgggcactgttggctctggggctcttggagtgtacaaggacacattcttgggggct

SEQ ID NO: 531335 - DNA, 86 bp, Homo sapiens
acatctgtatatttctgcgcacatgaagagcgccgagctcctacaatgagcagttcttcgggccagggacacggctcaccgtgcta

SEQ ID NO: 531336 - DNA, 146 bp, Homo sapiens
tgcgaattgttgaacgtgagcctgaagctaaacaggcaacatctgcaaaacaacagcatgtggttgtccaaccatgttccatttggcatggcacttggcaaggcactaaagcatgcatatccatccatattgtgcaacattggcag

SEQ ID NO: 531337 - DNA, 155 bp, Homo sapiens
agcagggtaggcagcattgtcctttagagactttactcaagtcatactttatacacaaagaacgagcaaaggggggaaaaaagccaaagtccaatttttaacatgcaatgtatattccctggggatgggacagaaaaataaacagtttaaaataa

SEQ ID NO: 531338 - DNA, 545 bp, Homo sapiens
ctcttgagtatcccgcttgtaccctcttctacctctggtgctgaactacagcggaagagaatctctggattccatttctgcattcttcagtgctctgaaggacatctgaagtccatcactcgggccatatagatacggagtgaaccatgaagctgactgcctcctcctctcagcctggacacgggcagttcatcccagctgtcctgcagcctaaactctgatagctgcttactccaagagaatggctcccagagtccagaccattgtgaggagcccatgtcctgtgactcagacctgggcacagcaaatgctgaggactcagaccggtctctgcaagaggtattgttggaattcagcacagcccatgtaaactctgtgccaagcaacggactgagcccagaaacggagatccccatagcacagggctcgctctccctccatgggctcaacaccagcacataccttcactgtgaggcacctgcagagccccttacttgccagggagactctggaactcaagatggtgtccaccgtgcaggagccgc

SEQ ID NO: 531339 - DNA, 893 bp, Homo sapiens
gttaatgttttgtgcactgggattgacttcaatggcgcacaagttctccaacttttccgaatttccaaggagagtaacccgttagagaacccttgagagtcccttgggcacatttcaggcattcgtggaagagtccttgaacaaggtccagccagtagcctgccctggaaaatgggtccactgccacgtgtgttctggctgtagacaacacttcttgatagtgcccacctcggagatagtcggcccatcttgggtcgttataatgaggagagtccaaaaccagcagcctttaagcctccacgccaagagccataatcccactccagtatgaagacccggattgaggatcccagaaggcttggaggaaacctccgggatgggcgtgttttgggcgtgcttagaggtttccaccgcgtcccattggggacgggccagtaccagcgcttgccggtttccaactcttgtgccccgaccatccagactgctgcccagcgtgacccctccatgaccaggttcattttgttggcctgtgatgggctcttccaaggtctttacccccgaagaagcccgtgaacttcatcttgtcctgtttccgaggatgaaaagatccagaccccgggaagggaagtccccagccgacgcccgctacgaagcagcctgcaaccacggctggcccacccaggcggtgcacgccggggctcggccgacacacgtcacctgtgatgtgtggtcgcggatatgggcacctgaaggggtggcgcgccggcccacggagcaccgcactggtattgaacttaaaaggttcacttttgtgtgtgtgcacccttgtgtgttttgtgtaactcctgtgggactcccctggttgtaaataaaggtttctcttttttttccta

SEQ ID NO: 531340 - DNA, 137 bp, Homo sapiens
gatctagtgacttctgtctaagctagataatgttggggccaagatgagatgcctgggcctctggagccctgacttagggtggttctgctccaggccgagctgagctgcatgttcagccagggctgaaagggggagcc

SEQ ID NO: 531341 - DNA, 216 bp, Homo sapiens
atggccgttatgcgccgacagggacggggcaagtgtcggtggacaatcgtacggctaggacgctccgtagtctccgacgagaccagaagtggcatgataaacagatataagaacgctcatttgggcacagccctaaaggccaaccctttgggaggtgcttctcatgccaaaaggaatcgtgctggcaaaaagtcacggagtctgaagcccaaacga

SEQ ID NO: 531342 - DNA, 166 bp, Homo sapiens
gattcagtctttctgtaacctgctgctgcttttagtcctcctcactcagatcggattcaatggagtgggcccagaggatacattttaattccagtaatggtaggtagattgtcctgcttctaaacactcctcatttatatttccactcatattgattcctagggaa

SEQ ID NO: 531343 - DNA, 400 bp, Homo sapiens
ctcagatcacatggcactctatcaacctgtgtccccatgttccctgcttttttgtttgtttttttgaggtggagtctcactctttggcccaggctggagtgcagtgatgcgacctcggctgactgcaacctctacctcccgggttcaaacaattgtcttgtctcagcctcccaagtagctgggattacaggtgtgcaccaccatgcctggctaatttttggtggagatggggtttcaccatgttggcctggatggtctcgaactcctgacctcagatgatccacctgccttggcctcccaaagtgctgggattacaggcatgagccaccacacccggccatctcctgcctttttttttggatggagtttcactcttgttgccgaggctggaatgtggaat

SEQ ID NO: 531344 - DNA, 205 bp, Homo sapiens
ctgttgcgatcctggtgtcctgcctttctccaagggcatgactgacttcttgcagtgcaacacatgacatgccccctccaccacccactcgcatctcagacgtggccaagagcagcaaattgcgcccagaggatcccattgtgagctggttctggaggtgagacagaagttgtgacgaatgaagaggcagtgtgaagtgtctgaa

SEQ ID NO: 531345 - DNA, 180 bp, Homo sapiens
acgagaggcggggggatatccctttccgaaacatatatacacacagttatcatgcaaatagatatctagccaaagatgggtccatagcctaatacccagatcctgtgaatgtacacttatttggaaaaacagtctttgcatatgttattaaggattttgagatgagattatacataggcc

SEQ ID NO: 531346 - DNA, 114 bp, Homo sapiens
aaatagttggttagcaggcaagacccagagttttagattcagattagggcttactcgctgaactttggaaacatccaattctgtgttccccagaaaatggtttaggccctacca

SEQ ID NO: 531347 - DNA, 1313 bp, Homo sapiens
  misc_feature (481)..(481): n is a, c, g, or t
  misc_feature (573)..(573): n is a, c, g, or t
gaagtatacataacattctaaaactgtttatattgtccatttaagaccgggaaaattcaaaactacatttattagtggatatgacaacgaatttatttcatagtttttaaaaaatgaagctcattactggaaatttaagtgaaattgaatttttcaaaggcatcttctgcagagtcgttttaatgtaactatgaatcaaactttcaactttcagaaaatgtgtatacagcataacctttgttaggtaacttgagaaaattcagatgtatctgggcggttaaggatccggttagaaatcatgtttcagtgtgagggcaaataaccgatttgaacatgaggtatttccggggaaacgctttttttgcccgatagtagtttgtcaaaagttaaaatcttgttgaattttaaacttgtttggaaggtgtgtcctgatttttttttcttgcatctttcttgagcttggatacttctttccatgttntatcctaaaaacgtggtattggatacacgccttttaagacttggtggcgaaacttaaagatgcttcgaaaagcctggaaagagcaactcagntgtaacttggcgaaagtaacgatccgccccagtgcgtaggaaaccagaaccgctttgccttagctgaaccacggtttgggcaactgatggcccttttagtgggaatttccttctgaattatcccatcataaattttgcccttttaaacccgtggaaaggttagacgggaagatacttcccaggttttaaactgttcacccgccctgtcctttacccaattgaactttcttaggtttctgaaggtattgcccgcttcccccctgtgataaactcgtcttgcttcaccacaatcttccctttctcctatacacgctgagccgttcgcctccacgctcttaactcgaaccgtatacttcgccccactctcgacctttgccccttccgctttcccgccggtccttcctcgtcctctttatacgcctctgcttacactcgcgcgcccctctattatgctccgtcgactccctctccctcgtccctcatactctctacccctccgtcccctctttgtctccaccgcctgcctctcgtaatccgtgcccttttctctcccctcatctccgctgcatctctctctccactttgtgctcgagtctcttatcctcctgtctccctcctgtccgttccttacgcgacatactctcctctcatctactgtgcgtctgctcctctactcagccgtcctacttccacttacgtcgactcctacatgcatctctcgcgctatatatctaccgccc

SEQ ID NO: 531348 - DNA, 104 bp, Homo sapiens
gtggggtatctaaattttttttgctgaaatacattttggtcaatcaagccaagcctgcctttacagaatttgtttttttttcaaataaattagttgttttctta

SEQ ID NO: 531349 - DNA, 1158 bp, Homo sapiens
  misc_feature (656)..(656): n is a, c, g, or t
  misc_feature (769)..(769): n is a, c, g, or t
  misc_feature (898)..(898): n is a, c, g, or t
taatcccaaaaatttgacccattccctggcctgtaacctttttggttttatccctttctcccattggttccttcccattttaatacccttggtgttattaacctttggcttttttaagaaagccttttaccccatttatttttttaaaacatttccaagaaacctggttgaacgtactctggggattgtgtagaagtgattaaaactcttagaaaaattgcgcagattgtgtgagacggagatatataaggtgaatcctggtgcgcttaaatactcttaatggcgaaggagtattgtgtctctattaaagcgcaattgagattttaacccaggttattgttcacatcccttaaaagaaaaaatctctaaatattgagaccccaatgtgtgagaacgggagtataactctcccaaggcgaagtgatatctcttcctctatttgtgtgaaaaccctctgtgttatatctcacacgggaagaatataactcctaagtggagtaatttcctcttctctaaaaatatagaggagtattgtgtcaaaaaactctttctcttttcacaaatatttaactctctctgtcctctacaaaatgtcccctctgcgctgttgcgccacaaaagagactcttcccaatgtgtgtgttcacctcgtgcgngcgaattatacaatatataacccttcttttccccccccagagctgtatatcttttggcgcgccaggtgtcattgtgtgtgtgtgtaaataccctccagagatattacaccccnggtgtgcgccttctcgacgatctttttggatttttgcgcaccactcttggtcaacacacggcggcggtaatcccctatcttaaccttgtcgtgttcaccaccctctttcttctaaatgcacaccccagngcgctccttaaaaggggcagacgtgcgcccaaggtcttctctttacagagagaaacacccacgattgtagtgtggtctctccctttaaacctctattttctccccgagattactcttgggtcccaacacacaaagcacacacggcgtgtgtccggcgcgcctcccccggtattagggttccctctgcgtcccccgaggtaatatatatacggttcccaaacgcccagcttttttgggttcccccgtgtgtggagaacccc

SEQ ID NO: 531350 - DNA, 1162 bp, Homo sapiens
  misc_feature (252)..(252): n is a, c, g, or t
ggtgagcgcctggggaccgcagaggtgagagtcgcgcccgggagtccgacgcctgacgccaggatggtaggtcgtgaacatgccttggaacaccacctgacatggagttctactataccgtgtgtgcagctgccaggatcgggtggcagagctggaaggtgatgcccaaggagtggaccatggtgggccgagcctccgctgctgtgcctcggggcggggataggtagctcgctgtggctcggactctagggnacttgtagcggtgaccggtgcccggatcctgggtgcaatgggtgcgtcggaggatctagggtctgaagccctggcgatgttccctggttgccctttgcttcgacgaccgttgcccctctgctacggggcaccgggggatggtactgcgtgtgcgtcgctgagtcgtgagcccttgtctccctgtccccccgcgataggcctggcacgtggtgtccactgaaggcgacattttgtgccgttgggtatcaccgggtggttttgccggctccgccgtttctcggtcgcgccttcgcggtgtacgacatcctgggtgcgttaacgcgggattagtattaaaagaccgaacgtgggtttaaccagcatactggaagggctaaaatgtcgtggtcgtgggatatagcgccgtgggaaggcaagggaccggaagggtggaggggcaaacaccaggaagcaataagggccgccgcacaattaggaaacttttatctgccagagtacttaaggaatgcgaccacagttgacgacggtgtacggttcttcctcgtgacatctgagagtggtcactcgacgtggcacatccccagagctcttgaaccccaaaacgaacttatccccgttaggggctattgtcttccccgaacttttcacggtgggctctggtgtggcaacaaagttatgttcaagtaaccgtcggggggagacgtgtgcattggattacatggaagaaatctgatctaaaatggttccacgacatgacgaaagagttggcgaatggggggggagacaacatagaaggaggtcagatgggaggtttaaaaggggagggaggtgggtgggggaagaggaactgcaaaaaaatggggggtttgaaaaagaaatttatggatagtgagggagaagagagcaggga

SEQ ID NO: 531351 - DNA, 454 bp, Homo sapiens
  misc_feature (183)..(183): n is a, c, g, or t
  misc_feature (272)..(272): n is a, c, g, or t
gagcggtctagccacagcaacgccagatccaagccacgttgcaacctacaccacagctcaccgcaacgccggatccttaacccactgagtgaggccagggattgaatctgcaacctcatggttcctagtctgattatttctgctgtgccaagacaggaactccagcaacattgctttttaaantgaagcaatattccagagcatttttcctctttttggctgaactcacagcatgtgaaagtcccaagccagggatcgaaactgcatcgcanaaacgacctgagccacagcagtgacaatgctactttcttaacctgctgggccaccagggaactcttccatctcagtcttttaatttcaactgcttgtcttacttggatccctaaataaaatcccacccctcgttagctcccagcagccgctcttaccgggtataagctcgagttctatatga

SEQ ID NO: 531352 - DNA, 263 bp, Homo sapiens
cccctagtggctagggcttggaccgcacaatctacagctcattctgactggctatctgaaagagagcagggtataagccagagtggtggggtgagaagtttagacaggaaagatggttacgggaccaggtaactaaaggtgactcaggtcagagcaggtgacagaggctaggaggggcttgtttcactgaaactagtgggcaagtgagactataaagaatgcaggaaagttaaaagttacaaatgcaagaaccaaagcaacag

SEQ ID NO: 531353 - DNA, 439 bp, Homo sapiens
  misc_feature (188)..(188): n is a, c, g, or t
  misc_feature (220)..(220): n is a, c, g, or t
  misc_feature (294)..(294): n is a, c, g, or t
  misc_feature (298)..(298): n is a, c, g, or t
  misc_feature (375)..(375): n is a, c, g, or t
  misc_feature (382)..(382): n is a, c, g, or t
  misc_feature (393)..(393): n is a, c, g, or t
  misc_feature (417)..(417): n is a, c, g, or t
  misc_feature (428)..(428): n is a, c, g, or t
gcaaattgcaagaattacgccttttcacctcctctgctctcctcccggagccggtgcccaccctctttttcacaaaccgcagggctggggagagggacttaacctttggcctacctgcctggctgtttggctctgcgcttgctgtttttggtttctttatcttctataggtctttactttgttcttgnccacccactaagacggtgttttatcactatgntctacctttcaccctaagggaaaggatacggacgagaaatggaaaactcactgtcttactttaaccccaagggnaggnacataaggtgctcaggattctcacagacgtcacatctactggtacagggcgatctgctgcagctctccactcaaggnagcattnccatatacctnaagaagatgaaattttcatcgagnccacgtagttncattgggatgc

SEQ ID NO: 531354 - DNA, 250 bp, Homo sapiens
gagccggaccgctagcggattagtgaacgcatcttgtgtaaacacacgagagtcacacccagtagggggccaggtatgtccttcaccccaagccaaactttggtaaatgaaataaatcacttatttcagaggcctgaggcatatattctccttcaagttttataccactttaatcttctattttggatttactccattctgagtcttaattttcttgactaatggaaacgttcacttaatgccgctagcg

SEQ ID NO: 531355 - DNA, 956 bp, Homo sapiens
caaaatgcagagtctgtttcaaaaattttggaggaccctcccccgtaaaaaagattcgtgaatcccagtttgagaacgcagtgctcataaatcctccatgatggcatgctacatgggaagggacagggtgctgcttgtagaaatcccgtctcaacgttgtcttgtgtcgttaacacccaggagataccaatccccgtggaggacttacgctagtactagttcgagtaacagacatggtgggcagcagatcagtatacgtgtactctacgaaagagagcacggcacctgtatggatcacgataaacgaggcagtgttgagcgctcagctattcaacgattacactcgcgtctcacgagctctggaatcacgtcttctactagaagctctcatacgcacttgtgtttccttgtctttaataatgagatacacgtgaatagtcatcctcttcacgtttcctggcagtgtgagagagcaaccaaagtgggatacatgcatgttgaacgtgttttggtaaggctaagactccatggaagctctattgtgtgaattcggaggctgtagacaaagtgtttccctatatcttgagggtatgatacataaacgtgggctgtatgcagtggtgtgcgggtaatgttaacaacggctctggcaggacgggggagtgggagacagaacaccggtaggatcaggcccgccaaagtcctgtgggtataaactaccaccaggtgtgtgcaggggatgggcctggtaatcccagcgcatgggggaggacacaggcggaggctcgcttcaaggccaaaaggtcaagaccagcgggcaaaaacgcagacccatattacaaacatttaccagtaagccgacattgggggagccatatgcacgaaccagaggcggggcgaaaaggctaggcacgaggccgtggaaaaaggaacaccgttccatgaaacgacattga

SEQ ID NO: 531356 - DNA, 213 bp, Homo sapiens
gagaaagaagagaagaagaaagaaagaaagaaagaaaaagaaagaaagaaaagaaagaaagaagaaagaaaagaaaagaaaaagaaaatagtgaaaacgtcctctcacaggcttcattgccattcctcacaaatgtagccatttttatcagagttattttcatatctttatagtaccttcctctctttctactttctttcaaagacaagcgaa

SEQ ID NO: 531357 - DNA, 538 bp, Homo sapiens
  misc_feature (22)..(22): n is a, c, g, or t
  misc_feature (64)..(64): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (122)..(122): n is a, c, g, or t
  misc_feature (125)..(129): n is a, c, g, or t
tgagggcggggcagagggagcntgacggggagagtgaggaggaaagaggaaaggaaggccaggntgggaggaaggatcagttnttnttgngggaagaagaaggaaaggagagggactattgnttnnnnnatgcaaatgaagggacttggggctagttcaggaaggaaagggaaagggaaggaaggcaagaaaagaggggttgaagggaaccttcaggaagggggtgtttaaggacaaccggaaaaatcatctagttaataaacctacaaacagcaccaaatttttttcatattatattatgtttaaattaacagcgtggctatttacagggggacacacacacggacacacacacacacggattccaggggagcggggggctgaaagatttggctgaaacggtggaggaccggcttgagggttgggggacaaaggcccttctctaggcagggcagactcctcggggattaaagtgctgaagttacactatgatgatgatgaggatgatggcgcaaattattcccaagatgatcatcat

SEQ ID NO: 531358 - DNA, 906 bp, Homo sapiens
cagcacagtcatttcatccccggtgcattccccaaaagcaaaaccaaagctcagcatgtgcttctagaactttctatatctggtgtcaggggtgggtggggtgcaaagggcaggccagcacagtcatttcatccccggtctgttccccaaaagcaaacgcaggagctcggatgtgttctagaattttacaatctgtgaatcaggttcaaaataactcacattccactataaggaggctcagaggatgccaccgagtgacgggacgtgagcaggatcacagagacaaccagtggaacacgcaaaatgttcccacgatgttagcaggggaacagagtcggccgaaaaatggcgaaggtgtgggcacaaaagaagcaccaaaaattgacacaaccaaaggccagtaaaagacaacctcgtaaggaaagaccactattcctccccaaaatctatctttaagggaggctaagtggtggtacactctgactttcctggaggttctacacgtagtacaagggtccaatcctcaatcgttatgatacaaactcaggaaaacaccgggtagaccctagtactcccgcattatacaacgcatttcggccggcacggggttcacgcctggtatccagcatgtgtaggccgaaggcggagaccttcgagtagacagtcgaaccagctgtcacatgggaccctgtctctataacacacaacacacacaacacaacagtgggcctgcgcccgaaagttaaccatgtgggcgggccccaaatgagcacggcagggtcaagacacggcagcagggggttcaccaaacacggggacgggtgcaacacagggtcggcttcggtacacgacggcaacacgcgcggggacaagacaccaaacacacaacgacgggagagcacgcac

SEQ ID NO: 531359 - DNA, 431 bp, Homo sapiens
tagatctgctatttataattaaccacaccggtatataggtttaggttatgtcctgagctgctcacacggccataaggtagagttggaacatgagtactgactgtgtgtgaggaagaccagtgagcatggtagaagtactgctgcccaaagttaagcaaataggtaagtgccataacccaaaacactaagatcctgtgaaggattatataaaacacaacaaggggacagtgggacagggagatggggtacagggaaagtggtaggccaacttctctgttggttgtcccctgagtgggaaagacacattctgtcttcgagatgagatttaattcaatgtaagacacacagcaaaacaaaggtaaggtgagtgaaaatgggcttacatttaaaattagatatcggtaaggatttagcattagaaaaacagggag

SEQ ID NO: 531360 - DNA, 143 bp, Homo sapiens
gggaagagcattggtagctgggactgtgtctgagggtcaggagcaggcaagggcatggggttgtggtctgagggggacttggttacagtgtggcattgcaggaggccagggggtggggtaagcagtgtccagcagagacctgg

SEQ ID NO: 531361 - DNA, 321 bp, Homo sapiens
gattgggggtaataaacccggacggaggcggaaaatataaaaaaaaaaaaaaaaaagaaaaagagagagaaaaaaggcctccttttgtttttttgaaaaaaaaaaggagagaagcaaaaagaaaggaaacaaaaaccgggggggggcttggtttctttttccccaaaagggaaaacaaaaaaaaccccccccccgggggggggggggggtttcccccgggggggccattaaaattttttttttggcccccccccccccggggggggggggtttttaaaaaaccccccggggggccaagtggggggggggggggggttttta

SEQ ID NO: 531362 - DNA, 140 bp, Homo sapiens
cggcgcgaggggtcctgccatctcacgatggcagttcagtgtatcaagctgactttcatgggtgttttcatgacttcttctgaggcctccctctggaatattggatggtaactccagagggaggcctcagaggaggccta

SEQ ID NO: 531363 - DNA, 451 bp, Homo sapiens
aattaatagctcacacgagctaagatacagctagatccattaagaggtcagtagatatactcattgcccttctaagaactaagaatctgtccttgtggcttggaaaagaacatactaaacaggggatactgcgttgtgatcactgtaacccattctaaggataacctactgtttgaaattaagaactgggaactgagaacagtcagaccgaaaattagtctcttttcagacgccgaatagtgaagagtgaatagaagtcctgtgccaatcaagtctctgcatcgttgttataccagatcatacataaaggctgtctctcgtgagatcgatagctattacttgcaccgttccacatgcggctgtgttatatcgtggtcagggcaaacccacctgactaaatgcatgcctaaggggatgaatagtggacttgtaatatctaaatttcactctt

SEQ ID NO: 531364 - DNA, 478 bp, Homo sapiens
aaaattctgaagattgtgtggtgatctgcgaaagagataaataattgccgttattttcacccaagtgaaacaatgacggcagcagcatattatccagaaatttaaattatgcacgaaaatgtgatttaaaaacaatgtcctttgggttacacaccagaacctacacttttacagagaaggactcgcccccacatgtcacaagtttttaaagcaaagataagagacgtgggcgatgaaattttgtcatgtccattttagtcactggacctttattccacgggccaccgtctctcatttggagggtttttttagaaacaaccctgctttccccagtcgagataaagtatctggaagatgttaacaatttatacagcctaacaagtgaggaattttataaaagttagccctttaatattcggttggaagaaaactattcaggctcctgaggcatattttgattgaataaaccttatttttt

SEQ ID NO: 531365 - DNA, 283 bp, Homo sapiens
tctggatcaagtgtctcatcttgcatggatggaagccaatactcagaaggaaataacagctctgaaactctgtgaaggacaccccaatattgtgaagttgcatgaagtttttcatgatcaggtatcctactttttttttttcccccatgtttcctattcccttaaccggggttggatattttcaacgcgttagggtgggtgcggcggggctacagtcggggcatatacacgatcacccagccaccacaaggggcagtgaacccaccctcgtaaaccccttccc

SEQ ID NO: 531366 - DNA, 224 bp, Homo sapiens
atacatgtaaccacatcggaatctcaaaaatacaatgttgaatgaaagcagggcccgtgtatggtcctgtttatatgacgttcaagactttttagagaattgaaaagcactgcgtcttgattcaaggattagtgatcacatgggcatataaatgtacccaaactcattgaattgtacacttcagatctctgcattttgctctatgtaaatttcgcctcaaatta

SEQ ID NO: 531367 - DNA, 312 bp, Homo sapiens
ggctcataggtcgccagtggataccatgatcatcactttatagggcttgttgtctaggtaaatagtacgaaattagcttggcaaacttatatatgttcagtgaataagaacttacatatgttcatgaagtagaattgttttgatattcttatgacttaaaatatttttctgaaaaagtatatatagcctttgagtttttttactgaagtactgtagatactaagagttgatattttgtttaaaatatatttttattgagcaaataatatttggaaaattttgatgtaagttggactttattatgataagtag

SEQ ID NO: 531368 - DNA, 374 bp, Homo sapiens
  misc_feature (42)..(42): n is a, c, g, or t
  misc_feature (125)..(125): n is a, c, g, or t
  misc_feature (155)..(155): n is a, c, g, or t
  misc_feature (315)..(315): n is a, c, g, or t
acttgctccaactccccccaaaacccaccctccaattggtangtccctgcagggggtccccgtaagcttattttgaaacgttgctaggatgggctgggcagctggctcacgcatgtaatgccagnactttgggaggccgaggcaggcagattacntgaggtcaggagtttgtgaccagcctggaggctttggcaaaaccccatctctactaaaaatacaaaaatgagctggccacggtgaaacctacctgtaatcccagctattcaggaggctgaggcaggagaattgcttgaacccaggaggcgggaggttgancgtgaagctgcaggttgcatgtgagctgatggtcgcgccactggactccagcctgggcg

SEQ ID NO: 531369 - DNA, 666 bp, Homo sapiens
  misc_feature (202)..(202): n is a, c, g, or t
gcgtgatcataagaccgaattgacgtattagtggacgcagtggtccgagatcaggtcaagtgcaacgatggtccataatgcgtagtatctcacttaggtagcatcacttgggccttggacgtggatatgcttcggtattgcatcgacctacttaaggaaacgagcactcggccgaggaacgcacgaagcagtctcttgaatngagatccaagtgataggcaagtacatggagtgcgtcgatttacggggtgagtcttgatacaaactagacgagtgctcgaaacgcagagttgctgcaatatgctcaaagattatgcgcactccgggtcacattggagtggtcgacgcaggagcttgggctacatgtagacactcgatcgacgcgaaattccgcatcacggtgtagacattcttgtttcgtggactttggccccttgcaaactggctgaaacccccaaaggggcgctttaacggattcaagcgttccaatgggttggcgccttccccaacttccaaacacactagggcgccgcacacacgattgatctgctactataaacaacggtcgggattgcaccactccttgggcagctcccaaggaaaatttgggtcacaccacgataggccccgggataggctttggccacacggggggtacaggtcgga

SEQ ID NO: 531370 - DNA, 499 bp, Homo sapiens
  misc_feature (38)..(38): n is a, c, g, or t
  misc_feature (44)..(44): n is a, c, g, or t
  misc_feature (47)..(47): n is a, c, g, or t
  misc_feature (59)..(59): n is a, c, g, or t
  misc_feature (348)..(348): n is a, c, g, or t
  misc_feature (364)..(364): n is a, c, g, or t
cacaacactaatctgccatgatccagatacttgatgtnctaatnctncaacaattgagnagagtgcatacaagcccttttcaaattgtcggcgcttagtctgcgctgtgataaccccaactgcttgtatctcatcgcaacacctgacacgttaccagcgaaagagctatctgacacgtcaggtgttcgtgataggctgtgaatatctttgtacaggcggttcttgtatgcttcaacaccagccgtgtcatactctttatgaatgaagccagcgtctactgatgtttgtccgttcacagcattattaccagacttcaacaacaacatacgtgctgacttcaactcacgnaacattgtcatttttnactctgtttgttctttgagttgttcaatgtagtcagggttattcggatctaacatcaagttggcgccgtccattaagtcgtcaatatcgcccttattactacattgcgtcattcaagcagtcaatgtaattggct

SEQ ID NO: 531371 - DNA, 746 bp, Homo sapiens
gtggggtgagcttgtttgtgtccctgtggtgtggactgtggttggttgattggcagtgatcctggtatccgataacatggtcaaaatgcagatcttcgggaaacaccgcttaccggaaagaccatcaaccttgaggtggagcccagtgacagcgatcgaagatatgtgaaggcatggatccagtgatgaaggaagggcattgccacacgagcagacagaggctcatctttgctggcaagcagtggcacagagggccgcaggtcgtttctgaactaacaatcatccagaagggagtcgaccctgcacctggatacctgcgatctgagagggtggctatgcagaatcattcgtgaagaccctgagccatgatacgttggtgacggtcaagaggcgtatcgcctacacttgacttgatcctatcagtgactagcaaagacctaccatggcctgctgttcgatgtgagatgagtgagaatagaaacctgggggtgactgttctggtctagtcgctgagcaagccagagcacacgaaccctcaggggggaacacagggggcggcagtcccctaccggcgagctcctccgagagggattggctgacagttccacaacgttcgagactggtcggtgtagaaccagaatcgggcaaaaaagggagtaaagctgttacgacccctagggctgcaaggctagtagcacacacgacaccgagacaacacagaggaaggtggggacacactaagcagg

SEQ ID NO: 531372 - DNA, 178 bp, Homo sapiens
tgcgtctctaatgagcgtggtgtgtactcgtaggatgcatttggatgacatatggggataaaatttagagaggtcgtttagaacagggaattcaacatgatcggctattattgtgtcttcgttttctcatttaaaaaaattacagaggccgggtgtggtggctcacacctgtaattcc

SEQ ID NO: 531373 - DNA, 547 bp, Homo sapiens
  misc_feature (371)..(371): n is a, c, g, or t
  misc_feature (425)..(425): n is a, c, g, or t
ggacccgccaacatgggccgcgtgcgcaccgaaaaccgtgaatgaaggtcggcccgggtcagtcatagaataagtaactacacgcgccagggcacacgatttccacacgaacaagcgcggtggtgcgtaggagagtcgccatatagtccccagacaaaaaggctccgactaacaagattagcaggttatgctcacgcactctgatgaagcgaattcagtagcaggcccagtaagaggtatctcctatcaacgctgtcaggaggtaggcgagagaaaggagagactgattatgttgccgtgagggtctcagcccttggatcgggagaattatggagggtagagtcctgacatgctaaggaaaatgctgaagncttttggaacttgcggcagtctgtgccaaccttcaggtcatctcagcctacagnttgggatgaagtttctaatagacgcgctcggggacctgtatgaagtgtttgtctgtacgtgctggtattgatttgcaagtaacatctggggacaaccagcaaagaaaaaaagaaatgaaaag

SEQ ID NO: 531374 - DNA, 110 bp, Homo sapiens
caggatcagggagacagatctggtgagtgtggtggcactggagggaaacacaacggctgatccagatgaagtcccacagcaagggaagtcaagcattgcatatgcgaccg

SEQ ID NO: 531375 - DNA, 236 bp, Homo sapiens
  misc_feature (20)..(20): n is a, c, g, or t
  misc_feature (98)..(98): n is a, c, g, or t
cccatgttgtggccacgganccaaggctggggcctttgatcctcaggactgctgtactggagtcccatgacggcccttccctcagagcccggtgctgnacattatcatcacctactttgacaccccagctgttgaagtggctgaaaggaagagtgaaggaaagtgaaggacttggtcttgacagagctccctgggcccttacagaaggggaaaagtaaaggcgctgttagaactgt

SEQ ID NO: 531376 - DNA, 147 bp, Homo sapiens
  misc_feature (28)..(28): n is a, c, g, or t
  misc_feature (32)..(32): n is a, c, g, or t
  misc_feature (124)..(124): n is a, c, g, or t
acatgtttcaagctatgtaaatttatcnttcngtttaagcattaatatttgattagccagagttacagttcataaagcatatgtaaatatggagttatgtggcattttctgaaatattttaccntattgtattacactatcccaaag

SEQ ID NO: 531377 - DNA, 241 bp, Homo sapiens
ggccaaggtgggctgatcacttgagtccagaagttcaagaccagcctgggcaacatggtgaaaccccacttctaccgaaaatacaaaaatttgccaggcatgatggcacctgcctatagtcccagctcctttcagggggctgaggcaggaggattgttcaagcccagaagttgaggctacggtgagccaagattgcaccattacagtccagcttaggtgacaaagtgagaccctgtctcca

SEQ ID NO: 531378 - DNA, 140 bp, Homo sapiens
gaatttgtaaaccccgagcgaggtctgctaccgaggcgctgctgtgccggagaccccggtgaagcaccgtcatcatgtctgaccaggaggcaaaaccttcactgaggcttggggataagaggaggtgatatattaactca

SEQ ID NO: 531379 - DNA, 597 bp, Homo sapiens
  misc_feature (427)..(427): n is a, c, g, or t
  misc_feature (505)..(505): n is a, c, g, or t
  misc_feature (532)..(532): n is a, c, g, or t
  misc_feature (567)..(567): n is a, c, g, or t
  misc_feature (595)..(595): n is a, c, g, or t
gttccaaatattgcacagggcatatgtatactaaaaaagtattcattggtgatttgaaatacaaatttaactggacatcctgtatttttatctgctaaatttggcaaccctacatatattcccaggagcctctctttgctctctaggctctcctagttgaagattgcctgtaatgttgtttctcatctagcccagacacaggactctgacttaaggaagccaggctggtgactcatctaagtgggaaatttacttgctgactcaagaggacatagttcttggcaaacttttgccttagaataaaccaaaagggaaaaaaatatattagcaaacgttaaataccggagaattgtttaaaacactttaacttaagggcaacggccaattaattggatattttctttcaagtgattaaatgaagatttcnggggttcctcttttaccatagcttggcctaaaaagggatttttgattagagcaaaaagtttatttaaatatgatgtanagaagaataagattgatttgaatcaanttggtaccagagtttaaattcaacgcttactttangagggactgggtgctgacttgccctggngg

SEQ ID NO: 531380 - DNA, 290 bp, Homo sapiens
  misc_feature (155)..(155): n is a, c, g, or t
  misc_feature (185)..(185): n is a, c, g, or t
  misc_feature (194)..(194): n is a, c, g, or t
  misc_feature (246)..(246): n is a, c, g, or t
ggcaatgggctgaactgtaatgaaaatgttatttaatctttgtctctggattttgaaacctgaaagactttcccctttgttttactggaaataaaattgttaatctgtctgattttgtttgaattataaaccctttgagggacccaacataaccnatttgtgcaacaacatagactgacctcagnacccaaaanagtgtaaatatttttgggcttccagctttggttttgttattttcataactgnaccaacttagaacagactgaattaataaatgagaagcgccatga

SEQ ID NO: 531381 - DNA, 521 bp, Homo sapiens
tcgaggctgaaccagttctggtccccactcccactgttcccctcagcgccaaagttcattgtataattctgtgcttgtgtgtcctcatagcgtatttcccgagatatcagtgagaacatatgatgtttggttttccattcctgagttacttcacttagaataacagtctccagtctcatccaggtcattgcaaatgctgttaattcattatgtgagctggtctgtaattataagaatatttttttgggaattttattgttccataagctatgggggtacacatggtgttgggttagatgagtaagttcttaagtggtgatccgtgagatccctggtgcacccatcatccaagcaggatacacttcaccatataagtcgtcttttatccctccccactcgttgattgatgggcatttcacttggttctatgatttttcagttgtgaatggtgctgctagaaacatgtatgtgcaagtatctttttcaaataattactagtttttcttggatagatacccagt

SEQ ID NO: 531382 - DNA, 160 bp, Homo sapiens
tcaaagatcatttgaacaatatacaatatgtagtagcattcatcatcatataatcgtattagtcataatatactaggacaagataaaaaagaacctcttttcataagtataagtgtctttatagtgcaccaagcagactttaaataacttacaaaagcaa

SEQ ID NO: 531383 - DNA, 1887 bp, Homo sapiens
gactggggaaacgggagggctcactgagaaccatcccggtaacccgaatcaccggtggtcaccatgaaccacattgtgcaaaccttctctcctgtcaacagcggccagcctcccaactacgagatgctcaaggagcgagcaggaagtggactatgctgaagggtgacccacaaaacctggcatcccacgatgtccacgcgtgatccacatccgcagacgagacctccgttgcactgaccatgtggtctggtccctgctgcaacaacctcttcatgaacacctgagtgccatggggattcatagcattcgcgtattccgtgaagatctagaggacaggaagactggttgagcgacgatgaatcgagggcccaggactatgccttgcaacgatcaaatgcctgacacagtctgggacaatgaatttcgggccatcttcagtgacctattgctgccgtcatcatacatcccaagctgattggtcgtcagtgcccagcgatagatcaggaggcatcatgaggccacggagctctgccgtgacctgaattccacgtactctatcttacattactcggcctgccccacgaggcaggagcctctggactatggcacatgtatgccagttactcaaccttcaattcttggacctgtcctcagcgagtctgattagccttattttgacggcatataaagataataagggtttggtctgcaacaaaaacgacaacatctcggcacaccgaagagctaaacataggagggcgcaagacacacgatatacagaagcgaaggtgatcaaaagccgcgcgcacaagtggttaggagaactcgcagacgagaaaagcaaccaaccgcacccaagccacgacagaccagcccaagcaacgacagaagcgggacaaaagagagagcgccgacaacaaacaagccgccaagcagcgacaaccaaggcagagagaacagcagcgaagccacagaaaacagagaaacacagcaaagaacagacaacaagaacaaagacaaaacaaacacaaacaaaagccaagaacgacaaacggaaacagacagatcgacagacgaggacgcgcacaaacgagcgagaacggggcaaggggagagagagagagcgaaagcaacagacacagacagacacacgaagaagagacaagcgagagagcagagacagcggcagaaaagagaagaggaaagacaaacaaggaaaagacagcacacacaagccgagcgaggagaaggaacagcagaagcagaatagagagcagcgagacgagaaggagccggcagagaaggacacagcgaggacaagccaagcaagaaggagcaggcacaccaggaagagaacaacgcaggagccagagagagaaaacagagagcgaagagcggacaagcagagcaggagcgaagaagcgaacgagaagggcgacacgagacgacagagagagcaagacgaggcagaccacgaagcgagagaagcacaagagaagacgaggagagaaagaagaagaggcgcgaggagccaacgagagcgacgacgagcggaccagcagaccaaacagcgacagccgacgaagccagcgaacgaacgcgagagaggaacaagagaagacgggagaagaggaaaagaacgcaaagagaaacaaaggaaacgaccacaacacgacaagaagaagagagcagacagagcaagaccacgccaagacacaggcgcgaggacaccacaacaacgggagaagggcagggaaagcgacagaacgggaggagcgacgaacgagaagcagaaggcgagagaggagggagaagaagccgagaaagacgaaacagaagcagaagacgaagacaaagacagagacgaggatgaggagcggagaccag

SEQ ID NO: 531384 - DNA, 595 bp, Homo sapiens
  misc_feature (30)..(30): n is a, c, g, or t
  misc_feature (243)..(243): n is a, c, g, or t
gacgaggatactcagaggctgggaagggtnagaaggaggaggcaatagggagagatttttaaaagtatacaaaattagagctagataggaggaataaattctagtgttctacagcaatgtaggataactacagttaacaataatatattacatagtttcaaatagtgagaaggaggatattgaatgttcacaatacaaagaaatgataaatgtttgagatgatggatatgctaattgctctgntctgatcaccatacattatatgtatcaaaacatcacgatgggcagggtgttgtggctcacgcccataatcccagcaatttgagaggccaaggtgagaggatcgtttaagctcaggagtttgagaccagcctgggcaacacagcgagacctcatctctaataaaaataaaaaaaattagccaggtgtggtggcatgtgcctgtagtcccagctactcaggaggccgagttgggaaaatctcttgagcctgcaagatacgggttgcagtgagctgtgatcacgccactgcactctggccttctggcctcggtgacagagcaagaccctctcttcctcgttaagcgggtaccgag

SEQ ID NO: 531385 - DNA, 400 bp, Homo sapiens
taaactggattggcgggtttctctcccttgtgtgttgttgcggagcagtctcttgctagcctgatgcatggacgcagagatggattctgtagcttttttgagggggatcttgcgaagatgtcaagcagcattacttaccaagcctgtcgtcatatggactcgcatcagaccttaattttcttttcagcgcattcatgcctgcttatttccagagcccccgctttggctttggacttcaggtctgtgggaggagtgtcccaggatggctcgtgcggtcatttccaggcagtgccgctctccctgtggcttgtacccacggtgcctcactgtgtgagtgtcctcctgctctggttgcccagccggccatcacttcacagcgtgtgttcatttctcccaaagc

SEQ ID NO: 531386 - DNA, 1099 bp, Homo sapiens
gggcacctgggtggggcaggcacgagttatttaaaacagttacactgcctaattctgaatatatatatatatatatcttttcaccataaaaaaaaaaaaaaaaaaaaaaaaaaaaaaaaaaaaaaaaaaaaaaaaaaaaaaaggggggggccaaaaaatttccccgggggggcccagtaggcacccctttttttttgaaaagggggccccaaaggggggttatataaagactgacgagacggggcgcatgtttaacacagtgcttgggatggggcaaagcatggacacggtcagacttacttgtgaaaaagaaccctaacctgcgggggggggcacatagtggggaaacactccctcagcagagatatttacaacgtcactgcagggaaattctacacattttcgacggtgtttcactggggctcacacacacgaggaatcagtgatccgcagtgcatcgaaaatttggtgctcacagacgagtgtttgacatatgtgtggaaacatattttttcaaccgcgcggggcctccgtgctcatactaacctagaacacagcaagaaacagaagaagcacaccccacacaacgacaatggatgacacgagcgaatagatcgaacagcacaacatcaaacagagaacagactacacactaatgacaccaagcaactgatgacacactactactaacaagcgaatccacgaacaagaacaaggaataccaacacgatcacaaagatacacagacgaaaacatgagaagcagacaacaagacaacacaaaaacgaaaacgagaaaagaaaacaaagaaaaaagcaaaggaacgaaaagaaacaaccgacaaagagaaacaaaaatacaagagaggagaaaacaaaaacaaaaaagagcaagacgaacacaacacagacaacacaagcaaataaagactaacaacagaaaaaagaaaatacagaaacaatcacagagcagcaatgcaaacagcactcaacagaaaagcaccagacaaagacagcgagaagcagaacatagagacgacaagaactcagagaaagacgaacaaaagagaaagaaggacacaaatcagctctacgaaaac

SEQ ID NO: 531387 - DNA, 896 bp, Homo sapiens
cgcgatactgaatctgcgcatatgtcgcgttcatcttcttcgtagtcgcttccttgggggttactgaccgcaatctcatattgcctatgccctccgagagtttcgtggcccccggatgggttctggaagcccggagctgttcaggccaccagacaccctgggcaaaccggacacctttgcttggggtcttgggcaaaagttccccgaggataagggaacactccttctctcgccgggtttttccccccttcttgcggcggctcccatcttcaggtcataaaaggccaatcgcagctttgtaacaccaaccccttcggcaatacaagtccccacttttacccctatagggttttctcccccctctttcagaaaactgcccgcctccgcatcttcgattttcacacaccatttcttcccaagatgagcggccccaaaacactcgccacacccaaaccagatccccactggccgtcattccgcttcccatctttagagccatgtatcccccccccccccttggaaaattgctgcaaactcagctaatcccaaatctatatcatcaggcgtagcttactttcccatgcttgtgaacagcctccccccctccttattaaagcgaagactttctaccacaagcatctcccccttgtctattacggaagcccttcacacttacaatcacacaaagaggtcaatcaaatatcttaagacctgactatccccagcccagcttttaatcctcccaaaaaaggcttcatttcatctcacaaactactttgataccttctggagcacatagcccaaggtattttctcttatcacccctcggaggaggttttttctttttcgaggggccaataaaaacaaaccaattaatactcccccccacaatgaca

SEQ ID NO: 531388 - DNA, 178 bp, Homo sapiens
tgacagtgtgtgtcgttgatggatgggtgtggcatttatattgaaggatgtgcaggcttcctctcagagcctgcccaacactggcgttgatgtgtggaggggaagcaagatgggtaagggctcagtgaagttgctccaagaacagtagcttgatgaagctgtccagtaagtgccttgt

SEQ ID NO: 531389 - DNA, 82 bp, Homo sapiens
ctatcaactgaggcgattccgttgagctgctccatctgtagggcgtagcgggcctccacctccctcatccgcttatccaatg

SEQ ID NO: 531390 - DNA, 152 bp, Homo sapiens
cgtcgggaagcagaccctgttagctcttggggggatcaaggggcttcccattaaggagaaaagtattagcagtttcttaaaaaataaaatggctacacggaacatgatacatggataaagcttcaaaccaagaagatgggggtgattgcctg

SEQ ID NO: 531391 - DNA, 181 bp, Homo sapiens
tatgcaacttggaggcagaggctgtgcggtggactgagttcccttggtgatgtcttcaggcattaaagctacggccccctcaacgtcagattagtgatacgtcaatgctctacacagtccagtcttgtgcctggctcactccatgctgacaaagcagagcacatgaagcgacaaagacacc

SEQ ID NO: 531392 - DNA, 1189 bp, Homo sapiens
ggccgccgttgcgcagatcctgggccgcggctgtgtgggagggctgacgcgagcgggtgaccttcctggatggctgggatgctgatgctgatggatggccctgggagctgccgagctgtctgccgccgcctgcctgccatgaacaactctgtgtgcgcctgacgcagatcgggaagctcttctgtgggctggtcttgacttggacgcactgacccaatgatgactctgcgcagactaacttttcccaactactggagcaacgtcgtacgattcgtgtatatcatgaacacgataacagaccaccaatcccagatctcgacgcgctttgggcttctgtcaccacctcttacacacgaaccgcaaaacgtgctgtggcggaacgggtgcctgtgccaagacaaggacccgcacacagcataagaatgagcccgaaaacattcgaacaccccagaagcccatgccacacccccctgggcgcgcattgcaggcctcggacgagcaacactggcccgacacggcaccgcgactgggccagcgaacagcggaacccccaagtgcagagcgcattaaaccatcgctaacactcacaacctacacgcacttattctgtggtccgggctgcgaaaatattcccttcaatccactatgcttgggctggagcaccacgacgacctcacggggacaattacctttgccaccgaaacaggttcccgagaaaggctttgagttccagcccgggcacagaggttacgcttacacttcgaaacttcctaaatttggaagtccggcaccgccgacggaaactcgccagccaactgcgcggccccaccccgagaacgggggatcatgaaatgggacatcgttatgaacctctaacacacccttcatatcagacgcgcacgcgcgagcacacctcaacacctcagacactctccccgcggcttaggggaaagcaccagaggggcgagttgcgtcccgaatacccacccactcggccaccatactcccactcccacccacagagccccgtatccagcgcttggcgtgcgcccacagtatccccgacacgcgtcggcgacaaacgtttatcacgcagccgcggcaccgcgcctctgggactggcacttaccgcgcagtgcaacccaggcgccacaagacggcaaggccccccccacacacgctgcgcccg

SEQ ID NO: 531393 - DNA, 354 bp, Homo sapiens
gtctcagcctcccaagtagctgggactacaggtgcacattatcagatccgggctaattatggtatttcttggtggacccggactttggccatgtcgggcaagttggatctcgaattcctggcctcaaacaatccatctgccccaaggctcctgaagtactgagattacaggcatgagccaccagacatggccaggggcttaagtttcaacatgatttctgcagtgacagacatttaaaccacagcaaagaggatgagccctcaaaagatactgagacgcagcacccagagagatgggaaaaccagctggtgagtgtggtgggacagagctgagaccgaatcagaaggaagagac

SEQ ID NO: 531394 - DNA, 275 bp, Homo sapiens
gaaaaaagggtaaaaaaaaagctttgtttttttcacccaggaaaaaagggtggtgttttcacccgggcaactgctcgccggcctacatggggttaattcaagtttgctgcgagcccgactccgcccttggcattggcctccaacaagccctgttttttttggggtacaggggaacgggatggtttaaactttcctgctcagtgtgtaaaaaatgaagctaaaacccctatttttgctctccttaagctgttcaataaaccggttcctctttttta

SEQ ID NO: 531395 - DNA, 245 bp, Homo sapiens
ctacgagagactactcgaggaggaataagcactacttggggtggctatagcggcatggacaaacgctgcaacgatactgctttcactgatggtcaaggtattgttatattgccagtctttgtaaagtcattaaagcagaagtttcttcaatgatcttctctctaagaaacaccatcacctccatgtgccttacagaggccctctgcgttctgctgcgttgcttttgcgctctccctttctggtgg

SEQ ID NO: 531396 - DNA, 250 bp, Homo sapiens
ccaacttggcctcccaaagtgctgggattacaggcatgagtcaccgtgcccggctgccagccctttttaaataaccagatctcacatgaactgaaagaactcactcattaccatgaggatggcaccaagctatttgtgagggatccacccccatgacccaaatacctcccactatgcccacctgcaacattgggggtcacatttcaacatgagatttgggaggggacaaaacatccaaactgtattcagc

SEQ ID NO: 531397 - DNA, 170 bp, Homo sapiens
  misc_feature (23)..(23): n is a, c, g, or t
  misc_feature (70)..(70): n is a, c, g, or t
ctgggtgcgctgctgctgctggntctccttggcctcgccgtccttgtccacaagcactatggcccccgcntcaagtgctgctctggcaaagctccggagccccagccccaaggctttgacaaccaggcgttcctccctgaccacaaggccaactgggcgcccgtcccagc

SEQ ID NO: 531398 - DNA, 797 bp, Homo sapiens
tgcagtagctcacgcctgtaatagtagctctttgggaggctgaagtgggtgcatcgcctgaggttgggagttcaagaccagcctggccaacatggacaaaccccctctctactaaaaatacaaacattagccaggtatggtggtgggtgcctgtaattccagctactctggaggctgtggcaggagaatcgcttgaacccagaggggcggaggttgcagtgagctgagattgcgcctgttcactccagcctgggcaactgagcgagacgccatctcaaaaaaaaaaaaaaaaaaattggaaaagacacgttcacgggtattctagctctaaatttctggtccattaaactctcagttacacttcggtccgatcaggatcaacgtgatgtgacccgtcgtgtcccagggctaaggaaatgtccttccatccctttaagggcccatccacaatctatgtcatgtttgaagaggacttgggggacgaagcagacaggagaggcttaacgagaccctttgatttcctatggtcccagatgattactgaacgaccctccggagtgctagatcggcgcgggggtcattgggctcttcggacaccctacgtgtgttggtgccggtcggccttgactggaatgccttcccaagaatgtgacccttctttttaggcagcttaatcttctcacagcccttggtgtttaagcaaccccgcggttgatcatcccccgtgggccgcgctaggattcggggggaccagcgcggcttcttttgacaccccattctcgcacttttggccctgc

SEQ ID NO: 531399 - DNA, 1081 bp, Homo sapiens
ggcaacagcttccacaactgcttcatctcatgccaacactaatttattcccacactgtctttgtacatttcagagctttggtctacctgagtgggcctccttattcccactgtgccagggaaggtaggtttctactggctgactgagtactgtgagtagaggcaacactagatgccagcatgggtcttacttgactggggcagtaggctagagtgagggtgtggggtaggggtaggtaggggagtagtagtaggccagggtaactaggaatccctggtggattttctgattacctgtggtgagacggacagctacaggacctggagaaggggatgcagaggcaggcctgctgaccacacttgttgcaatcacaaaggtggagggtcctggtgccaggcagtgaactggcttctaatgtggggttcagtcagtgccagcaagtgggggaacactttcacgtattgcgctaggtacagcacttcctgtctgcatttcctatccctttgcaccagcttgaagaaatagagtaagacagaatcacacatcatgtggtgggccaatggacctaagtacctgtggtgaaccagttactactgtagctggagatcataagcacttgactacagtaacatcttagaatataatccgcgctctcaaccctaagttaagactcggacgcaaacaaagaagcatccaaagacaacagtgacttgagctatagatagtcaaaataatacgcgaagtgcactggtaacaggtgtcggacagcacggctggcatgaaatacaataagacagaacctattccgtggcagtgaatcctgcagaccaccatactcttccatatattatatatggcccagccatcggacccgagcggttctaacgcgggcgtcgcggactagggagacaaagaaaacgtcacggacccgaacgggggccccgtttggtggccacggcccaccagacagggagaagacgaattgagaagaggagagactaggaaaaggggacaaagggaggagcacccaggtgcgaggggacaagaagcggcaacagcagcacaaggacacgatgactca

SEQ ID NO: 531400 - DNA, 290 bp, Homo sapiens
accccttatagctactcgctcaccacttctgtttgctctgtgacgtattaatcctagatgtcaacaccagatgttatattctaacttgtactaactgacgtgtgtcatactatcatggaaggaaacaaaatgtacagatgaacattattcagtgttatgtactgtaggtaaatattcatgtagaatggacatcaatctacttagcaatatttggaggctatttcaacattgcactgtagaaatgtaaagtaatgtatgcgatgtaaaggaaagcccgcgagtcgcattat

SEQ ID NO: 531401 - DNA, 167 bp, Homo sapiens
  misc_feature (110)..(110): n is a, c, g, or t
gacagctcaggggacgaagagtggagaagaaagctcacaatattagcatttaaactgcagaaaagaaggcaagaaaaagaggggctgaacttgaagaagaagggtgaggntctaaagctatagacagtggagcatacagggcatggcactttattaggggctcctca

SEQ ID NO: 531402 - DNA, 555 bp, Homo sapiens
aggaaaagatgatcgccgtttgggtaaaaggtggaggagggccctaaattcttgaagtctggggacgccgccatggttaatatggttcctggcaagcccatgtgtgttgagggcttctcagacaatccccctttgggtcgctttgctgtttgtgatataacacaaacagttccggtgggggtcatcaaaccagtggacaaaaaggctggtgggggtggcaaggtccccaagtttgcccagaaaggtcagaagggtaaatgaatattatccctaaaacctgcccccccctttttaatcagggggggaagaagggtttcagaactgtttgtttcaattggccatttaagtttagtggtaaaaggcgggttaatgataacaatgcattgtaaacccttcagaaggaaaggagaatggttttggggacccctttggttttttttttgggggggggcggttttaagttattagtttttaaaaacaggactttttaaggggaacaacttggccaaaaatttgtcccagaattttgggaccccttaaaaaagttaaatggga

SEQ ID NO: 531403 - DNA, 358 bp, Homo sapiens
ccttgagaatctccaagtgggagccacatggccactttattctccactggattcactctaaagacacagatgggccaggcatgtgtcatgcctgtaattccagcactttgggaggctgaggtgggcggatcgcctgaggtcaggagttcgaggctagtctgaccaacatggtgaaaccctgtctgcactaaaaatacaaaatttagccaggtgtggtggtgggcgcctgtaatcccaactattcggaaggctgaggcaggggaatcacttgaacccgggaggcagaggttgcagtgagctgagatagtgctgctgtactccagcttgtgtggcagagcaagactccatctcacaaaaa

SEQ ID NO: 531404 - DNA, 232 bp, Homo sapiens
acgtttttgtggagtaaattttgggattggggggaaaaagggaccaccggcccatagccttggggttggacatctttagtgtagctgccccattgatttttttataatcccttggggtttgtacatttttggggggagaacaccaaattttttccttaatatatggacctagcttgaggcatttttaatcccctgccctaggcaggtaataataaaggttgagttttcccca

SEQ ID NO: 531405 - DNA, 146 bp, Homo sapiens
agactaacgccaggccagagcgatggaggcatccacctggcagaaaggcaaactctgtagactggcaggtattttcttgtgacatggcagttgtcacggatttccgtggactgcatctctaacagacattgctcctcactcatgca

SEQ ID NO: 531406 - DNA, 226 bp, Homo sapiens
gtggcctgtacgctgtgtggctcgtggatctttttaggacgctggtcgtgttgccttagggcccccagtgctggaggggcagtcatctagcactgatgatgcctcgcagtgatgctgtctcctgatcaggtcatgtcgtgaagtgtccagagttaagactttgacgtgcgaatgggggagtggtgcgggacacaatatcagcccctgacagcagctcgcccctgag

SEQ ID NO: 531407 - DNA, 1507 bp, Homo sapiens
  misc_feature (829)..(829): n is a, c, g, or t
gcgtcggggtttccttgcttcaacagtgcttggacggaagcccggcgctcgttccccatcccggccggaccggccattagcccagcccatcctgtctacatccttcacgcgcaactccatcggacggcacccgaaggatcgcctcggccagctcagctcactagcgccagggcagctcaacacgcactggcggccaggcagcacttcatccgtatcagctcgcgctgcgcgatcgacagaattccgcgtccacgcgtctggcaagcgatgtcggccacacgagatcttaccaacgcagtgtactttcgagtatggtccgaccaagtctaatcgcgtcgcgagagtcacatgctggcatgcgtcttacgacctcgctacggttctaatgctagatcgctattgctctatgacttgaactttatgagcccgcgaatggactcgtggccttgttgatatgcataccatttggtccacacagtaccgtcctcctttcatctcacacatctcactgatggacgaggggacacctaatgactgacgcaataccttgaatgcaagccatgcagaaacccttggcgaagcggatcgtcctcggatatgcttgtcccttttccatggggcataagtaccaaagtagaagcgccacgaatctggttggaatcgaatcttgggtggcaggtaagcaagagagccttgcagaattgcctacagtaggcatgctcggtaagacacttaagcaatttatgaggcatataaaacacagggcttggaaatcacggtccaacataatctgggggtaccccttcgcaatacaacttcggggggcccncccctggaggcaaatataaagattgtgaggccgcccacttgtttagttgttgtagcctcccctagtatccgaacggaaactattcactttgaacccttgtaaacttggaggtcgacgcgcttgaaaccacgcccgattcttcccaggcatattcggcgtgctgtgagcccacccgattggaattgcacaccccttttggttcgcttacttgcattaggggtggaaggccggccccgggaatattctcaggggcatatgggaggggcgaaactaatgcttcctcttttgaaagcatactggccaacaatttcgccttggggcaatgaaccaggtcgaattcacttggaacacacgcctaagggccacatcaggggcgtaaaactcttccccccaattaggtccggttgggcgtgtggacttttgcccctgtggggtgcaacccaaaagcgggcaggtggacaatggccagtggtttggcgggggatgaacccgtttaaaccggctttggccctatgtgacggtttcgctatcgccaagaaaccagtgccacgtttcaagagtcctcttctgcggtgtcgggtcgccacgtcccctctcaaggtatagcaaagggttgggggtccccctaacacagacacacaccacagtgtgagcctgctgggaaccaatggacaacag

SEQ ID NO: 531408 - DNA, 318 bp, Homo sapiens
  misc_feature (11)..(11): n is a, c, g, or t
taggcggtacngcgatactagatctcgggtcatacctgaaccgctaccaccaaagccagaggtcgccgcacacattccgggtctttcgataaagcgtaatggggctaagccggacaacatctggagtggctttcgccaagggccagatggcaactgcgttaccgtatcggccatcaaggcagccatgtaccgatttggtcaaagcctacggacatttttcgctcagtgagaaaagagcctggcggttatcacgtggtcatgcgcgacgatttccagctgagattgaccgactcggagttggcgcaagcagcacaaggt

SEQ ID NO: 531409 - DNA, 355 bp, Homo sapiens
acacaggctaccaatggcaggacatatcaagggggactggagcccacgaaacagcatacggagagctaaagccattcatggtacccttaatcaaggtctccttccgatctgtgtcttgaggtcaggctcctcctgtcttgttacccactgtgtttctcggctctagctcttctccccagcccctgcccaataactaccagctgtcattgagagaggctctgattggtcccagggatagccaatgggctggctggctctggataggggtccacccggatccagccggccctggctgggagaggcagggggcgggacagacagtgacagctaagtcagtccaaagggctgcagaatt

SEQ ID NO: 531410 - DNA, 145 bp, Homo sapiens
atttgttttggcctccgggccccctcgctccccacccacccgggccccttcctccgggggtcacctggggcctccatcccaaaagggcaggggttatttttttgattaaaaaaaataaaaagggccgggccccttttttttttta

SEQ ID NO: 531411 - DNA, 464 bp, Homo sapiens
ttccagacccaagccccccccaaaacaaggggaagtcgggcagttcagtggccttaccctggagggggcccattcccccccccgcaatttcgccaaaaccaaaaaatagcccccgcccccccccctgtgccccaaatgatggatttattgtacaaaaatcattttcccattttgggggggggtcaccccaacccctcaggcccccctgtcacggggaacaaggagccctgggggatttttcttttcctttttttaatgaaacaaaaaaagggccatgtcccccaggggtttttcctgcctgcccctccggtgacttttaacaggattctggggccaaggtttcaactcagggcaacggcaggccaggttgtgggtttccacccgggtttggccccaggggtggcaaccggattttggggcaacccctttggtttttttaaaaaaggtcaaaggtggtttttcca

SEQ ID NO: 531412 - DNA, 690 bp, Homo sapiens
ggaaacgcgcagtgagtgattccgcgctgtgtacggactaacacttgtcacccagaaggacgttcaacctccaaaggagaaaccaatgatatatatctcgcggagagtgtcacacatcaaaatgagaataaagtctagggatccaatcaaatgcagagaatgtaggtacagaataatcggcaagaaaaggactaaaccattgctcgtttttgaagctctttgaatgctgtgaatttacaggaatggatagacttataccaggatttgcgctctgtccaatactgaacggtgaatagattatcatattgcttacagaaagatcccccttatcttgtggagagacaatccaaggccaccagtggactcctgagaccttatacagaaacaaacctttatacgctgcgttgtccatatatatatatccaaggtaaagtataaggtgtagattgagcatttccagacgcttaaagttacggactagaacaatggtaacaaccatctggaaacgtatgtggatgtgcaaattggagtttaacattaaaacctttttatgggaacctttttgataatttggaaaaggtaacaacttccttaacgggcccaacggtgaacccgcccttcagttggaaccccgggttcacattttggacaagctcaagggattcttttattccgcggaattttgggctc

SEQ ID NO: 531413 - DNA, 966 bp, Homo sapiens
attattcccttgagctagcggtcgtctaggtcggagctatctttgggggcccactctgtcgaatgggctaggtcgtcactcttgagttcgtagctgattctagtgcttggaactgaactgtgtgtagtgttttgattcggagttgctgaagcagttcgaggataagagctcgtctcaagtgaaagtctgcaatttaggtatttacatcgagctaaagtcagagggtgtagatagagtcctttataataggctgatagctgcttgcatggaaatatagctctccggaggatgattcatattgcaattaaggaaacaagtagtaattgatcattaatgtaatcaatgagtggaggaatagatggtaataactgataatttaaggcgccgacttgttccgaagtatgttgaagtaccatgaaggttgtgatacgaagggaaagctatatgaatattgtgactgtttggtctcacattgacgtagtatagacccgtatgtgatatcatatagcatgattcctaaacttactaattagtatgagttcttcttgtcctctaagtcgttatccatgatagcaaggcatggtgaggggggttaaagagaaatggagatattgcaaaatctttaggttactcctcatgtaacgcaggtaggatgagtactaggaggaatgcgcgtaggcttttagataaccgttcttaatttaatattaaatgatggcaggtaaaagcagatgcgtaataatggcaatttaactgcagtgcatgagcttatatattttgacgaggagttggctgcttagtgccttttcagtgagcttgttctaagggggccgcaaacagttttggaatggataagagacaaaagaagtgtatcgacttgaaacgggatgtataggaggacacttaacccaaaaaaaaaaggggcagaaatatgggagaggaatcgttacgccgaggcacgccacc

SEQ ID NO: 531414 - DNA, 913 bp, Homo sapiens
gtggaatttggggttgctcttggaagtggccttgatgaggatcctttacaactattcagaggactgtgtgaagtagttactggaaaaagaacttgaattatgcatttattggcattaatgtaaacagtaagtcctaagctttgatggaagggtccatacatttttttttttttctggcggatgtggctatctagatgttctctatagcaattaatagcaaaaacctttacattctgggcttttataaactttaccagtgttgtctgaattcacatagtgtgctggtaacacacagcaacgagtttcctctctggcacaaatcctgactgggcctatcgggggtgatggccagatctttagccatggaccatacttggagagattatgctttcaaacagaaaatggccacccctactcctttacccagcataaactctagggtctacactcttaaaataatggcttacagtctcccattaaactcccctgtgcgccctttcctcttgcttggcaccatgctcgctgtggcaaacacctcatctcttgacataaatgggcggatccttaggcttaatcgtgttcctggcagccaaaaactgactcaggagaaagccatatttaccccaggcgtggaccgtgttccgctttccaaatgccttggaaccaggacacctacaatggaggggcccttataaaggtttccgcgacgtggccaataccctacacaacttcgtggaggcgcaccacatttagactacccccccggtttatccagaaggccaccaacatatcaatacagagccaccgtatctggacagcttcacaaggaagattccctcccagagcctccacgtcgtccacgcagagaaggtcattgcactacgcctcagcggacgaaaacaaccaagagcca

SEQ ID NO: 531415 - DNA, 437 bp, Homo sapiens
  misc_feature (12)..(12): n is a, c, g, or t
  misc_feature (40)..(40): n is a, c, g, or t
  misc_feature (113)..(113): n is a, c, g, or t
  misc_feature (119)..(119): n is a, c, g, or t
  misc_feature (129)..(129): n is a, c, g, or t
  misc_feature (135)..(135): n is a, c, g, or t
  misc_feature (137)..(137): n is a, c, g, or t
  misc_feature (146)..(146): n is a, c, g, or t
  misc_feature (360)..(360): n is a, c, g, or t
  misc_feature (417)..(417): n is a, c, g, or t
gcggatgacgcnggttgcagcgggggggcccggggcttgngttggcatgggatggggaacgcggtggcttccgcgaggtttcggcagtggcatccggggccggggtcacggcngtggantggggccgantcgagncngcggactcngcgaggcaaggcgaggataaggagtggatgcccgtcaccaagttgggccacttggtcaaggacatgaagatcaagtccctggaggagatctatctcttctccctgcctattaaggaatcagagatcattgatttcttccctgggggcctctctcaaggattgaggttttgaagattatgccagttcaagaagcaagaccccgtgccggccaacngcaccaaggttcaaaggcattttgtttgctatccggggacttacaatggccacgtcngtcttggggtgtttaagtgc

SEQ ID NO: 531416 - DNA, 176 bp, Homo sapiens
tttactttttttgggggctctcggtatcctttatcagggacaaacccagctggccccaagcctacggcaaaatctggtatgtacagtatagtctaggtgggggggggtacaggagctggcctggctggcacctctcaaggccttactcggtacacaggcgggatcctctaagagtc

SEQ ID NO: 531417 - DNA, 1122 bp, Homo sapiens
cagaggcagcaccaccacacagtcacccctccctccctctttcccaccctccaccatctcacgggcccatgcccgagccaccgtaaccacccgtgccacctaagacccgcagatccgtcatctgtccgtgtttacgttagcgcacatgagggatcatgagtaggtctgggaatggacgaggaaagggcaaatgtaggggcgtgtggtttcccttgtccccgtgtccggaccgtccgaatcccaggtgcgtgtgtctctgtctctccgtagcccctctctcacatcatcacagttcccagtggtggcctcgaagaaaggcccaggaagcagcgcagggcgtggagaataacgagccatcgttgcccgtcggcgcctgcgtcaggacccgtgggcgtaccaatgtggcgcacgaaactgctggtgggccccacgtgatccgcgcaatgacacgttcacccattagtcatcccatgcggtggccatcctcttggccccattgtccgtgagagcgccagcgaacagcagaacggggagtgggtgcagggctcatatgcggcgaggaacaggcgagcgagcgtcagcaggaagggcactgcggttgggcacgggtagggctgtatggcggcacctctagtgcgtggctgtttcaccgcgcagaggactagcaggacagcttgccaaaagagtagtagttcgaatcgtttcatgtcaccggcgaacagaacaggaaacaaagaaacgacacaacacaggacaagccaagaacggacacgaagcgacacgacacagccgcaacgacaaagagaggggccgaggaagaagcctgccacagaagcagagacaccgacacgagaagacgccaagacagacagcacagcaggcaaagaaagccgcgcacagagtacgcgccgcgagcaacacgaacacccagggacacaccacgcgccggtcgcataaacagacgagagccagcgggcacacacgaggcgacggaggaaacaccagagaaaagaaaccacaagaaacagaggagcagagaaaccagcggagaccacaccgcagaggcatctgcacagcgccggaaaaaacaagatagcgcagtaaaggcagacaaccgcaccg

SEQ ID NO: 531418 - DNA, 701 bp, Homo sapiens
gatcctgtggtcgtcgtctcgtgtggctgctgagatcgatcataggttccttcaagtggtcccttattttaactaactgtccaggacctgcgctccactgtcatcgaagaagtcttgagatgggccactgtggctccggaagcatgtgtctgaggtcatcgtcttggacatgtcttggccagcaggctgttgggcagaatcctgttagcacacagccagttgtgggatgcaggaattccctactctgttccagcatggagctgcccagatgatctgtgggtcaggcctaaaagctgtgtgccttgcagtccagtcaatagggataggagactccagcattgtggttgcaggaggcatggagaatatgagcaaggctcctcacttggcttactctgagaacaggaggtaaagataggtgagattgccactgactgacagtatactctgtgatggtcttacagatgcatttcacaactgtcatatgggtattacagctgaaaatgtatgcccaaatagatggcaagtgagtagagcaagatcaggacaaggttgcagttctgtcccggaacaggacagagaatgcacagaaagctggcattttggccccagagattgtacccgttttggggtcaactacaaaaggtcttattgaacgtaaaaccgatcagtttctccccatgtggccacatagtaggcctgtc

SEQ ID NO: 531419 - DNA, 300 bp, Homo sapiens
ccaccatgccccactaatttttgtattttttgtggagacagggtttccccgtgttgcccagggtaatctcaaactcctggactcaaacgatccaccggcctcagcttcccaaagtgcaaggattccaggtgtgagccactgcacccagcctttttttttccttatacttattttataatgttctgcaataagcagggtttttgaggcatgaaaaaaattttaagttaaaaaatgaaatagtcaagtagcaaatacattactgagaaccattttcttattaaagagcaaactatgagaata

SEQ ID NO: 531420 - DNA, 222 bp, Homo sapiens
agatcgacagctccaatcatctcagcgatcgtcagatcagggtcatccggtcactgtggtacggcatcggggttggcggcgtgctgatcgccgggttcatcatcctgtatcccggtcacaccgacctctggggcatcccggagtggatcgccggcatccagtcgatgcccagccgctgatcacggagcggaggtcgccgtgatcgtggggaccggcaggttg

SEQ ID NO: 531421 - DNA, 442 bp, Homo sapiens
ctgcaatcagccgtcgtcgtttactgcaaggcgcgggtgccatgtggctattgagcgtaagtcaggtcagtctggctgcggtcagccaggtcgtggcggtgcgcgtctggcctgcgtccagctacacccgcgtgacggtggaatcaaatcgtcagctgaaatataagcagttcgcgttgagtaaccctgaacgcgtggtggtggatatcgaagatgtaaacctgaactcggtactcaaggggatggcggcacaaattcgtgcagacgacccgttcatcaagtctgtccagacgggcacgaacagaaccgataactaccgggcttacaatctcaaggtgagacgggttaaacgcagcgcaggtgcaccaggcgccatcggtctggagtcagacgagaagccatgtggtatttcacgtcacccgtgcgaggtgttctttatgtt

SEQ ID NO: 531422 - DNA, 195 bp, Homo sapiens
agacggggggctcaggcagtctggctccatcattcacgttctaagcgtgtgtgtgtgtgtgtgtgtgtactgtgtgtgtgtgtgtgttttggccagggtggtaactgtgtatactacctccctgatgctgctggaaccttctatagagaggaaacgctgagtcaagctccagatgacaggccaggcagagtgact

SEQ ID NO: 531423 - DNA, 142 bp, Homo sapiens
gcacgagattttacaactgtggaatcaaactcatctacactgagtggcatagacaaggccaaacacctggtaactggcaaagctaggatgagacccaaccttccaaacatctatctacccgctaggtgtggcaacttatgcc

SEQ ID NO: 531424 - DNA, 446 bp, Homo sapiens
caatctgttcccatccaggagagaattgcacacagttgacaaagcgtctgtggtcgccaactgtgaacttgaacttgaatgggggtccctcaaagagtgccgcgcagtaatcatcgcttcccgtagccagccggtatggccggctctgcttgatgtccacgctgtagatgactttgttgtgtcctgtactctcgcctttagaagagccactatcccagaggaagactgctccaaagttctacccttccttccccgaccaaggagaatcctctaactagtctacagtccaagcaatgtctacgatcttcccagcgaaaggctgctaactcatacttcaacaggtgctaccttctgcgtggtattcccagatccttcagcttcccagatacatctccggaggcaatgtacaatccgctagagcaccattccttggtcaacaacaggta

SEQ ID NO: 531425 - DNA, 178 bp, Homo sapiens
tcaaagtcccatgagacaggtggagatacctttattactgttaattctgcagagtattcttggcgccacccagaataacttgtaatcttacacatattaggtattctcgtataatgcagtaatcctcattacctaattcaatttccttctcaatttccaacttaggcactggtcaggc

SEQ ID NO: 531426 - DNA, 320 bp, Homo sapiens
ctgggttacacaactagggtcagttttgcaggtggttaaagcatttaccaagatagttgtaggtaaagaagggcagatttattagagaaattgtgaaaatatgttgcagatgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 531427 - DNA, 361 bp, Homo sapiens
acctcctaccacggaaatataaaagatactcagaaactatgaacacctctatgcacacaacctagaaaacctagagagaaataaataaattcctgaagacacaaaatctcccaagactgaatcaggaagaaattgaaatcctgaacagaccaatatcaagttctcaaattgaatcagtaattaaaaaaacctactaaccaaaaaaagccctgaaccagatggactcacagccaaattccaccagacacacagagaagagctggtaccaattctactgaaactattccaaaatacagaataggaaggactcttccctaactaattctctgaagggcagcattaccctcgtggggtaggaggt

SEQ ID NO: 531428 - DNA, 535 bp, Homo sapiens
  misc_feature (205)..(205): n is a, c, g, or t
  misc_feature (335)..(335): n is a, c, g, or t
  misc_feature (360)..(360): n is a, c, g, or t
  misc_feature (366)..(369): n is a, c, g, or t
  misc_feature (372)..(373): n is a, c, g, or t
  misc_feature (375)..(375): n is a, c, g, or t
  misc_feature (379)..(382): n is a, c, g, or t
  misc_feature (386)..(386): n is a, c, g, or t
  misc_feature (388)..(388): n is a, c, g, or t
  misc_feature (392)..(392): n is a, c, g, or t
  misc_feature (406)..(407): n is a, c, g, or t
  misc_feature (410)..(412): n is a, c, g, or t
  misc_feature (420)..(422): n is a, c, g, or t
  misc_feature (425)..(425): n is a, c, g, or t
  misc_feature (427)..(428): n is a, c, g, or t
  misc_feature (430)..(433): n is a, c, g, or t
  misc_feature (438)..(438): n is a, c, g, or t
  misc_feature (442)..(442): n is a, c, g, or t
  misc_feature (445)..(447): n is a, c, g, or t
  misc_feature (456)..(456): n is a, c, g, or t
  misc_feature (458)..(458): n is a, c, g, or t
  misc_feature (463)..(463): n is a, c, g, or t
  misc_feature (467)..(467): n is a, c, g, or t
  misc_feature (469)..(469): n is a, c, g, or t
  misc_feature (481)..(482): n is a, c, g, or t
  misc_feature (486)..(486): n is a, c, g, or t
  misc_feature (491)..(493): n is a, c, g, or t
  misc_feature (498)..(498): n is a, c, g, or t
  misc_feature (502)..(504): n is a, c, g, or t
  misc_feature (507)..(508): n is a, c, g, or t
  misc_feature (511)..(511): n is a, c, g, or t
  misc_feature (515)..(515): n is a, c, g, or t
  misc_feature (517)..(517): n is a, c, g, or t
  misc_feature (530)..(531): n is a, c, g, or t
  misc_feature (535)..(535): n is a, c, g, or t
taccacgatatgggctaacaattctgttatccttaccaggatatgggctaaaaatttttttgtgtacatgtacacttaacatatataccaggattgaataaataagtagcaaagtttttactgtccgaaacagaatccaaggaaaaatgctagaacaaactctgtggatgttgggttgaaatccgaggtatcggtatgaatcacntatgagtgcatgcttttaaatacacccgagagttgcacacacacagcagtttgtacatataaaagtagatatgggctatgtgtgtttacctccggtctagtgtatatatgttctctgcccctgtcccccntggagggaccttgaaacagtgaacntccccnnnnccnntngagnnnncccnanttcnccccaattttgggnnccnnnaatacccnnnccncnnannnnacaangggnccnnnggaaaaacntnggganaaantntttttattcccnntacnggggnnnggccnaaannnttnnaanaacntntaaaaatttttgnngggn

SEQ ID NO: 531429 - DNA, 455 bp, Homo sapiens
tctgcagacatttgttgtttccagtttttggccattacgaataaacatttgagtacatggctctttgtgaacatgtttttcttgcccttgggtaaatgagtgggattgttgcatcatacagaaagtatgcattttaactttttaaaaatctgctgggcggattgcttgagccccggagtttgagaccagcctgggcaacctggcgaaactccgtctctaccaaagatacagaaattggtcgggtgtggcctgtgcctgtagtatcagctacctgagaagctgatggaggattgattgggcctgggaagttaaggctgcggtgctgtgctcacacccctgcattctagtgtgggtgactctgtctccaaaaaaaaattttttttttttcaaagttgtaccattttgcatttctaccagcattgtatgagtttcagtagttcctcatctagccgcat

SEQ ID NO: 531430 - DNA, 317 bp, Homo sapiens
gagagggagtctcgctctgttgcccaggctggagtgcagtggtgtgatcttggctcactgcaacctctgcctcctgggttcaagcaattcttctgtgttagcctccccagtgggtgggactgcaggtgtgtgccaccacacctggctgttttgtatttttagtacagacggggtttcaccgtgttggccaggctggtctcgaactcctgacctcattatctacctgcctcagcctcccaaagtgctaggattacaggtgtgagccaccacgccctgcaacattaaatattttattaatttcatctttttcaagaaat

SEQ ID NO: 531431 - DNA, 102 bp, Homo sapiens
tagaaagaagcaaaagtctcaagcttatcatattcccagaagaaaaataaagaatgttactgtggacagagtatactgaggacggctcgggtaaaggaccag

SEQ ID NO: 531432 - DNA, 372 bp, Homo sapiens
ccgccatgcctgagcttccccccgcccccgccgtgggctcctgtgcggcccgagcctccccgacgagcgccgccccctgctccacgatgcccagtcccatcgaccacccaagggctgaggagtgcgggctcacggttacaggattcccatttcagaactacgaccatttgaaaaatagaagatttaaagattgacgcaaagtgcatgtaccatgatacaccagacggagtctcactctctcgcccaagctggagtacagtggcgcaatctcggctcactgcaagctccgcctcccgggttcacaccattttcctgcctcagcctcccgattagctaggactacaggcgcccgccaccacggccggctaattt

SEQ ID NO: 531433 - DNA, 106 bp, Homo sapiens
  misc_feature (6)..(6): n is a, c, g, or t
ccatgnttgggcatcatggctactgcatcttatgatactcgagtatatatctgggatccacataatggagacattctgatggaattggggcacctgcttcccccac

SEQ ID NO: 531434 - DNA, 199 bp, Homo sapiens
tatgcgcgggtcgtgtgtgtgtgcggtcgggctgagcagtgagctgcgcaagtgtaatcagtggatgctggtttgagcgaaggcagagtgagctgctcctcggtctccaccacagaggactgcattgcccttgtgctgaaaggagaagctgatggcatgagtttggatcgacgcaatctgtacactgcatgcctctttg

SEQ ID NO: 531435 - DNA, 634 bp, Homo sapiens
  misc_feature (283)..(283): n is a, c, g, or t
  misc_feature (455)..(455): n is a, c, g, or t
  misc_feature (464)..(464): n is a, c, g, or t
  misc_feature (621)..(621): n is a, c, g, or t
acaactcgttgttggccagtcggggaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaaggggggggtgaacaggagaagcaagcagccgaatcgtaatgaggcgtgcgccgccaatatgcactgtacattccacaagcattgccttcttattttacttcttttagctgnttaactttgtaagatgcaaagaggctggatcaagcttaaatgactgtgctgcccctttcacatcaaagaactactgacaacgaaggccgtgcctgcctttcccatctgtctatctatctggctggcagggaaggaaagaacttgcatgttgatgaagaaagaagctaattgnaagaaggcncttaaaccaaaaggacatctagagtaaagcgcagcttaccaatggggcctgcaggaagtcatgcacttttatcaaaggtggccaattttttttggctcaatccctttcgaatacgggaatttccaactccatccaccaacaccatttaaagtttaanagcgtattaaaaa

SEQ ID NO: 531436 - DNA, 826 bp, Homo sapiens
  misc_feature (61)..(61): n is a, c, g, or t
  misc_feature (67)..(67): n is a, c, g, or t
  misc_feature (70)..(71): n is a, c, g, or t
ggcgcaggcaggagggaacggctggttgcaggtttctctcgccctggtccgcgcggcccgncgaggnggnnaccaaggtgggtgcggggcccgggcccgggcccaggacacgcggggactctcgggagccgtgggccaggcgcttagccggccacctcgggccctgtccaggcccaggcgttccagggctgctctgcgggccgcgtgcgagagggactctcgggaggccccggggcgccgcacccactccttcccacttgggactcccgcgggcgcccggctctcgctcctctggccagcgtgggcctcccaggccccctcgcggctctctccagagcaggagccccaccttgggccgcccctctcacacctgccgtgggtctggtacgcgcctctgtgtcggactccgcgcccgcctgcgtgggaggaagccaggactcccgggcgaccgggccattcctgtggtttgtgtcagttccacagcagcacgtgggcactttccaccgtcagccactgggcagcccggggcactcctgcagcgtcccctggccctctccagggcaggcgaaggttgggcagtcctgggcggccagcaccccggcgtgcatgtctcctgagcagctgcccatcgggcctctgctggcctgggggctccaagatgcaaggccggcgggagctgggggggagagcctttgagttgactccaggaggaagcagccagcgcttccctccgagtggcacctgagaggctgagtgatgacagttggaatggggaacggacttgcccgaccttctcctgtccgatgggaaagcagtctcattggcc

SEQ ID NO: 531437 - DNA, 319 bp, Homo sapiens
aaaagtaaaggagaccaggcacagtggctcacgcctgtaatcccaacactttgggaggccgaggtgggtggatcacctaaggtcaggagttcgagaccagcctgaccaacatggtgaaaccccgtctctactaaaaatataaaaaattaccagggcgcctgtaatcccagctactcaggaggctgagatagggagaattgcttgaacccagggaggccaggaggttgcagtgagccaattcgagccacttgaactcccagcctggggcaaaccaaggagccaaaattccgtcttcaaaaaaaaaaaagttaaaggagga

SEQ ID NO: 531438 - DNA, 373 bp, Homo sapiens
  misc_feature (58)..(58): n is a, c, g, or t
  misc_feature (330)..(330): n is a, c, g, or t
  misc_feature (341)..(341): n is a, c, g, or t
ggacaggtgattaatttttaaaaaaggtgggaagggggcagggtccttttttaaatgncccagcagaaaacccaagggtggaaataacttccttaggagtaaatgatgtttactttaagctgctgctccgtaattcacccacgctgacgttggtagattacatccacgaataagtcatgtaataataggacagccatgaaaaatgtagagatgtgtcaacagggtggaaactggttccttggtgaagaacaagccatgcagaaagctggatttctaacattctcaaatctctttttatccaaacaatctaattaatggggattgtattcnatgttataacntcacttcaaaaattcctaggcttatgatgtta

SEQ ID NO: 531439 - DNA, 204 bp, Homo sapiens
ccctaaggttctttgcctagcctcgcccaagaattggtgtggcggcttgacctatggcgagttgacagatacttggaccaagtagagagaaatgatctgtaggtttttattgatgcagagcgcaatgttcataagcttcctcatgcttggaatggggtccctgaatgggattcgccacatgcatagctcgtggtgatttgcctt

SEQ ID NO: 531440 - DNA, 335 bp, Homo sapiens
  misc_feature (183)..(183): n is a, c, g, or t
  misc_feature (222)..(222): n is a, c, g, or t
  misc_feature (307)..(307): n is a, c, g, or t
  misc_feature (315)..(315): n is a, c, g, or t
aaacttgagtctggatatgagggaggagggggccacagttagaagtttgaccttctggccgagcacggtggctcatgcctgtaatcccagcactttgggaggccaaggtgggcagatcacgaggtcatgagttcgagaccagcctgaccaacatggtgaaaccccatctctacttaaaatacnaaaattagccaggcgtgtggcgcacacctgtaatcctancgactcaggaggctgaggtaggagaatcacttgaacccaggaggcgaaggttgcaatgagctgaaatcatgccactgcactccancctgggtnacagagcgagactccatctc

SEQ ID NO: 531441 - DNA, 583 bp, Homo sapiens
cgacgccaggatctgacctgcaaatgctcacgagattcctaaacacagcactgattggaacatgagctcttcacggtgcggcggatccttgggggctcctgctctttagtaaaaacacagctcgcctctcatttatccaccgtggagctcctcacccgcaagccctggtggagctgctttgaggatggaccagagcctcattctgtgatgctatcatttctgggtccacagattcactgcactggccatacacatgctcggctgccgggggaccaggaatgcagggtgcgggctcctgacctgtgtttctaaagtctgctcattcacccctcgcccagtgcttctcatgctttcaaggaacacacaccctttcaagggtcttgtgtgtgccaggcaccctgaacaggcccagccccgcacttaatgagctactcacgaatcagaggccaggatggtgaagtgaccggcagtcacactgcttgcacgggggtgacatttgggggcaggcggctgtagggtccatgacgaaaactccactgtcggttgtggggtcggaggaagccgagggctaaaggatgagtat

SEQ ID NO: 531442 - DNA, 362 bp, Homo sapiens
ccaaggacagacagtgtgagggtctatcctcatgcccaagctgggtattagccatctcagagcagaaaaacagactatctggccgagaatcccccccatcttttttcccacaaagtgttcaaggaaagtaacacttttaggaagatacctcatgtggggacaccctatccccgccacacacacactctgcattcatgaagttgaaggacccgagctggaaagagattccagcaaccttttcccaccgggcaccgcaatgttggcaaagagatctcccaggcagtgaatgttcagccagtgttcattgacttagacccaaaaagcccacacagagcctccccgcattataataaaggaacccg

SEQ ID NO: 531443 - DNA, 400 bp, Homo sapiens
  misc_feature (269)..(269): n is a, c, g, or t
cagaaagagttggagaaattttgcacccccttttttcccaagttgtaccaaagtgcaggaggcatcccaggaggaatccctgggggtttttttggggggggggctcctccttttgggggggttttctcagggccccccctttaaagggtttttttacccccccaagtttaaatgtagcttttttcccccctttttaaacttttgggggccctaattttgtggcaaatttttgggccgtttttaaaaattaaccgccctatagtgggttnttgggctttttcaaaattttaatttggaacatttgcccgggggaaggaaaaaactttgcctttttttacccctttttttttagtggaaaatccaatttttttattaaaatttttttaatttggccccctta

SEQ ID NO: 531444 - DNA, 605 bp, Homo sapiens
  misc_feature (446)..(446): n is a, c, g, or t
  misc_feature (502)..(502): n is a, c, g, or t
  misc_feature (526)..(526): n is a, c, g, or t
  misc_feature (528)..(528): n is a, c, g, or t
  misc_feature (605)..(605): n is a, c, g, or t
aaattgtttttaataaaattgcttcttaggggtataaaaggaaatgcatagacacggtatcagcattctaatattttgccacttaggttgatttactttgctgataagaattatggatatcgagtgtacagtatgtgcatgtgtcacatatttatgtataattgtgtatggaaattgtagcacatatacatatactaattatgaaaaagtgtctgtatacactaaatttaaatcctaaccacatctgagtttgctatagacaaaacaattcgctagctgtcgtatggtggattgaaccttttgaggtaagaaacttgcagtgtcagcctagtgcaattcggtaagaaattgtgtgtgtattaaattggaactgtctgatagctgaataagagcctaagctcatcttctgttcttctggccatccaatgaaacggagcagaacacanatttctttccccgctgctctgtagctcacctttctgaaatgtctttgaaatctttnctctccatcttcatttttctttgntnattatttacatcataatttgatgtgctgtcttcgcctttgatgcgtatccttctagtgttttatggctcacttttcn

SEQ ID NO: 531445 - DNA, 322 bp, Homo sapiens
cactcaacaaacccacaggtcctaaatcaccaaactgcattcaacacatttcggttggggcgcactcggcagccacaacccaatctccgcagccagtacatgctcaagacttccacccagtccaaagcgcaactcactcatcactcacattgcatcccaatcacacttgcaccaaaccggcaaccacagttcacccctacagggcatcacaccagcgccaatccctcatatctcagcagatcccatcatccaaccaatcagaggtattacgcaccctcgcatagtatggcatccagcgcaccatccccgcataggtgccagc

SEQ ID NO: 531446 - DNA, 603 bp, Homo sapiens
aaattgtttttaataaaattgcttcttaggggtataaaaggaaatgcatagacacggtatcagcattctaatattttgccacttaggttgatttactttgctgataagaattatggatatcgagtgtacagtatgtgcatgtgtcacatatttatgtataattgtgtatggaaattgtagcacatatacatatactaattatgaaaaagtgtctgtatacactaaatttaaatcctaaccacatctgagtttgctatagacaaaacaattcgctagctgtcgtatggtggattgaaccttttgaggtaagaaacttgcagtgtcagcctagtgcaattcggtaagaaattgtgtgtgtattaaattggaaccgtgtgaagaaaaaacacacatgtgagaatatcagagataccttagactcttgacacatatcactgtataagagaccaaaagcatattttgttgtttctcggccctccctgtgacgggcacaacacacaattttttttccgccggtgtgtggacacacctttgagaaacgcttgaaaaatcttttcctcaccatccatattaattttggtttagttttacgccccccttttc

SEQ ID NO: 531447 - DNA, 1013 bp, Homo sapiens
ttgccggccttttcaaatgaggtgaaaccccccgccccgtgtgcccgcctttacacaggggcccctttttgagccccctgtccttgtatggacccttcccgggccttagcccaatgtggaattgttccgcattgccccgcgttcccatttgacggcttccgtcaatacttaggccctacttgtgccccacccaccccggtgccccagtattgcccacatgatgggcgcccgagtgtgcaccacggaggaaacgccaccaatacccccaggcccacaccacaacaacaccaccggtggcgccaaaagggccctttcgattaccggggattaaagtcccctaatgttagttacgcctccacgagagttttttgttttccttttcgccaccgcgagttttttttctgagcgcctctttgagccacatcgccacgcctctatggccccttagccccccccacttaaggaggggccacctgggcccccccacacacggcacttcacccccgcctataattcccctagagatgttcccaccactccctctaaccaccactcccgctattacctctcgccatccacggaggtatttcacatcaccgcgtgagggctcacccacatagggtgctataatagggaaaccacacccgcgaacccccacatataattcacagccacctggcttatttacccaatgtttacactgggttctctaattttacccctcctaccacagcctcacagaggtaacttcgaagtcttcccttcacccacatttccgacggcaatttatcggctcaacacattttttgtaaccaccacaggcttccaccggaacttcaccgtcacttattggctcacactttcctcacctatctgcttcatccccccactaatatttcacctttacactcccaacatcacctttggcttcgaaagcccccccctgatactggcacttttgtagatgtggtttgactatttctgtatgtctccatctattgatgagggtctta

SEQ ID NO: 531448 - DNA, 509 bp, Homo sapiens
  misc_feature (32)..(32): n is a, c, g, or t
  misc_feature (411)..(411): n is a, c, g, or t
caaaaccggccaagttttatcgtgatgagctncccctggggggccaaaaatgtcggggatcccgggaccccccctgcggagaggggaattaagcctggtcttcggccacagagccccggtggggcccccaccttctatgtcccgggcccccagactgaccaaaccctagtccttctgatgggcaaagaaggggtccccggggggttggtcaccaaaagatgtatataaagggccccccccctcggggggtcccagaaatgacctggttagtcccttccccttaaccgctccccgaaggtttgcccccctttcccccccaaacccccccaaccccttttattttttgggcccttcccccaaccccctttttgctgccaaaaccccatggggtgggggccaggggtggatggncaaccccccccccccccccaaatcccccccggggggggttggaaaacttttgttttttggggttttttttttttgaataaaaaagattctcctaccca

SEQ ID NO: 531449 - DNA, 610 bp, Homo sapiens
  misc_feature (610)..(610): n is a, c, g, or t
aaattgtttttaataaaattgcttcttaggggtataaaaggaaatgcatagacacggtatcagcattctaatattttgccacttaggttgatttactttgctgataagaattatggatatcgagtgtacagtatgtgcatgtgtcacatatttatgtataattgtgtatggaaattgtagcacatatacatatactaattatgaaaaagtgtctgtatacactaaatttaaatcctaaccacatctgagtttgctatagacaaaacaattcgctagctgtcgtatggtggattgaaccttttgaggtaagaaaaaaaactggagtgtgagagcctatgcaaattcgggagaaatatgtgtgtgtgtttaaaattggaaccgtgtgagagagaaatttcacatggtgcgaaaatctcagataccctttagtctcgtgacatataactctgaatgagaccctaagctcatcttgttgttttcgtgccatccaatgaaacggagccactttctttccccgtgctgctgagctcacctttctgaatgtctttgtttgatgtgctgtcttcgcctttgatgcgtatccttctagtgttttatggctcacttttcn

SEQ ID NO: 531450 - DNA, 247 bp, Homo sapiens
gagttcagtggcatgatcatagctcactgcagccttggactcctaagttcaagcagtcctcctattacaacctcttgagtggttgggactacaggcatgtgccaccatgcctggctatttttttttttttttttttttttttggaaaaaacgggttttttacgggttagttttaacttctgggtttaaagggaccttccttaagggtgggatttttggcaaaaaccctttgcccttgggaacatttt

SEQ ID NO: 531451 - DNA, 691 bp, Homo sapiens
  misc_feature (105)..(105): n is a, c, g, or t
  misc_feature (108)..(108): n is a, c, g, or t
  misc_feature (113)..(114): n is a, c, g, or t
  misc_feature (118)..(118): n is a, c, g, or t
  misc_feature (142)..(142): n is a, c, g, or t
  misc_feature (149)..(149): n is a, c, g, or t
  misc_feature (158)..(158): n is a, c, g, or t
  misc_feature (189)..(189): n is a, c, g, or t
  misc_feature (192)..(192): n is a, c, g, or t
  misc_feature (203)..(203): n is a, c, g, or t
  misc_feature (207)..(207): n is a, c, g, or t
  misc_feature (243)..(243): n is a, c, g, or t
  misc_feature (281)..(281): n is a, c, g, or t
  misc_feature (285)..(285): n is a, c, g, or t
  misc_feature (289)..(290): n is a, c, g, or t
  misc_feature (292)..(293): n is a, c, g, or t
  misc_feature (399)..(399): n is a, c, g, or t
  misc_feature (405)..(405): n is a, c, g, or t
  misc_feature (442)..(442): n is a, c, g, or t
  misc_feature (511)..(511): n is a, c, g, or t
  misc_feature (519)..(519): n is a, c, g, or t
  misc_feature (544)..(544): n is a, c, g, or t
  misc_feature (582)..(582): n is a, c, g, or t
  misc_feature (608)..(609): n is a, c, g, or t
  misc_feature (613)..(614): n is a, c, g, or t
  misc_feature (620)..(620): n is a, c, g, or t
  misc_feature (663)..(663): n is a, c, g, or t
gcaatcatatacctgcacctaaaatatacaacctcggcgctgccattgcaggaagacaaagagactgtctagagagtaacgcggcgccgccctggcgcagccccnccnccccnnggcnccaccaaagggaagtgggaatgcncaccccncccgtctcncgccaggccgaaagcggcagggggagaattnacncccggcctgcnaaangcagccttgtgtccccacttcagagccccaacttcnccaaagccagtgcctgggaaatggccttgtcggcagcnggcngganncnngcgcagtgtgccagccgtgcaaacccccaccagactggtgcagtgtgccagctgtgcaaacccccaccagcagcacccccaccagcagccaaagaaaacaatttcnaaagcngcccccaggatttcatgccacgggggtggtgaggggnaggaggaggtggaaagcattgaatcagaaagtcttccaggtaccagcaatgccagggttaatatggtcnggcttgcntttcaggtgagcacctgtagctggnaggaaagtggcgtcgtggtggaggtgggcatgaattcnagaagccttgggggggcgtccggggnncttnncactangtcgtgctgcctcctgggggaattcctaagctttttttgaatnagaaaagcactgacaagcagacagaatt

SEQ ID NO: 531452 - DNA, 384 bp, Homo sapiens
tgtagagcatcccccccgttcccgggtagaggattcccagaggctgcatattttataattgagcctccgggcatactagttttgggctgggaaccttgcttaaagaagacccttaagctgtagaacatttaaacgttgaagccacaacgcagattgaggccttgacgatggagcttgaagatggagccccgtgacctataacctacccacctgttggcctgctttcttgggcgtttctgggaggagttcttagcctgatgaaataacttggggcgtagaagagctgtttaattttaaaggccttagactggggatatattagaggaagcggattgtcaaattaagggggtcattgtgttgagctaaacgctgggaggaggtacc

SEQ ID NO: 531453 - DNA, 238 bp, Homo sapiens
  misc_feature (47)..(47): n is a, c, g, or t
aacaaattggtgaacaaactggtgggatttttgcccaaaaacggggntgggggggcccccttcagggttttcctttcccctttaagggcgaaaaaggggccttccctctccccaaaaattggggtccttttccccccctcctttttgccccccggggggggggggggtggtaattttcagggccctgttgctcccttttttcgttggggaaaaataaagcccaatgttgggcccttta

SEQ ID NO: 531454 - DNA, 350 bp, Homo sapiens
agcactttagcgaatgacttgcttgtagtagacattccaatagtgctacgcgaagcaaagcataaaggaatgtgctgggacaaaataaaactatcatgctcaccattagtaaggtgcatatgacagtgtcataacccaagccccttattacaggcctagagacagatgaggcaaagaataattaagaaacgtgtagtcagcacaggccatgaacatgctggtgaataaccactggaagactaggatgaggagtagactgtgagttttccactgcagctcctgcattcaagatcactggacatgacagagcagtatagttcaagtgaacacgttcagagccatggcaaggg

SEQ ID NO: 531455 - DNA, 255 bp, Homo sapiens
gtgtgttcagtggttcccatacaaaaattagctgggtgtggtggcatgtgcctgccgtctcaactactcaggaggctgaggtgggaggatcacttgagcccaggaggttgaggctacaatgagctgtgatcacgccactgcattccagcctgagtgacaaagtgataccctgtctcaaaaaaaaaaaatcgggatggcgatcaactgtgcatagggagaaattactaaccatgggtaaggacaccggaaataagg

SEQ ID NO: 531456 - DNA, 341 bp, Homo sapiens
tgcctgtaatcctagcactttgggaacaataattgttattgctaataatagcacttagggaggctgaggttggaggatcatttgaggtcacgagttcaagaccagcctggccaacatggggaaaccccatctctactggaaatacaagaaaattagctgggcatggtggtacacgcgtgtgatcccggctgctcgggaggctgaggcgggagaatcacttgggcctgcgagacagaggttgcactgagctgatatcgtgccactgcactccagcctgggcgacagagtgaggctctgtctttaagccttagggagaggcatgttctctcgaggggggggcc

SEQ ID NO: 531457 - DNA, 86 bp, Homo sapiens
cgtttttgttttaggccggctcaacagtgcagcctggtccctgggggctggacccaggctcctaaataaaccagcaactccctcga

SEQ ID NO: 531458 - DNA, 285 bp, Homo sapiens
  misc_feature (154)..(154): n is a, c, g, or t
  misc_feature (282)..(283): n is a, c, g, or t
gacgtggcgattcaaaagcttccggtcctgttcgccagcgacggatattgctgtgccagttgtcgggcaagcgtaatgccgtcgatatccggcagatcaaaatccaccagtgcggcagcaaacggttcgctattttgcagtgtctctaaagccngcgcggcattgccaacagcaacaatctgcgcaccactggttttcagcatctcaatggtaattcgctgggttagcgggttatcttcaattaacagcaaacgtaaaccgtcaagacgcaccgcctgattnnct

SEQ ID NO: 531459 - DNA, 692 bp, Homo sapiens
gaggcatgaggcagatcagtgcaggagtttctgttgagggggcaggcggtggtgaggaaaccgagataagttaatctcttgtgaacagatagagattcaatgacaactacgtgtacaaagatatagtcaaataggtgtactaaggatatcgctgtagggttcaaagttatgtgaagcgtaatattgtagatagcttaagatttgaagaagaatgatatgagagacttagagagagtagcactgatgagggagaacgataaagagcgtttcataaaagcatgtacggagcgtggagactgaacgtcttcgtatcatggaggtatagacacatgtatttaagactgaaacttgacgatgaaagtgactactagagcccccggatttcaataccaagtagaagggcaatgcttcaagatttaaaatgaacggtgacttaaacagcttaaagttatagtatcaaaagttgtagtgtggattatcatgattgtgaatggcgatctgtgtagaatcgtagattaaacgggggggtgatgtacacagatgcttgagatccaggacgcagggagagatttgcgtcatttaaacgtctagttaaagcatatactaaagggaaaagaattcaattattctgtaacattttgtgggggaatattgattcgttagaaaatcttgcaataaagacgggtgggcgc

SEQ ID NO: 531460 - DNA, 401 bp, Homo sapiens
ccttaccttagaagttgtggtcatctgcagctgtggtcgtactgtgatgtgtaggaggaagagctcagtgtggaaaaggagggagctactctcaggctgcgtccagcgacagtgcccagtgactctgatgtgtctcacacagacttcaaaagcctgagacagctgtcttgtgagtggactgagatgcaggataacttcactcctcccctttgtgactatcaagagcctctggcatctctttctgcaaaaggcacctgaatgtagtcttgagtccctgtaaagcctaatgtgaggaggtggagagacagaccaacacccgtgtccactgtgacccctgtacccatgctgacctgttgtttcctccccagtcatctttcttgtaccagagacgtggagctgga

SEQ ID NO: 531461 - DNA, 160 bp, Homo sapiens
tgactggtggtgacctgacagctgttgttatagtctgcacgacaggagcgataatgccgagtgtctcacgtttctgactagacaaatgatccgtcagatacgcctcgcccgatgtgtaggaagaggcatatcaagaatactgaggcgccattggcgtgaa

SEQ ID NO: 531462 - DNA, 366 bp, Homo sapiens
aggggaagaatgatatagtttggtttggatgtttgtcccctccaaatgtcatgttgaaatatgatcccccaatgttggaagtggggcctagtgggaagtgtctgggtcatggggacagattccctcatgaatgtcttagtgccctccttgtggtaatgagtgagttcttgcaaaatctggttgtttacaaagggtgtggcacctccccactctctctctgtcttgctacatggtatgctggctgcctcttcactttccaccatgattgtaaggttcctgaggtcctcaccagaagccaagcagatgttggtgccatgtctgtaatagcctgaagaactgtgagccaaataaacctcttttctttat

SEQ ID NO: 531463 - DNA, 706 bp, Homo sapiens
  misc_feature (23)..(23): n is a, c, g, or t
ttctgttgatacccccggagtantggatatgttgatccaggcctcgggagtgagctgagagtgcacacgcatgagttatctgatttagtgtatctgctatatattttaagccttcatttgcaattcatgtaacagttgtgtcataaattacacaataaagcagctcctgttcaaatttttaaaaaaaaaaaagaacatcacatataaaaaaccactgttggcagccataaaagaattatcctacgcgagttgcctcttattccactcgacttcaaatttctatgatgccagagtgtgctctcatatattcgatcgctatattaataccatacacacatgcccgaatcatttataataacaacattttctaaattcttgcgtaaaaactactcgctcttaattgttaaacacttatcttacacacacccacctcatctactattcatataattttaatacactaatcttcacccacaaaacaacccaataaaacaattataaatacactctatctgctatactatcttaaaaccacttttccaccatcttcttctatccatctgttattccaaaccccacacatccaactatatcctcacttctacttcttttatacaattcttcccctcaactctaacaaatatattaccatcatctaacaaactcctaatctccctacccctctcattctatactaacacacccc

SEQ ID NO: 531464 - DNA, 288 bp, Homo sapiens
  misc_feature (64)..(64): n is a, c, g, or t
ggggggcccccccccccgttttttttccccctttaaaaacccggggggggttcccccccccggntttttttttggggggggggggggggaaattttttcccccggggaccccttttccccttggggcttttttgggggcccctttaacccggtttggtcaaaaaaaggggggggggggggggggggttttccggggtttttttccccccccgggggcccttttttttaaaaaccccccctttttggggggggggttttttggggttttatttttttttttttgggcca

SEQ ID NO: 531465 - DNA, 291 bp, Homo sapiens
tcttagacgcacctgggcccccacctgccctgtgctatctcagcccctggcttctgccctttttttcttccctctcctgctcccctcatccatgtgtaaaaaccaggcacccagaaaacgagtagggtgaaacttggtgcctgcctttacctgcagggggcttgggcatcacttgacctaggcctccaagactctgccctcctccctgggtcctccaacagccttcagcttcgtccagcacccagccctttgcacctgtgggaaccccctgcctggggatcaatttcaaac

SEQ ID NO: 531466 - DNA, 116 bp, Homo sapiens
cgcgcattgaccacggaacaccgcgggatggtccatctgcttgtcggtagcctgatgcgcgcttcgtcaagagtgacacctgaatttgctacgcgccagacccgtggcgatatagg

SEQ ID NO: 531467 - DNA, 716 bp, Homo sapiens
  misc_feature (294)..(294): n is a, c, g, or t
gtgattcccgagagatctggtggaaagtcagcatcgcggtactccggggcttggtgtacgtccgagatgaagcaccagatcatgcaccgatgatgtgaagccctccaatatcctcgtgaactctataggggagatcaatgctgtgtgactgttctgtggtgcagcgcgccgagcgtcatagcacgtccatggtgccaactccttcgtggcgcacgcgctcctactgtggctccggagcggttgcagggccatcattactcgcgtgcgagtcggaacatctgggagcttgggccntgtccgctggtggacgctggccgtcggacaggtatcgccattccgaccgtgaccgacgctaaagagctggaggcctagtcctatggggcgagcccggggttcgacgagggaagaaggagagccatcatcagacagtctcgtcctctggaccgaggtgcccccacggagtggccaccgatcagcgtgtgtcacgggtgatggatagccggcctggcacatggccatcgtttgatctctctggactgatattggtgaacggaaccatctcctatgctgcctcaactggatgtgttcaacccgcgatttccaggagttaggtcaatgagatggcctcagtcaagaatcgcagtcgtgcagcgggcggaacctgtaagatgctcagaaaacaaccttcatcaaggcggtccgagggtggaacgaag

SEQ ID NO: 531468 - DNA, 228 bp, Homo sapiens
acaaggcacatgccttcccttcatcatcatgcatcccccatccagtagtggtactgtttgtatacagttgattgagccagacattgacacatcatcacctaaagtccatagtttacactagggttctctctttgtgttgctcatgcgggtgggtttggacaaatgtatcatgacatgtattcgctacttattgtgtcgtatcagaagaatttctgtgcccttttcaat

SEQ ID NO: 531469 - DNA, 267 bp, Homo sapiens
gacatgtccctgccacacacctttcagaagcttcaccctctctctttgtcccttttcattttggaaacctcactaaaaatgtccaggttgccgaagacgtagatcgcccgcgaaaactacattcctaaaagtcttagctggaaaagaactacctacctcggtgcgaggccccgataccacctggcaaaaggtacgtctcactctcaaggacagactttcgatatctggggcttctcatccctgaccagtggctgaattaaaaaaaaa

SEQ ID NO: 531470 - DNA, 407 bp, Homo sapiens
gtgagatgcggttgggggtcgatatgagagcgtgtctcatgtgcgtacttgagcacagacacagtcggatgaggaagcagatcggtgagttcgccatgtgggaaggaagagagaagcgcaggaggagaggatgtgctggttgctgccccgagactcttggtgtgggatctcgaagactgcgatggcgaagtcggtgagcagaaggcaggcggtgaactggtggatactgccctgcacatggatcaggaagcagcacagcgccttgaggatgcggatgtgctcgagcaggaagtcctcgtccgcgcacagggcccattccagagccaggcgctcctcctcggcctcttcatcctcctcttcgtcctcctcttccccccaaccggccatcttcgagggtaccgagctcg

SEQ ID NO: 531471 - DNA, 350 bp, Homo sapiens
acttttataagaaaacctatatatcatttttgagagtaaaacactctagttattttctatccgacgacaagaaccagctattgactgaactagtaacacctgtctctctcactttgtctctaaagaccatgacttcccatctcagacccttcccagcccctggtatccaccattctactctctgcttctatcagttcaacttttttagatttcccatgtcagtgaggtcagactgtgtttgtctatctgtgcctggcttatttctctctctctttttttgtgtgtgtgagacaatcgtgctctattgcccaggctgccgtccagtgctgccatctccgctcactgccgcc

SEQ ID NO: 531472 - DNA, 111 bp, Homo sapiens
tccttaacaagctctggtggagggaagtgaacagagaactgagatcagaggcctgggttccatccctgccttcacggcacattgatatggttttaaaaccacacacaagtc

SEQ ID NO: 531473 - DNA, 185 bp, Homo sapiens
actatatcaagattccaaggataacgtatacaagagtcttaccaaccaagcaggcatactagtattcgacaatatcattaaaatacacagccctgttggggattgctttaagaatgtaacatgagataaagtgcttagacattaagctttctgacttccaaaatctaatagaatatatggtcagg

SEQ ID NO: 531474 - DNA, 160 bp, Homo sapiens
gggattgcgcaaagcaatgcagcataatgcagtgggactctgtaaggcacatggaggtgatggtgtatcgttagatgagaagatcactgacagaaacttactatgctaataattgtgctttacacaatgctgtgcaataatatacaactcacttgtacca

SEQ ID NO: 531475 - DNA, 364 bp, Homo sapiens
taggccagttttctctagtcgtcagcggagctcgatggggtgtccccatgtgtgctccaggggggttctctaaagttccatctgtcaggtagttccccccgagactgtgccgtccctaagatgctggtcttgacctgcttgagccactgcacccagcctggaccagcttttaatagatggatctttagaagagaatgtgttttgagggtctttcctggtttggttttttagctcaagagctccctctcctgttgtcatagtgtgcctttcttgtagtcaaactctctgattttcctagtgtttttttcagtgggatacttattaccaggaatatttatttttttttccagcgccagcgaggctg

SEQ ID NO: 531476 - DNA, 1353 bp, Homo sapiens
  misc_feature (231)..(231): n is a, c, g, or t
  misc_feature (308)..(308): n is a, c, g, or t
gctccgtaattcgcatcataagttacccttgtctaatctactacaggcatatcactatctgttaacgctgacctataaattcttagagctataatcgtagagttgacgcaagggtgtcccgagagcgggatgtatggcacccatacgagacgtgacatacaagaccacatttgcgcatgagccgcctgatagatacgcatctcacgctaaatgatcgcgctcgatataganacgcgcagacgatcaaagtcatagcacaattctagctcgcttcatttacaatcaatcacggtgcgccggacctcgtntacactgctccacgccagtgcgttcatcttgtcctagctaatcgaatacgccaccttcgcgcgatgagcccgaaggctcggcgtgggactttaccttcgaagggttcaggacgtccttgatgatcctatgctcatgcgccacatcataggtcgtaaacccgcatctcctactcaaacaattatcaagagattagaaagacaattggcacatgcgcatcgtgatcggcccgcttgccaattcttggtggcgtctcccaagactcaattcaggcgcacgagctcgaagtacctacttgttaagtagaattcgtcttggcacatcaccccgcgagtacgagtcgcgtaagggtatttgccaagtagcacccacctgaaaattattgtgtgggcgcttccctgtgccataatacccaacaatcctggggcgctttgcacatacaacggaacaagcacatacctagccactcctcccatagaatatacaacatacacatagacgttggcgtgcacacttgtgaggcgccatatacgtagtgcgcgaacaacggtggagtggcgaacactacactaatttcattttcgcggcacaaaacttttacagtactataatatatcaactgcgcaaatccacggggggggcgcctctcccattattctcgcccacgacgaatattagtcccgtggttaaaacgacgaggacgaaaatgttcttcttggcaacacaacttcattactccaatacctgaagggtacacattttaccaaacgaacaaacagcttccacagcatttacagataatcttgaccaacaagacacatagtggtgggcgtgtcccaaattgtgcgggggcaccccgttttgacaatcaatcaatatataactacgcagtatatttgtcctgctgtctacacacgtgaagcaagagaacaaaacaaaactgtggtgttggagacataacgtgtggtgcggcacgtattaataaataatgacaaaatccacacccggtatctgattggtccctatagaacggtgagatcatattat

SEQ ID NO: 531477 - DNA, 208 bp, Homo sapiens
ttttgtttcactctctttttaaatgatctcaaacaacctgtagttcttatgcatttaatgtcgtttaatcatttgccattatttttttgctttatattatataaaggtattcaggcattataccaaaaattaggggaaaattaggtgtaattgaatttcccgggggcccccacgcttacaatagattatacaattacatgggccaatt

SEQ ID NO: 531478 - DNA, 282 bp, Homo sapiens
caatggtgagaaggatagattctggacttttttgttctccagataaatgtggatagatttggggagtgagacaatagtcatggagtgacccttaagactttgtgctgaaaaacggaaaggatagagttatgctaatgatgagcatgaagaatgtgcgtggaccaggttttgcagtatgcatttcgtggcaaaacagagtagaactgctatctgtacaggcttcaaaacttatcctagctgtgatctgcatggacttgctttcagcatgatttcggggaagac

SEQ ID NO: 531479 - DNA, 364 bp, Homo sapiens
  misc_feature (21)..(21): n is a, c, g, or t
  misc_feature (24)..(24): n is a, c, g, or t
  misc_feature (164)..(164): n is a, c, g, or t
  misc_feature (229)..(229): n is a, c, g, or t
  misc_feature (231)..(231): n is a, c, g, or t
  misc_feature (253)..(253): n is a, c, g, or t
  misc_feature (256)..(256): n is a, c, g, or t
  misc_feature (299)..(299): n is a, c, g, or t
tgaattttccactctttcaanaanatggataaagcaccaagatggaaaaaaggggtagtgcaattaaaattgaccataaaacgctttaaaaataagacaaatcaacatgataatgaaccataatttgatctcaagatgtaaaaaaccaataaatatgtgaatcngcagaagaaatcttaagcacacggtgatttcatgtccccacaaaaagtaggcaacgtttcttagntncagaagtttcaagcttcacttntgngcagtagaaacaaaagtaggctacagtctgtgccatgtgatgnacagtttctgaaatgttttacaagactttgataataaaacccttaaacttatgttcgttccattt

SEQ ID NO: 531480 - DNA, 187 bp, Homo sapiens
tcgtggtcgatctagaggttcccagcggcgccttgttttgcctttccactcccccagccgcctctttgaccagttcttcgtgagtagcacctgtgggatgtctgatcttttcccgtccgtctacttccctgagatcccttctaccttcgtgccaccctcctttgcgggtcggcgtctgcggcggggg

SEQ ID NO: 531481 - DNA, 140 bp, Homo sapiens
tatctagaggatcccagaggcactcacgccagccatcgcggagagctcagagggccgccccaccctgcctcctccctgctgctttgcattcacttccttgtgcagagtcaggggacagggagagagctccacactgtaac

SEQ ID NO: 531482 - DNA, 269 bp, Homo sapiens
  misc_feature (86)..(86): n is a, c, g, or t
agcaggaatgaaagtggggctttttccgccccagggttccaggaaatagtttgaggcaaaatggagggtatgaggggccttcacanttcattttatcccttttacccatcacaaaaaaaaaagcaacaacacctggatttttccaaacaacttttatttcctcagagttttccttaatcctatggaacaaaaagctgcccctgaatagggcccagtatagggggttgtttttttactccctccccccaaaataaaaaaatagactttta

SEQ ID NO: 531483 - DNA, 159 bp, Homo sapiens
atgatttttgttcttttatgtgcgtgataaaatacaaagatgtgtgttgccaacttcttccttttaaagctaagggcaagcaggttaagctctttcccagccccttaagcccaagcccctttccaaagttggtcacagacaaaaaacttaattgccctt

SEQ ID NO: 531484 - DNA, 272 bp, Homo sapiens
ggtgctgttcctgatgtagacaatctatggatgaatgttgggcatttccgtaatggtttatgtatgggacctgcttctgcacagttgtttagctcagttaatgctagagcaacccacattaaccgacccagcaccatactcccctgaacgcctaaagacagaacagttggtcatgggctaaacgacaaaaaggcaagcttcaagatttatttagattcaaacattttggctgccatacgctgggcttgtttgccatataaccaataggtaat

SEQ ID NO: 531485 - DNA, 137 bp, Homo sapiens
atgagaataattataacaagctcatctgcctacgaaaacagactaaaatcgctcatgcatactcttcaatcagccacatagggatagtacaaggaaggggtaggctatgtgttttgtcagggggttgatagttcttg

SEQ ID NO: 531486 - DNA, 220 bp, Homo sapiens
ctctcccttcttttctgcctaacaccatctcatcgtttctggcctcactgtgggacaatccacacacattcttcttttcctctcctggcggggcacagagccacccccttggccttttcttttcttggaagggttctagttcaggcttcttattcatcagacccttctaggccccttcatctatggcaggttaaggcatgtgaggccttggttgggatgt

SEQ ID NO: 531487 - DNA, 1462 bp, Homo sapiens
  misc_feature (236)..(236): n is a, c, g, or t
ccgagagagtgcctcagttaaaataaagggaggaggaagactgataacggactgagttctggccgtcccgtcacccctgatttctggcaccaggcaagtcctcaacagtgcactgatgtatgtgcttttgtaacgatgtcaattctgtccgtttcacattggtgctgggtactagtggtgtcatggtggtcttgcgatgcagcatgaagcgtgtatgctaggtgaaggtttgcgantatagtcaagctgaaatgaatgttaggtggaatcgagaaagttggtggcagatagctttgctgcgaattgcttggagtgtttaagaaggtattgtttagtagtagtagcattgatcattccaatagtcctgaccgcaattggtcatagcagctagcgaatatgtcaatcgacttgtcatcgtgtagcttgtatggatcatggtgtggtccaactgatctatgctttacaaacattcaacacttctttcgtcctgatcataacgcgcgaacataggaagacaaagagcgaccaagaagacgaacaccacgatgaaatggacacacaaatgataaacagagataacaaaagagaagagaagcaaaagacatcgatcaaggcgagaacagcgaggaagcgcgcacccaaagtacatggggaaccgaacgaaaggcgaaccccaaccgcccgagaagagggtggcaagcgtccaacacgcaccgacaagtcagctgtaaggacgaacagggactgggacaccccctagacgaacccgccgcggcacctcgctgcgagacccagctccgggaacacgtaaacctaaggagggccccaagccgggacgacgccatacacggaaaccaggcactacaggaaacaacatacggacccacagcagatgcccagggagacaagcacagagcacaacaaacaaacaagggcacacaaccagggaagcatgcaagcgctgtgcggagaacaccctcaaccaaaggatacacagaacattaacggggagcaacaagcccactggcaagaggaagcccaaacagggcgcatgaacaaaaacacacaagagaccaaatacgcctataggaacacgacgagaggacacccgaacgcacacaacaaaacgaacgaacgcaactgaaaccataccgcacaacgcaggaggaaagcgaaggagccaacagaggaaacaaaattcaacacgagagcccagagccacataaaaaacaggggaccagaggaggaggagcggcgcagccggggggaggacggcggaccgacgggacacacagacagcgagaagagcacagcgatcgcggcaccaggcacagcggggccagacgggaacgccggaacagacacccccgcccagacggggtgctaaggagcgcggagcgcagctgcgacaagccaggaagcgggcgagggacggccgtataggcgaagctgagagcgacaa

SEQ ID NO: 531488 - DNA, 871 bp, Homo sapiens
agagaaattttccactagaagaaaatccttgctatctatttttccaatagaagaaaatccttgctatcatattaatttgatgaataaccaaatttattggcagtagttaaaaacaattttttttaaaacagtctcactctgtcgcccaggctgagtgaagcaatgtgatctcagctcactgaaacctccacctcccgagtagctgggattacagacatgcaccaccaccctcagctaattttgtaattaagtagagacgggtttcgccatgttgaccaggctgtcttaaatctcctgcctttacgtgatcggcccccccttaagccttccaaagtgctgggaattacaggtgtgagccaactgcaccctggcctgtagaagctaaaaatttccttgaagaaaaattcctgatttaaaaaataacctttatataagtccacgtgcttgtcgacaaatgcggtacacactgccatccatgcttgtctggaaacaagccttaaatagaattcagattacggctaacatgattttcacaaaacgcacattcaaggtttcccatctatgatttgccacaccatttttctggacaaccttttactttccattctatccctgacggattttgctacccaatacttgtggaatgcactaacgggtatgtaccttccagtggtccagaactgcatacctcttgtaccggcatgttgggccactggaacatataaggggcagcccatccgacaatagttggttccccatattgtgcttttttgcccgagattaacaaggtctaatccgcttacaaggaccaaatattcggccccacatctcccaccttgcaaaattagcggagtgggtctacaacccaaca

SEQ ID NO: 531489 - DNA, 1656 bp, Homo sapiens
  misc_feature (1282)..(1282): n is a, c, g, or t
tgctttgctccttagtcttggtcgtgtgtctgttccgtcgtgttgtgatgagcgcgccgtacggtgtgtgtggtctagctcatgacgtgcgtggatgcattgccgacgtgtgtttgtgtgcgcgccgtcggctatatgtatatgttctgtggtcgctgtgcccccccgtcgtgccgtgtgttctgcttagttggggcaaccgctatcttgtttgatcatctgatcttttagatgtcggcctgctctgaggtggacctctctctatccaacggtggtgatggagtccctcgcgatcgttcgttccctcccctccccccccctcctttgtgtggtctcccttttcggagccctttttcgtcccacagatttgttctttggcaccccacatgtatgacacacgaagctgggtgttttgcatgatggtggtacatcgcgcaccgttgggcccccgggtgggtgttttttgggaacagggaggcacctatccccttgttagatatgaagtaccagccgaggagaaatgttggagagttgtggttagtaacaccccacaggaaatttaatgattcccccgcggtggtttaatattcctcaagctcgtatctagtgctattagcgccaagtgtatgttggccccccgcgaagcccttattatgtttggcggcaacaaagaagggaaccacagaaagggttctctgttatttttaatcttgggggctcggggaccttgtaagttgaacccacgtggtgttgcaaaaaaatataaactttgtgggtgtgtagagcccccccccaacagtggcgaggcgtctgttagtaaggccgccacagcatgttgtctagcacaacttataaagatatacatatggagaagaagttctatttctcgttgttttgttgggtacaccgctcctgcacggagatgtgttctacccttatagagtgattatctttcacgcttctttaagcgcacgagaagtgttttcaacgggcactctttaaataaataatcgttttggtggtatatgaaaggtatgttctccacacaactcgggagaaacacatagaaatgttataggtgagtccacacagacgtgcccacatttcaccacggtgttataaggcacggccacaccttataaattttctgaaaccctataagattttagaaatggcacattggtaatataaaaaacacccctttataacccagcgtatatctctgtttatattttataccctgtttaaaccccacgagttgggaaactctatatttctgcgnactataattttctcttaaaattatttgagatgagaactcttgtgaggtatctcgttgttctctgcgctctttcacaacactgagaagtgagaattatagttttcactgagatatatatgccacccctctaatatatgtttaaaccacacatgctcttgtataaactctttgtggagttttttggtggcttatattgctataatgcacacttcacgcactgtggtattgttgagcacttttaaatatctttccctccacatttctgttaaattataaaaagatagtgtattttacacgtttcccgggagttgtgagaataaatgttgcacgtttttttaaattaatggaaaattaataacttttggttttgccca

SEQ ID NO: 531490 - DNA, 196 bp, Homo sapiens
  misc_feature (55)..(55): n is a, c, g, or t
gtgatacaccacgaaggttaaacacaagatgaagagtagactccttttgaatatngtagtcagacaaagtacgtccatcttccagctgcttgcagagaaagatcagtctctgctgatcagcgaggaattccttttccgtatcctgtgatcttggcctttctacattttctacttcgtatccgacgggtttcaacct

SEQ ID NO: 531491 - DNA, 83 bp, Homo sapiens
ttttggaaaactcaccaaattcgatgaatacattttcttcttaacccattcggaattattcctaataaaatgataaaatacgt

SEQ ID NO: 531492 - DNA, 285 bp, Homo sapiens
agaacctggcggacctttgactagcggagagacacacgtcttcttggcaccatcaaaggacatatctctctgttaccctttcaaactaggaactcttcaatacatcaggggttgtgagggctttgggcattcttttatcttgggtccactgtgagtgacagaggtggtgcggcctgggaaagatctccctcctttacattttctctatctccctacctcctcctatattctaaaactagtgcctacgcaacagaagggggcagggtgctacttgtaagaagagat

SEQ ID NO: 531493 - DNA, 785 bp, Homo sapiens
  misc_feature (109)..(109): n is a, c, g, or t
gggaggctgagctgggagaattgcttgagcctagaaggtcaaggctgtaatgagccatgatcatgccactgcactcccgcctgggtaacagagtgagaccttgtctcanaaaaaaaaaaagaaaagaaaatttagaggattatatagctaaaaataatttcttaacaattaacaaaactttgggtaaggaagcaagtttacaacagtttatctaaaatcgctgttccttttcacaagaaataactcagtctggaacaactatttttgtgagtgaaaatttcccttttacagaagaaaccaaatttgtaaaaccttaggtggtaatttatgcgaacccaattatagataaccttatagaacaattttttttaaacctttactggggatcaaaaagattcactccttgtaaatttccaataccatttcaatttttcaaattaacctttctgagaatagcaaggaaacttcctgataacagacagaacaacttggggactctcactcttgctcacgattttcccactgttttctgaatagtccacatcttttacttaaaatccttttaccttccgggcacgcacctggccacaacttcccgtggacataggagagctgtgagtccattaattgcgcccaatttaaaaacctgcgcgatatccatttcagtgggtcaccacacgtgcatatttctcatcgttccactgcgacccacgaccggattccttcgcgtctaccccacgttttgattgggcacacagactgtttggggcaccactttttttctc

SEQ ID NO: 531494 - DNA, 413 bp, Homo sapiens
gctgggggatggtgaaggaataatataaattaaaagtagataactgcactatctttatctcagttacctgcataataaataatgagaaatatattgtgacttataatatggtagatatgttacaaaaccaagtacttaatcttttacatcatgtcttcacctatttgtattttaaccagtaatttcaatggtctgaaacatgattctgagcttcacataatatcttaactgtggaactcaaaagtttgatcactgaatttggcagttattaatacctaggtacccccgctgttacacaggtatttagatacgtgtacctgaatgaagctgcttttgaattttgttatgttgaaatgcaagacataacaatgatggcagcaattaaggtcacagaaatcattaggtaaaggaaa

SEQ ID NO: 531495 - DNA, 159 bp, Homo sapiens
gacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagaga

SEQ ID NO: 531496 - DNA, 140 bp, Homo sapiens
ttaattcaagagcctttaagcataaagtaacataacagcattgcacggggccggcactgccgctgccttcactgagggctgcagtgctgatctgagagcttgtaggaggcaccatcgatgattacgtttaggggagggaa

SEQ ID NO: 531497 - DNA, 943 bp, Homo sapiens
gagagccggttcgcaccgacagacggacggaggtccagaccgcagccaaggcgcgcccgtgcccccggccgggtccccgccccgcatccagccccagctcccgccgtcccccacgacccagcgccatgcgggcctaggggggggcaggcgacaacttgcgccttgggcccacctgagacccggtccctaagcgcccaaagggcagaacgccctgaatcggggagctccgcgggggaaccaccgggcctcaagctggcccaggcgcccgggcccggtcggtgggcgtggttcagcacccgcaaggagtgacgcggacaacatgtattatatgtgtcgcaagaacaagaggagctaaggtcacacgactattggccacggaaagattttttataccttcttgtcaaggggaatacataataagcaatgtcgtattcaggggggtggcctgtgggtagcacaaaacttgatgctggaaaaacagatccgtgacctagcccgggtggaggggcaattattgctaagatttgggccccatccacatcatggtgattggcctaggacgtcacagactggtcctcaaggtggtgtggcagcaccatgactccgtacaagagcgtgaaaatgatgtgccaatgatacaagaccggacttcgggaagcgccccgaataggagccgagggtgcctccggtcgccaaacccggtattgtcgtgcatacgcagatacgatgcatgagcacaggcactgatactgggatgcaccgacaacaggtcctaaacatcgcggcgaagtgcggtgtccgacaagcgtagagtaattccggcctagacctggcaagcaaaggggcgtgatctacaggccgaggtaatcacgatacgcgtgcttacaaggtccacagtcgcaacgggggcagagcaacaaattgaacggagtctgtgtacagc

SEQ ID NO: 531498 - DNA, 145 bp, Homo sapiens
aaagggggggggggtttccccaaaaaaagggaaaaaattcgggaaaaaccccaagggtttggaatttttttttgtcctttttcccccaaaaaagggcccagggttttttttaaaaagcccaaaaaacccctttggagcccgtcca

SEQ ID NO: 531499 - DNA, 564 bp, Homo sapiens
ccacgcggtcaggtttgagtcgcgagcgagccttcttttgtttttgttatatgtttgcactatttctttcttctcatggataaaaactacacaaaagctaatggataattaatttaaaaagcaaggttacacattatctggggtttaagaaatttggtcagctgggcagtttcattcattggagcccagggtcatatctctcttatagccttagtccacatgagaatgattctgcgggtcttctcattcggagatcttcagggctctctcaggcatcctacacaggtgagggcgtgccaagtgggacaaaacaaaattccttctatcagtgtaccatatatgtggcattggtcagtgaagggtcattcacccagaacttatggggtttgccagtagtttggtcaaacttgggggtcaactttctccggtggctccggggtaaagcacattttctttgggtacaacataagctttaaggcctcatgtttgggtattagaaacttgaccaggaaagaaaaaaattaaaacaaacaaaacaagaacaaacagcgatttttaaacaac

SEQ ID NO: 531500 - DNA, 103 bp, Homo sapiens
tagtcagcctctctctctctattccaatatgtttcatggagaacatgcactcttttataagcaaacaaatatatgccatgtgagattctattattattcacaa

SEQ ID NO: 531501 - DNA, 242 bp, Homo sapiens
  misc_feature (42)..(42): n is a, c, g, or t
  misc_feature (49)..(49): n is a, c, g, or t
  misc_feature (61)..(61): n is a, c, g, or t
  misc_feature (79)..(79): n is a, c, g, or t
  misc_feature (99)..(99): n is a, c, g, or t
  misc_feature (112)..(112): n is a, c, g, or t
  misc_feature (119)..(119): n is a, c, g, or t
  misc_feature (147)..(147): n is a, c, g, or t
  misc_feature (177)..(179): n is a, c, g, or t
  misc_feature (194)..(194): n is a, c, g, or t
  misc_feature (199)..(199): n is a, c, g, or t
ctttctttctatggccttgttcttcatctgcaaacaagagtnaattagnggcaaggttctnttcacttctgggattganagaaccagcatttgtgaagngtttatatagggnctacagnggggtacattctgtttaaagatttatgnatcagctggcttgcttctctcctatctctnnnggggaacttgatggnatttntgccttagcagattgtacattatgtttttataacgtcttttct

SEQ ID NO: 531502 - DNA, 113 bp, Homo sapiens
gaactactggtcctctgtaaaaccccgatggtaaagagtgttatcgtctccatcatccattagtggtactgatgtgtcgaaaaaatgctgggatccgtcccgaaactgagaca

SEQ ID NO: 531503 - DNA, 450 bp, Homo sapiens
cggagggcggcggtgatctatagctgaataagcacggtcaggacaggcacgcagcggcagcagacttagtagcagcagcagtacccttagtaccaggtgcttaggtgggagaagctttcaggagagctgccttttgaagcttcttaacttcattgcctgattattctgtgccctcgatgttcttggcttcataacttttttaaacaccggattcaagaatctgttcgacctaagggccctctgtgccctttgcgtcagtgggacatgtgaaaactcattactgtgagaacacaaatccgctggttggggcatgaccgcgaattcattgtaaatttcgaatgcgtcagtgagacataacatgtccaatagcatagaagagagaacaactacctacaatggtggagccaaaaagaggacaggaaaaacgaacagatgaaaaaacaaacgaca

SEQ ID NO: 531504 - DNA, 235 bp, Homo sapiens
caagagaacctaggcttccatctttctccacagtccctagtgcacgctgagcacctattacagacttactgatgatctcactgaaccctaacagacccctgctacttcaagtgtagtccatagaccagcatggcattgcctgggactttcttagaaatgcagattcttagacactgtcccagatccactgaatgagaatctgcatgcttaacaagatgtccaggattcagaaaca

SEQ ID NO: 531505 - DNA, 771 bp, Homo sapiens
  misc_feature (10)..(10): n is a, c, g, or t
  misc_feature (66)..(66): n is a, c, g, or t
  misc_feature (195)..(196): n is a, c, g, or t
  misc_feature (227)..(227): n is a, c, g, or t
  misc_feature (234)..(234): n is a, c, g, or t
  misc_feature (248)..(248): n is a, c, g, or t
  misc_feature (262)..(262): n is a, c, g, or t
  misc_feature (281)..(281): n is a, c, g, or t
  misc_feature (321)..(321): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (336)..(336): n is a, c, g, or t
  misc_feature (453)..(453): n is a, c, g, or t
  misc_feature (510)..(511): n is a, c, g, or t
  misc_feature (528)..(528): n is a, c, g, or t
  misc_feature (548)..(548): n is a, c, g, or t
  misc_feature (668)..(668): n is a, c, g, or t
  misc_feature (687)..(687): n is a, c, g, or t
  misc_feature (707)..(707): n is a, c, g, or t
  misc_feature (744)..(744): n is a, c, g, or t
gtattttggnttttttattactggaggaacagagctaaaggcctaaagaaggccttacagtttatnacagttaatagaagagtaacatctttttacaataaactgttagaaatgataagtgtaaagttgtgcgtctctgcggctcctgaacttgaagattattatgaatagattggaccagcattattttttaannactttgatacttagaactttccaactttaanattcagnttctttaatggtgncaacagtagttgtnttgaaccaaaaatagtcangtaaataatgtctcagtaaagcaaaagcattatcttctcncatacnananattcngagttcatttcttttcttgaccttggaaatttctgttttccaaatacctaggggaaatgaataccttctgcgttgggtccatgtggcgatctggtggggtcatctgtgtccctgggncgggcccgtttgtcgctgagacctgtgctggttggggtttgctgtgttttgtctgcnntgctgggatcttctggnattatagtattatgggctgngcggtgaattctgtagtttttttccaagagttgttgcactgcacttgatttaaatgcagcagagagtgtcttgtttttcctaacaaaggttatccttactagaccatcccattcctgaanattgatgggtggtggtggnttcttaggttctatccttanatctctggattccaccttgggcggtggtctgaagttnttctttccccctttcattagatggtcc

SEQ ID NO: 531506 - DNA, 560 bp, Homo sapiens
acagacatactcagacctataaaaggcctgaagggtggatgtggcggtgtgcgctgcacccaccaagactgatgcctgatcaggggaggacactataataagtctcttgtacagcaacagagcctctaactacagtgcgctatctccatggggctctcagagtacgtccgagctccacaccaagaagagagccaacccacgtggatgcagctcggtactatagggctgacttgaaactatgataagactgcctcaaagcatgtgccacaaccccggttcttgcagacccccacagagtcttgagaaatccctcttgtggtccacataggggaaatatagaatacgtcaacagaacaggctgaagtcttggtcatctacatgcttgcaaattccagccttcctggcctgtgagtgtagcatgactaatagcaggaagtcagcaatctccatctttcacaaaaacgtgatgtgttacacgtacgctgcccggtgaacactattctccacctccctccctcccaaattgctattaccgctgggggatcctctagcagtcaact

SEQ ID NO: 531507 - DNA, 115 bp, Homo sapiens
gcaatcttagctcatgtgaagcttaaattcctgggctgaagagatccctccacctgtagcctccttaatagccagtcatgtgccagcctgcctagctatttgtattttagtattg

SEQ ID NO: 531508 - DNA, 120 bp, Homo sapiens
cgtgtacctcattgtatttatgctgactcgccgacactccatggtaagctatatgaagatgatctgctgcaggtgttctgagccctaggattcatctttcttttcaccgtaggtgtgggt

SEQ ID NO: 531509 - DNA, 277 bp, Homo sapiens
  misc_feature (208)..(208): n is a, c, g, or t
  misc_feature (231)..(231): n is a, c, g, or t
agttcgacgtgatgactctccagtagagaccagctctgtgtggctatcacatgtccgacacagttttagggaaactatttatactatatcaatcagacgccaggctcttactcacactttgcacttcacagtgcgcagacacatagtgttgcaatacgtgcacatgctcagtaatatatattgcctgagtacagttcattggaggtantcagtagtccgctggcgcctgantggtcgcttaggtggttctctgactgccccacagtacgcggctgtc

SEQ ID NO: 531510 - DNA, 193 bp, Homo sapiens
cttggtccccgcccatcgctctcatcacctcggccacagtcccccacctgccacggctcctccctcttgcagcagcacctgccctgtttcatcatggtgaggcccgtccgggtcccaacttggcccatgatatgacagcccttcttggggcaaagaatcgtgcgggtcctcgcagctcgaattcactcaatca

SEQ ID NO: 531511 - DNA, 123 bp, Homo sapiens
caccatttattcatgcctactttatttttctgatttcactaaagggttccaatcatatagattatgtgcttaagggcaagaaatgagcataattaagataccctacttaaaaaataactactt

SEQ ID NO: 531512 - DNA, 441 bp, Homo sapiens
cgtcgcaactaaggacaccagcagaacgcacggcgtccgtatctgcggtatgcagatgtatgatgcgcagcatgataagttggtattccaagataagtattatggccggaatgtcaagccacatgaatttacctctgtgctagagtcctttttccacaatggctaccaagtgcttgtgcaccatataccaccgctggtggagaagctgcattgcttagcacgccatgcatgcaagctcgtcggctatcgattttacgcaagcagttggctgctcatttacgacggggatattcgccgtcaaaacacactatggcagggtttcgaagcagatgtctggcaaggggctcggcgtccatcagcgcagtcagatgcgaacacggaacattcagagtcgtttccgcaaatgacgcctggatcagaggccagcacagggtaccgagc

SEQ ID NO: 531513 - DNA, 1236 bp, Homo sapiens
  misc_feature (1055)..(1055): n is a, c, g, or t
  misc_feature (1100)..(1100): n is a, c, g, or t
  misc_feature (1122)..(1122): n is a, c, g, or t
gacttctccacttctgttcctccccgccctggtgctgctccgggtcacatactcgtcctgagccggcttcagcctctccgcgcagaagtctcccggagccgacttctgagagtcgagtactcctatgtgaagactaccaagctcgtgttcaagggaaccaaggcgaagaggcgagatggaaagaaagtatcaaggagtgagctgaagccactgcccttgagaaccctctcgaggagtctgggctcatgaggatgccagaataagtggcagtaagaagaaaaagaacaaagataagaaaagaaaaagagaagaagatgaagaaacccagcttgatatgttggaatctggtggacagtaacaaactttggtgaaatttcaggaaccatagccattgaaatggatgagggaacctatatacatgcactcgacaatggtctttttaccctgggagctccacacaaagaagttgatgagggccctagtcctccagagcagttttcggctgtcaaattatctgattccagaatcaccctgaaatctggctatggaaaatatcttggtataaattcagatgaacttgttgttgggcgttcagatgcaattggaccaagagaacaatgggaaccagtctttaaaattgggaaaatggctttgtcgacctcaaatagctgctttattagatacagtgaagcagaggacatagaagcaaaaagtaaaacagcaggagaagaagaaatgatcaaggctctcctaatctctgtcagaccttcacctttatgaccttgccttatctaccagaacacagatccctcttactaaagattagatcctgtgctgaaagagaaaccaagaaaaaagatgacattccagaagaagacaaaggaaatgtcaaacaatgtgaaatcaattatgtaaagaaatttcagagcttccaagagcacaaattaaaataagtaaagaagacagtaaaattcttaaaaaggctcagaaagatggatttttgcatgagacgcttctggacacgccgaagctggactgtactgctgccatctcgnctcactgcaacctccctgcctgattctcctgcctcagcctgccgngcccctgccattgcagaaacgncaccacgcctgactggtcttcgtatttttttagtggagacggggttttgctgtgttggccgggctggtctccagctcctaaccgcgagtgatctgccagcctcggcctccggag

SEQ ID NO: 531514 - DNA, 1074 bp, Homo sapiens
  misc_feature (893)..(893): n is a, c, g, or t
  misc_feature (938)..(938): n is a, c, g, or t
  misc_feature (960)..(960): n is a, c, g, or t
ctcgtgccgcggcctcagcctgtccgcgcagaagttggccggagccatggccgagtactcctatgtgaagtctaccaagctcgtgctcaagggaaccaagacgaagagtaagaagaaaaagaacaaagataagaaaagaaaaagagaagaagatgaagaaacccagcttgatatgttggaatctggtggacagtaacaaactttggtgaaatttcaggaaccatagccattgaaatggatgagggaacctatatacatgcactcgacaatggtctttttaccctgggagctccacacaaagaagttgatgagggccctagtcctccagagcagttttcggctgtcaaattatctgattccagaatcaccctgaaatctggctatggaaaatatcttggtataaattcagatgaacttgttgttgggcgttcagatgcaattggaccaagagaacaatgggaaccagtctttaaaattgggaaaatggctttgtcgacctcaaatagctgctttattagatacagtgaagcagaggacatagaagcaaaaagtaaaacagcaggagaagaagaaatgatcaaggctctcctaatctctgtcagaccttcacctttatgaccttgccttatctaccagaacacagatccctcttactaaagattagatcctgtgctgaaagagaaaccaagaaaaaagatgacattccagaagaagacaaaggaaatgtcaaacaatgtgaaatcaattatgtaaagaaatttcagagcttccaagagcacaaattaaaataagtaaagaagacagtaaaattcttaaaaaggctcagaaagatggatttttgcatgagacgcttctggacacgccgaagctggactgtactgctgccatctcgnctcactgcaacctccctgcctgattctcctgcctcagcctgccgngcccctgccattgcagaaacgncaccacgcctgactggtcttcgtatttttttagtggagacggggttttgctgtgttggccgggctggtctccagctcctaaccgcgagtgatctgccagcctcggcctccggag

SEQ ID NO: 531515 - DNA, 1290 bp, Homo sapiens
  misc_feature (301)..(301): n is a, c, g, or t
  misc_feature (1109)..(1109): n is a, c, g, or t
  misc_feature (1154)..(1154): n is a, c, g, or t
  misc_feature (1176)..(1176): n is a, c, g, or t
gacttctccacttctgttcctccccgccctggtgctgctccgggtcacatactcgtcctgagccggcttcagcctctccgcgcagaagtctcccggagccgacttctgagagtcgagtactcctatgtgaagactaccaagctcgtgttcaagggaaccaaggcgaagaggcgagatggaaagaaagtatcaaggagtgagctgaagccactgcccttgagaaccctctcgaggagtctgggctcatgaggatgccagaataagtggcaggtatatcctgaatgaatgtgagatttttacnctgtgaatttcctgtgaggagagtaagaagaaaaagaacaaagataagaaaagaaaaagagaagaagatgaagaaacccagcttgatatgttggaatctggtggacagtaacaaactttggtgaaatttcaggaaccatagccattgaaatggatgagggaacctatatacatgcactcgacaatggtctttttaccctgggagctccacacaaagaagttgatgagggccctagtcctccagagcagttttcggctgtcaaattatctgattccagaatcaccctgaaatctggctatggaaaatatcttggtataaattcagatgaacttgttgttgggcgttcagatgcaattggaccaagagaacaatgggaaccagtctttaaaattgggaaaatggctttgtcgacctcaaatagctgctttattagatacagtgaagcagaggacatagaagcaaaaagtaaaacagcaggagaagaagaaatgatcaaggctctcctaatctctgtcagaccttcacctttatgaccttgccttatctaccagaacacagatccctcttactaaagattagatcctgtgctgaaagagaaaccaagaaaaaagatgacattccagaagaagacaaaggaaatgtcaaacaatgtgaaatcaattatgtaaagaaatttcagagcttccaagagcacaaattaaaataagtaaagaagacagtaaaattcttaaaaaggctcagaaagatggatttttgcatgagacgcttctggacacgccgaagctggactgtactgctgccatctcgnctcactgcaacctccctgcctgattctcctgcctcagcctgccgngcccctgccattgcagaaacgncaccacgcctgactggtcttcgtatttttttagtggagacggggttttgctgtgttggccgggctggtctccagctcctaaccgcgagtgatctgccagcctcggcctccggag

SEQ ID NO: 531516 - DNA, 225 bp, Homo sapiens
  misc_feature (224)..(224): n is a, c, g, or t
atacataagaaaaagaaaaacataaaaactacaattaagactgtatgtgagccaccatgcccggcctatttttctttttttgtagagacagagtctcactatgttgtccaggctggtcttgaactcctgagctccaatgatcctcctgcctttgcctcccaaagtgctgggattacaggaaggagtcactgtgcccagccagtttgcagttgtattaggattanc

SEQ ID NO: 531517 - DNA, 1166 bp, Homo sapiens
  misc_feature (799)..(799): n is a, c, g, or t
  misc_feature (805)..(805): n is a, c, g, or t
  misc_feature (944)..(945): n is a, c, g, or t
  misc_feature (972)..(972): n is a, c, g, or t
  misc_feature (1002)..(1002): n is a, c, g, or t
  misc_feature (1025)..(1025): n is a, c, g, or t
  misc_feature (1039)..(1040): n is a, c, g, or t
gacttctccacttctgttcctccccgccctggtgctgctccgggtcacatactcgtcctgagccggcttcagcctctccgcgcagaagtctcccggagccgacttctgagagtcgagtactcctatgtgaagactaccaagctcgtgttcaagggaaccaaggcgaagaggcgagatggaaagaaagtatcaaggagtgagctgaagccactgcccttgagaaccctctcgaggagtctgggctcatgaggatgccagaataagtggcagtaagaagaaaaagaacaaagataagaaaagaaaaagagaagaagatgaagaaacccagcttgatatgttggaatctggtggacagtaacaaactttggtgaaatttcaggaaccatagccattgaaatggatgagggaacctatatacatgcactcgacaatggtctttttaccctgggagctccacacaaagaaggggaaaatggctttgtcgacctcaaatagctgctttattagatacagtgaagcagaggacatagaagcaaaaagtaaaacagcaggagaagaagaaatgatcaagattagatcctgtgctgaaagagaaaccaagaaaaaagatgacattccagaagaagacaaaggaaatgtcaaacaatgtgaaatcaattatgtaaagaaatttcagagcttccaagagcacaaattaaaataagtaaagaagacagtaaaattcttaaaaaggctcagaaagatggatttttgcatgagacgcttctggacaggtagctatttatttacttattttcantgtttncagtagccaatagaaatggcatgtagaaaactatattctcttaaattactgtagttttcacattttgtcttcatttctaatttatgagtgtggcaatattacctagagaggacatcatgagttgggaaaagactgtcannaaagaatatctaaaaattataacgatnctaagtatatactttaagaaattcaggttngactgtatctacttcataaattnatcattatcttttnnataactattagaccagaagtagaaaggaagcgttggtcgtataaaaatttggtgggttctgtaaaggagtgcagttcccttaaaataaggtttttaattaccaattaattataagttaaaagtgaa

SEQ ID NO: 531518 - DNA, 285 bp, Homo sapiens
gcttaaaacaggcttgcttatttggttttgtcaagttttacgaaaatatatgatatatatttatactaaaactatataatccttagatttagggaagcaatcagttaatgtctttagcacactaaagcagtattaaacacaggtacaaggtggaaattgtagaaactgaagaaacaggcaaaatgtctatggtagggataaagggttaggtattatgtaaatatgttatttctctctttacataattgttgtgaaggtctcacttttccaggtgtatactgggtt

SEQ ID NO: 531519 - DNA, 189 bp, Homo sapiens
taacgcgctgatagcctcctaacgcgctgatagcctcctaacgcgctgatagcctcctactgcgctgatagcctgctaacgcgctgatagtcttcaaatgtgctgcgattacgggcgcgagccaccacgctcgtgacttttgacatcttttatcaggctttctgcgccgaggacgctacacacatagag

SEQ ID NO: 531520 - DNA, 737 bp, Homo sapiens
  misc_feature (301)..(301): n is a, c, g, or t
  misc_feature (529)..(529): n is a, c, g, or t
  misc_feature (535)..(535): n is a, c, g, or t
  misc_feature (617)..(618): n is a, c, g, or t
gacttctccacttctgttcctccccgccctggtgctgctccgggtcacatactcgtcctgagccggcttcagcctctccgcgcagaagtctcccggagccgacttctgagagtcgagtactcctatgtgaagactaccaagctcgtgttcaagggaaccaaggcgaagaggcgagatggaaagaaagtatcaaggagtgagctgaagccactgcccttgagaaccctctcgaggagtctgggctcatgaggatgccagaataagtggcaggtatatcctgaatgaatgtgagatttttacnctgtgaatttcctgtgaggagagtaagaagaaaaagaacaaagataagaaaagaaaaagagaagaagatgaagaaacccagcttgatatgttggaatctggtggacagtaacaaactttggtgaaatttcaggaaccatagccattgaaatggatgagggaacctatatacatgcactcgacaatggtctttttaccctgggagctccacacaaagaaggtttgtgtntggaanggaagatcctgccacaagtgtagattttaggacattcattcacttaggccaaactctaactagtctcaaacattttccaaannaatggaaccattgcatttgactcttccatttttttaaattccttaatatgtaccaggccattggcaaggtccctctttctaatataaggcatttggaaaacattccggtataggttcca

SEQ ID NO: 531521 - DNA, 504 bp, Homo sapiens
gggaactcaatgtattcgtcatcacttgaaatgtggtagcgcttacaaagttgatcgattggattctttttaaaaatcaaaagccaagtgaacaacaggatatatagactgataaactatttaggctgacatagatattttacacacttgtcttcaacctgtgactctcgtctgtttacacttcgacacacacgacattactaacgacgttactgtttgtcaattatttctgaccctacctaatattgttacacaactctccctagttcgacgtattctatagaagttttacaaacggacacaaggacacctggacagcctattctctgtcctgcgagttcgaaatacaaccttacgacccttcattaatatatacccgcccaccaagaacattacaacacttttcataccaaggggtctaaaaaaccttatttaccaacccaaaatgcttccttgactccgtaggtatcaatatataggttaatcaatgggagggcggggtat

SEQ ID NO: 531522 - DNA, 121 bp, Homo sapiens
catagtgctcacacctgtaatctcagaacttcagaaggcctattgtgggaggatcacttgaacccaatagttcaacgtgatatacaattgtgccactgcactccaggcaagaccctgtctc

SEQ ID NO: 531523 - DNA, 661 bp, Homo sapiens
ggccagacgcggctgtgcacatacacagaggggctcacgagacccatgactcctacatactcttttgtgtgtccgccaccacccactgtcttacctcatttcaaccgcaccacaccggctgaagcgggccacaatgggcagtcccccatggcagccctgatcttataagcagacaatgcacggggcagtcatgccttaaaagatagccaaccagggtcacttcacttccacgaggaatatgcaacacggcggccttttcgtgctctatgaaccaaagaaagctgggtcccagagaggtggggggccacggagcaagcgacacacagaagactggagccacgtgcaccctgtcagacttccggacttctctctgtgaaccagagccccgctgtgctgtaccctctgtcacgagcggctgtgggacacaccattttgtgcacagcccgtgcgtgccttcgcacaaggtctggtttccttggttcagacaaagcattaaacagcacggagctcttggagagaggtatagtgccccatggggaaaaaatggccccttgtggggctccaatgtgcccctgtgcgctttatgccaacgggagaaatgcgccattccttcttggagatatgagggatgagagagactctcgacatttttcgggtttag

SEQ ID NO: 531524 - DNA, 209 bp, Homo sapiens
catctacaatatacattcacatgttagtaagatcataattagtcaagatatgttacaaggatgcgtattctcattgttatttacacatccatgcaagcattcctgtgggggaaaaaaatcacaaaaatttatgcagattatgttaacataaacccatggtccggagacggcaccgggtcaccgagctcgcaattcgacactccatggtc

SEQ ID NO: 531525 - DNA, 828 bp, Homo sapiens
cagctctcactgagacagtgatctgggaggattttctggatttttttctggcaaaaagagcatcatttctgactccaagtggaagggaatggataaagaagaaaaatatcagtgagactaccgtgacaccattgcccgttctttcatgaggttttgaagatgtctgcaagacacttctaatttgcaaaaaggaatagcagtttgatcttcggtaaacactttggggcatggaattttaatatagcagtaaatgttttactgtttcttttaaaccattcttgatattgttgtgaaaaacctaactttagcagagagtaaaatttaattcaagattgttcctcgtgcactggagtataatcatttgattttttttcttctcagcgatatggaaattatggcttatgattaaattgcatattccaggctacacaaatttatatttgctcctgtttgatagtgtcatgaaagttcaggaggagaatgcaaaaagaaactaatgctatattataattaagaggaaaactccattaaagaaataagtactgttttaagtggctacttatttgtgtttctgtcttaagtgagtacagttgcctccctggtgattcagcaatgaagttctttgcagctctgagctgtgtcggaatgcgtagacagttgatgaagaaggaatcaatgcaaatggattcatgggcagggagtattaagtaactcagtggaaagtcaggacaagtgttctgtaaactgacgttcacttaccattggacagtttatttacctttacacaagggcacatttaaaattctaggctcttgtgaataatgccca

SEQ ID NO: 531526 - DNA, 355 bp, Homo sapiens
tctagaggatccctgaggcagaagatcactcccggagtgataatgcttgcagggggtttgtgtgcgtgcgggatgacgcttgcagtggggtttgtgtgcgtgcgggatgacgcttgcagtggggtttggtgtgcgtgcggcgatacgcttgcagtggggtttggtgtgcgtgcggcgatgacgcttgcagtggggtttggtgtgcgtgcggcgatcacgcttgcagtggggtttggtgtgcgtgcggcgatgacgcttgcagatggggtcaggtgtgcgtgcggcgatcacgcttgcagatggggttcggtatgtgtgcggcgatgacgcttgcagtggggtccggtgtgtgtgc

SEQ ID NO: 531527 - DNA, 323 bp, Homo sapiens
gcacgaggtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattacccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctc

SEQ ID NO: 531528 - DNA, 149 bp, Homo sapiens
ccatagcaaaactcagagatctacacctaggcatacaatctacactcttaaaaaacaaagacaaagagaatcttgtaagcggcacaagtgtcttatcacacaagagatccttgagcataacacagtatttttcactcagaaaccaatgc

SEQ ID NO: 531529 - DNA, 1050 bp, Homo sapiens
gatacctcctcatcaactctgacatagtgtgctgaacaggacatgtacgagtggactacgatcaatgcgtgcggcggcgggttgccgcgcggggggcgggtctggtgcggagtaggtggtggcggatatggtcgaggcagtctgtcgatatcccggaacggtacttctgccactgctgctccgtggagattcgtcccgtgcctgccggaattattatctgtccttagatgactgcgagtctgcgattttatcgaggaggctatccccggaagagaccagggatgctacagaaaaatggttctgcgcccgctccagaagctccctacaagaccagatgccggccatgcggctggaagcactgtggaccaagcatcctgtgcactgctggcggcacgggataactgagatctttgcttatctggcaattctttgatgagcacgcatgtgcggatgaatcccccagcgatttcccatcctggcgtgtcgcatggctgacagaacggcagaggacccttgatgagccggcgggataagagagcactccgatcccggacagcggctacggggcccgagagtcccgtcgtcgcgtctcaccacgcggcgggtcaccgggcggcaacgaaggcgtcccacgctggaagggatcatccagcagctcgtcgacggctatcattacgcccgccagcatcccccaggcctgtgctcctgtggagtcctgcactcaggacctatggagtagcgcctggtggggcaacggcgtggaatgccatcattacacagctcctcaatcaagttgaaaaacacagggccccccacccggcgattaaagagaaatcccagggctcccccacggcccgtcatgaggagcacgtagtctggatcaaatgcctgtgtgcaggagaaaccgcggggggcgtgttgggagtgcttgtacctggtcccagtgttttccgcttgaaaagccctgcggaaatcggagaaggcagccccgggggtttccggcccccagacaacgtgtgtggtcccacaaagcggtggtcccataagccc

SEQ ID NO: 531530 - DNA, 1232 bp, Homo sapiens
ctgttttcttttttctctggttggtcgtgtgttgttgtgggtcgaagggaggaggcgcagagcacagtgtagggtgttggagcatcttcttgctgccacgtgttgtgtgcacttgcgcgtctgttcgcttgttccattgtggtctgaaacaacatgggggtctgccccgttgttcgtccgtcgcttttgtttgcccccgtacgtatctggtgcgccactttgctccctttctccgggttttcccccccgggggccctttggggctctccagggtggtcgtgaacccttacacgggttctctctctttctttgggggcacatccgaggtgggcgcccaccccagtggtccatgtgtgtgccctcccttgccgtggccccagtggccaatgccctctggtgtccgggtgggagtccggtgccgggggtcccaggccagggtctctagctgtgtgcccgacgtctcgttccccacgggcgtaggcttgtctgggcactcaacgtattactgtcgtaacagtacccagtggccaaaccgtcggtgcgcccgtccaggggaacccccggtcgtaagtcgcccaagtggcactgtcccgtaagtgcgtgttcccgcgtaccgcgaaaagttgtgtaggccgtagtattatcacagcgtatcgccagtgccccccaacgtgatagtacgtacacggtagggggccccacccagtgaaggtgaccccccccagtgacgtccgtgtacaacgtagtgtccgtcgagtcaccccctacgtgtaaaaagtagtgtgtaaccaccaaacgtgtcccaccgtaccgtctccgtccacaccaaagcccccagtttaagaagtgtaaaaaagtgtgattgacaccaaacctcgtgcaggaccccaatagtgtgaccgagaaagtcgtggtgtcgcgtgtcagtgtcagtggccccccaccccagtccgtaggccgtatcccgcccgccacggtacgtgagtcagtgtcgtagtgtgtcccccgtcgtatgttgagtccccacccgtccacaagtagtcgtcagtccacccaccgacgtatagtcacccacccccaccagtggcgtatagtccaacgtataccctccaaaccaagtgagtaaccagtacgtccgtgtacacgtagtgtccgtcagtcaccccacgtgaaaagtagtgttaaccaccaacgtgcccccgtaccgtcccgtccacccaagcccccagtta

SEQ ID NO: 531531 - DNA, 510 bp, Homo sapiens
  misc_feature (2)..(2): n is a, c, g, or t
  misc_feature (86)..(86): n is a, c, g, or t
gnaccccgcgcattcctcctcctcctgagaggagctcagcggaagaaggggaagcttattaagctgatgaaagcagtgaagaagangcaggcactgttggagagaagggcatttcaccatcaaaggctgctggagaaggtagtaaagcagggctgtcaccagctaattgccagagtgaccgtgtgaatctggagaagtctttgctgatgaagaaagcagctctccccactttcggttctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggtgccacagaacttcattgatgagaccagtgatatagaaaatttactcaaagaggaagaagatcacaaggaagaaaataatgattccaaagaaacgtcaggtgccctcaagtggaaggagg

SEQ ID NO: 531532 - DNA, 384 bp, Homo sapiens
gtaaggagtaacctgaaggtgtagaattggatacagatgaaccttcaatgggattcaaggctcacctgagcgcgttgactggagtccacactgtcagacagaaagactatggtgaaaggaggaacgctatatgatgatgattggggaaacatcaaaataaaaagtggaatgactctactaatgatggggtgagcagatgctcttccataagaaccctcaggcctgtcttcgtagaatacatgacagaagaacagctagtatctgctatggagtcaccatgtggattggcaaaccttggtaacacttgttacatgaatgccacagctcaatgtattcgatgtgcgcctgctcgatgcccttattactgcagtccttagagtttgt

SEQ ID NO: 531533 - DNA, 610 bp, Homo sapiens
ggatatgtcgacccacgccgtcgggagcaggtggttgtgacaattcactgctggtgcgggcgctggaccgcttccacctggcgctttcgggctcccggggtcctgctggcctgctgccgggctcggagacgctgccacggagactcgtggaacgagtggcccgcgagcgcctggtccaccacctgcagggtctccgggcggccttcctgggtctgcctgatagacgtccgtcaggtcgctgttagacacctcgctgttctgggaaggagggccctggcctggccgagttgctggccaatgtggccagctccatcctgagccatcattaaggcctctctgacagacaatgcaccttttctagccgaccaaagaggtgttcttctccaacaagccctacttacagtgaggtgacgttctgcagtcagggagtgtccagtgagtggtcctctagtcgtgggtcgttcgtccgacgtctatgtgccaggacggctccagagctttcgtgctgacaggcctgggtgagaaggggggtgcctacacgcacctgccctgttccatgttgcatctcctcgcctctgcctggactacgagacggcgcagcatctcctag

SEQ ID NO: 531534 - DNA, 667 bp, Homo sapiens
  misc_feature (546)..(546): n is a, c, g, or t
gcactgcgtgcagcctgggttcccgcccgcgcctctccctccacacctccctgcaagcagagggagccggctccgatcttggccagcccagagaggggctcccatagtgcagcagcaggctgaagggctcctcaagcatggccagagtgggctctgaggccagcgagcaagggctgccagcatgctgtcacctctcacttccttctctctctctttctttcatttttgagacagggtctccctctgtcacccaggctggaatgcagtggagcaatctcagctcactgcagcctccacctcctgagctcaacccctcccacctcagcccctaccacctcccctcatcctcccacttcagcccctcaagtagctgggaccacaggtgtgcaccaccatgcacagcaagttttttcactttttgtagaggcagggcttgctatgttgcccaggctggtctcgaacccctgatctaaagcgatcctcctgcctcagcctcccaaagtgctgcgatcacaggcatgagccaccgcacccagcctcctgctntctttctgcatctccctctgttcctcctcttggtcatttgttcattcatttgacacacattcagtgacacagtccagtgccagagcccccttctgggtgctgcaaatgtggcggggcgcct

SEQ ID NO: 531535 - DNA, 150 bp, Homo sapiens
  misc_feature (77)..(77): n is a, c, g, or t
gagagaaagaaaaaggaagaaagtgagtaaaccaagttttcctctttccaattatacacaaaggttgccttggtgcntgccaatctgctatagggatacaatctctggaggctatgggtgggaatgaatgcaaggatatatagagtatag

SEQ ID NO: 531536 - DNA, 165 bp, Homo sapiens
ggtcgctctagaggtccctcaaacctgcagccctgtgcatgctttctcagtcttgtggtggtactgtatacaatgactagcttcccctcctcccctctttaaatcaccattttccattggtagttcgatagaaattttttttcttaaacgttgcatattactggt

SEQ ID NO: 531537 - DNA, 130 bp, Homo sapiens
  misc_feature (72)..(72): n is a, c, g, or t
cgccccgtgcagcctgtgtgccctgtgagtctatgccccatgagcatgtgtgccccatgactctgcgccccntgactctgtgccccgtgagcctatgtgctctgtgggtctgtgccccgtgagcctgtgt

SEQ ID NO: 531538 - DNA, 412 bp, Homo sapiens
acaggctttcgcctctgcgagtaaatcacgagaggacacatagaaggtgagccacactaattatgaaaatccacagtgtgaaaggacagcgctgccctgaccatacgccaaagagttcaaagccggcctccagaacatggtccagaagagctggagggagcgtcaacatccgggggactctgctaatactcgggcccagctccacaagctgcgggtccatcacaaaggacagccgcactaggctaatatcgcagacctgggaacactgccactgccattcaggggcgtatatggacaagacaaaactggcttggctcttcgggccaggggtgccttttccaaggatactcagagcattttgtgggaacctttcactcaaagtgaaaaataattcctaaaacgtgcataaaaa

SEQ ID NO: 531539 - DNA, 1630 bp, Homo sapiens
  misc_feature (374)..(375): n is a, c, g, or t
  misc_feature (739)..(739): n is a, c, g, or t
  misc_feature (1536)..(1536): n is a, c, g, or t
agcggaaggatcactcatgcttccaggctgcacagagcactgttggatctagctgaacgaatgttttctctgtctctgggtatcaacggtttctgtacagcacagattatgacagcgtctttcttaagagacaagttctcactacgttgcccaggctggtgtcaagctccgggcctcaagcgatcctcccacctcagcctcccaaagcgctgaaattacagacgaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatttnnggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcacggaagattaanggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcnaaaatggaactttgaaatgtcaggtgtaaatccaaaaattccatttgatataccttgtatgaggatatatgtcaccaaaacacaaaaggaatgg

SEQ ID NO: 531540 - DNA, 646 bp, Homo sapiens
  misc_feature (374)..(375): n is a, c, g, or t
agcggaaggatcactcatgcttccaggctgcacagagcactgttggatctagctgaacgaatgttttctctgtctctgggtatcaacggtttctgtacagcacagattatgacagcgtctttcttaagagacaagttctcactacgttgcccaggctggtgtcaagctccgggcctcaagcgatcctcccacctcagcctcccaaagcgctgaaattacagacgaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatttnnggaaggagacaaacaacttataagggaaacatccacacatcaactgaattcagaacgctatgttcatactttcaaggatttatctaatttctcaggagccataaatgtcacctatcgctacctagctgccacacctttacaaagaaagcctactcaggaggctgaggaggccaaggcacaagaatcgcctgaacctgggaggtggaggctgcagtgagctgagttcgcaccactgcattccagcctgggcaacagagcaagactccatttc

SEQ ID NO: 531541 - DNA, 205 bp, Homo sapiens
gcttgatctcaggaggcggaggttgcagtgagtcgacatcacgccactgcactccagcctgggggacagagtgagacttcgtctcgaaaaaaaaaaaaaaaagtggacgggagggccaaaccaaagggggggtttaaggggggggggcaaggatggaacccaaggggtgtttaaacccttttgcaggcccgttcctcaatttggt

SEQ ID NO: 531542 - DNA, 302 bp, Homo sapiens
gatgggaggagaaggacgggtgtaagagcttaccatcaatgagaaggcatcatggagcagaacttccgggagcatggtgcgggagctggagagggagaggaggaagtgagtggcgtgcgctggagcagcgggagcagtgatgctgtggaccaagtgaatggtgatcatggatgctctggatgagagagccaaggtgctgcatgagtgacaagcagcaccgggagcagctgcatagcatcagcgactctagtgtggtctctgccggaatttggtgcattgatgagcaattactctctcccccc

SEQ ID NO: 531543 - DNA, 782 bp, Homo sapiens
tctcattacctccagtggtcatcgtcatgacagcccttcactcccccgcagagcctcaggagccgtcacatgacagtgcgtttcaaattgccaatctggcagactgcccgcagaatcattcctcctcctcctcgtcctcctcagtggggagctaggcggagccaacccagccaatgaagaagaggaaaaggtagtggaggtctagcgatgccctgcataagagtgctcgatcaacttgtggctgtcttgcagcagtttgctagtgatacctgcataaacggggacaccagcatcatgcaacatatgtagaaacatgtggaagcagctcaagagtaaaaaaaacctggcacattcactagaaggcttcttgatagtcaaggagtcttacatataactggaagaagactaatttctaaaaagaggcttcacctgcttaaccttctcactttctccatgcaataaacatgtccgatacttactttacatactgggggatgtcatacatggttctccaatatgtatgcagtagtacaatatcaacgatgacacagctaaatattccaaagaaacaaccttgtgtcccagacggctgaaagcatttccgaatggattctctttaagagcaggtagttatatacttatttttccacaggcatttgggagattgaaaggggcaaacgtaatgtcattgatatataagaagactgctttagtcacaccacgtgaagaaaatatacagaaagttaatatacatattaatgtaatagggggctttcttcaat

SEQ ID NO: 531544 - DNA, 958 bp, Homo sapiens
aagtgtcatttgggtgtcgcgtggggccgaatgcaaatagttatggctgacaagatcacagcccctgggcagggtgcacagtggaatgtgtgaaagatcagtttggctacattaatatgatagtagagagatagcaagaagctctttataccatgtgaaagaagttcaggatggcataggagctacaggcacggagatgaggatggagttctcagtgattactataatcagccgcacctggccaaaggtgcacggcgccgtgtaaatgttgggcggagtctgtgacaggggccccaaaggactgtttcgcaagcttccctcgagctgatcggtatgagccaattcgcttgaagggcaattattcatttcttggaattgatagccaagagtccttcggcctaattggttaccattcggtccagcccaaggggtaaccaagataaacttcaatcggaggttttgagtgaaggaacaaagcaacaagatccggtcacagcctgggctttccacttggaatttaacacaacattccagcaaatgaacaccaaatttaaattccaacgtattgatccaggttggcggggcacttcttgttgaaaagggatctgaactatgtcacagtcttacaataccactccccggaaaagtcttggacaaatactttatttgttacgtcgagcacaaatcaacagcagaggttgtaaacaccatttcgtcgttgggaatgtttaaaaacacaacataacgtgaacgtgtaagaaaaacccatttccaattatttgcccaggttgcagctggacaaaacttatgggttggcgccttatatgttgcacatctacggcactttatggggcgcattaagagcaacaggtagttgagaatccatttgcctgtgtccgtgaacacctcatcacgacttgtggccaataaatcttgactatgaaactatagccacccg

SEQ ID NO: 531545 - DNA, 343 bp, Homo sapiens
agtccctttccatccctgggatgtcaggcctttctagaaggtgcaaagaaatatgtttgtttgtgatataaatatccacagcctttcttgccttctctcaacagtttgcaggcttgattctcagagctttgctatattgatgaggtagaggagagctggatgcattcctgtcagaaagaatgaagaatgtctaagagagaaatgcataacgggggtccaggtgagtgaagggaagattctagaaggtgagttttggttggagaagatgttggagagtttgggatgcgtcataccagagatcgaagcccagttcttgtgctgtgtaggatggaaaggtggatct

SEQ ID NO: 531546 - DNA, 1663 bp, Homo sapiens
ggctgcctgagtcgactctgcgccgccgccgcgatggaggccgccgcccagttcttcgtctgagagcccggacgtggtctactggcccctgatggcccatcgacggctgcacatactgatgtacctgggactgacgcgctgtcatgccgctgatggtgtggctgttctcaatggtgcaccccactgtccactgcgcttcagcttccggacctgccctggcaggtgcccctggctcggggtcatgcttgtctggctggtgtgcgggtgaacaactggctccacactcaccagccgctggtgcttggccaatcgactgcgttatgtcctgtgcccactgctgcagctggcctgcaaggagtgccaactactacgtgctcgctgactcagtgcgggcaccgtgagcctgggcctggactgccgagggccaggaggtgttcgtacccttcagcgcggatgctgcccatggtggagcccaacgacctcgtgtacgatggctgggacatctcgtcgctgaacctggcgaggcgatgctggcgcgcgaaggtgctggactgggggctgcaggagccaactgtggccgcacatggaggccctgcggcccggcttctgattacatcccgaattcatcgcggccaaccagagcgcgcgctcggaccactcataccaggctcgcgtgcgcagcactgcacgaatcgcatggagcatccgagactaccggactaacgaggtgctggaaaaggccatagtgtgtcgcacggccaaacgcaccgcctggaagcgatccagcctcagacagcagagacccttggcacattatctgccggagattcccccacaattacggccactgcagcgtgcctcctggatcccaccggccactcataccgacaccatcgcggcacacagaactgtttactctccactttttcggctcagttacgcgatagttattaacaaacaagaaacacaccaagaaccacacacaagccgctctacaagaagtacacacagctcaacaacgcaccagcctaccaaaaccaccaaccaaccccacaccaaccctacccaaacactcctaacactccacaccaccacagaagtcaacacaacaacgtaactcaacaacagaccaccaacaccaaccacaacaacacacctcaccaaccttgcgggagaggggcgcaggcagaccggagcagggggcaggcggagcgaggagggtggagagtgggcgaggagggacgggagcgggaaggagcgccgagcgggcgggagcgggggcggggcagcagcgccggcggagggctcgagaggggggggcacacgagaagcccgagcgagacacggacgtggcacgggcgggacggccgcgtgagctcgagagaaggagcaggccaggggcggccgacggcgcgacgcgacccgcgccagcacagcccgcggcgggagcggcgaaagtgagaggcagcggcacgacggccgggcgcgccagtcggctgcaggcgcccgagtgggcggggggggaggggcgcagcgaggggagggcgacggaaagcgacggcgacagacggaggaagagcacagcgagagacgcagctcccgggccgcgcggactcacgtggtaggcgccgcacggggacgcgacggcgactgagggcgccac

SEQ ID NO: 531547 - DNA, 961 bp, Homo sapiens
  misc_feature (131)..(131): n is a, c, g, or t
  misc_feature (512)..(512): n is a, c, g, or t
  misc_feature (560)..(560): n is a, c, g, or t
ggccgggcgcggtggctcacgcctgtaatcccagctctcagggaggctaagaggcgggaggatagcttgagcccaggagttcgagacctgcctgggcaatatagcgagaccccgttctccagcaaaaaggnaaaaaaaaaaaaaaaccaaaggaaaaaaaaaaaaaaaaaaaaaaaaaaaaaaaagtgtgtgggggcgcgcgccctgggccccgggaaaaggtttttaaaacccatcgcggtgtggggcgcgcgcggggcccccaaggtgtacacggaacactggggcctcaacggcggtgttccccgagagaaaacccggggccagaacacagggggggggttttcccccaaaaaaaaagcgcccgggggtgaaccccaggcgcgttttgagacaacacccacaaggggagagttcagagaggcgctcagaaagggggcgtctctaataacaaccgagggtgctcccaggcaggaggcgccgcagtattaaaaattaaccgcccgcgcgtngtgaggttacacaacacgtcactcgcacatacatccaccaatcagcangcctaccatcaccaatcactatctcagctacgcgcaccaactcagcacaccacgcaacctctagcaaattagctcaagtcagcacaacccttcactacaacacccacactacacagctcacgcaccgacacccccaacacaacgtcccgcttcaaccaacaccacacttactactccctctcctcacaaaccccagacccactaactacaaaaccactaactctaccaccgaatactaacctccccaactggtagccacacatcccaacactacaatccactacccctctactgtagcacacccgatcaagacgcagagaatacactacccaacccacaacaagtccacactcagactcacacaccctactatccactccagtcaacactaccaaacctat

SEQ ID NO: 531548 - DNA, 428 bp, Homo sapiens
  misc_feature (226)..(226): n is a, c, g, or t
  misc_feature (307)..(307): n is a, c, g, or t
  misc_feature (317)..(317): n is a, c, g, or t
  misc_feature (334)..(334): n is a, c, g, or t
  misc_feature (350)..(350): n is a, c, g, or t
  misc_feature (383)..(383): n is a, c, g, or t
  misc_feature (422)..(422): n is a, c, g, or t
ggcacagcagaaggtcgaggaataacaatatgctgtttctgccctctggtggttgaaagagatgttgtaaataagtaattacaaagatgtgtggtcctatgactctaaccacctatggcattatagtttcttttattccacctgcatttattggttcactgatgtatcaagcatgtaatgagcatcttctatatgactggtctttatcagtactctaaagtgcctngtctagtagcattctggccattagaaacaagttaacatatgtgaggtcttacaaatgaagttccaaaagcccgcttttgcnatgtctagancctgacttttgggcacnccaggtttggattgcnaagtgtcgtcctatctaaatctaaaatttctangatacactgaacttaattgggtagtacacatggtgaatngaaaac

SEQ ID NO: 531549 - DNA, 540 bp, Homo sapiens
gcctcaaacggcgttccggccacaacggcgtttccgctttcgagaccacaacgcgcgttccgcctcacaacgcgcgcttctcgaggcccctctgttctatataaaggctctctctagttataagagattatacacacacatgctccaaggcaattccccgctttccacagtggaggttcacacgcctcttaaaatctacccacccgagtcacaaaaggggaccacacagcacttcacagcacacgcacgcacaatgcacgcgtcacacaaacggctgtatagcctaagccacacacacccccacaccgggagaaacacagcacgtgagttaaacctttagcacatataacgaaaagtttaaactaaagctatactaaaccccacgggttggtcaaattttgtgccaagccacccgcggtcaacaccgagttaaacccacaagtcacatatgaaagccggcgtaaagagtgttttagatcaccccctcccccataaagctaaaaactcacctgagttgtaaaaaactccagttgacaccca

SEQ ID NO: 531550 - DNA, 752 bp, Homo sapiens
cggcatggaggaggcggaggccgcggcgagccgggccgagacagtgagggccctagcggggcccgagcggggcccggggcccctaagccataacctagaagtacatagggctaggcaggacataaggtagacccgccaataccggtataggacgactaggaagcccaggcccctacatacaagccctatagggtgctacggcagaagcggagactaggtacctataacctaggaagtaataaaactagacaaaccatgcgggaccctagcggacgatatctagtacagcacagggtgcctgagctataaacctagctaggtagacctagtacatatgtcacaataatacaatgtaagaatacctaggtacactacgagcgagcccatacaagagaaagccaatagaagaccctagagccaagaagcgaagcactaatagatagcacgccctaagagcctgcctaggaagacccccacggcgccacagagtgcgacgtggtaccaccggacggcgttcctaggcactgtacgcaggtagtacataatccacacgtaccggcataggccacacacgtaataatatgtagggccaggcgggctatagtagcaccccaagcgtgtagacctagagacgcgccaagacagaggccccagtagcatgccaagcggcccgggggagcactacccaatggtacaatatggaccttaccaaccatgagcccacggggacccctagttacactgggccgcca

SEQ ID NO: 531551 - DNA, 960 bp, Homo sapiens
gtacgtgcgggtgttcgatgtgacgtgattgcgcactgccctccacagacaccagacaggtccggacctgccacaagtgtgggacccagctgcggtgacatccattgtgcactttggggagagggggacgttggggcagcgctctgaactgggaagcggcgaacgaggctgcgagcgatgagcagactccatcctgtgtcttaggggtccagcctgaaggttctatcagaagtaccccacggccgtctggtgcatgacaagccccctagccggcggccgaagcgtttacgatcagtgaacctgcgagtggacccctgagaggatgactgggctgcccgtgaagctacatgggaagtgtgatgaggtcatgcgagtcccctgcgtgctggtgatgagggcagtcacagtcggaagtcgctgtgcagaagcagagaggatggccccgcctggggatcggggtgcaccgttagctcggaccccatcctagggggctggtttggcaggggctgacaaaacgcagcaaaaatggaagaaagtgacgtaatcacgtgctcgatgaagaacagttggcactttgcagatggcagtgtcacggtgaaggtgtgtttgcccccacgggtctagggagaaccgaactcttgggggatgacattttcacctgtgacattcttacgcatttgtctctgaggaagcccttgactgctgggttgtaccctgatacggctggccatcgaggacactgccatcggcctctgtgtcatgagtggcagcgacttctggaaacgggactgggttttcaggcccgcctggaagtgagggcagggctttctcgttccaccggcagctcaggccacgtttactacatcaggaaaggactaagactctgtggtgcgaaggggcagccgtcaacctattccacgtggggaacaaacaacgcttggcacgagcgtgccactaagc

SEQ ID NO: 531552 - DNA, 637 bp, Homo sapiens
tcctaaaagtacaaatccagtttatccatctgtttatgacccagtacacgggaggcaagtggttccacttcataaactccattccaactccttggaatgtccattcttgggcttacgggaaaaatctaaacgggaaggccaggcaatgcttaggcaactaaaagtcaggtggggggataagtgcattaacgttccccctcacgggggtatggccagcggggcactgtgttatccgcaagcgtggttttcataaaccgtgtcaccctggaactcttgtctgacccccccatttctctggaacgcctacaggcccggtgtctcgggtctctacagatacatcatccaccaccacgaggttacagacagcgcctttactgggatagctcgccctataggttgctctggcgggactactacctgcgctcccacggaactcgccgacactctctcctcgtgtgaaattcccagacctaattcttccaaccatgtccacctcaactgggggaagaaccatgatttctgatccaggacctttatcctcgcgtcccatgtgccccttcagcggcgtcactacacagccgactccgcaaaaatagcaggggctagtctctgaattgcccggacaccgggttcagga

SEQ ID NO: 531553 - DNA, 150 bp, Homo sapiens
tccgcgttagcgtcccatcagcggattctatatattagaccttgttgggttatctgatgggagaagactggccatcttgcgtaacatcagtagtaaaaaccagttaaatttttaaccctttgcaggaattgctgatgggagaagactgcg

SEQ ID NO: 531554 - DNA, 290 bp, Homo sapiens
  misc_feature (70)..(71): n is a, c, g, or t
agaatttcagaagctgatattacctccatcggtcaggagaggggaatgttggcggcccgttaaaccgggnnacaatgtccgggccaaggactttgagaaagcatacaagactgtaatcaagaaggacgagcaggggcatgagttttaaaggggccccttcccttccctccaccacaccattcaggggggggggcttttttggcccccccagcacctttgtcccaaaacctcattcccttttttttttacccaggatgggttttttcaataaatagataagatggaatcca

SEQ ID NO: 531555 - DNA, 533 bp, Homo sapiens
agaagtttctcggtgaagtaatttttagaaaagtatagtctagattccagcaatgtgaaataaacgtgcttcagatgttttacttaagtcattagtaagggaaccagtaagatgttaaaatgttcctaagaatatctgaaaagctagatatacatgcgcaatttacaaataaagttaggataaaattgctgggctagctacaaaactgggtaatgcccagcatggccataaaccctatagggttatctgttccattagacagaagttgtttgtgtctcccaaattaacttctgcgccaactgggtaattatcttttggcacatgttaccatgctacctgagaaagcaaactaatgtgtaatacttggtagccacttgggtgaatctaaattggaggttatagtctgataaatacagatttgtttgttcatattgcagtgaatgtacatggttgctggccacagtaacattttgcttatgtagccatattatatggtcttggtataaaaggtttggatatggaaaatttaagtt

SEQ ID NO: 531556 - DNA, 295 bp, Homo sapiens
gccaattaaaggggggaatttttttaaaaaatggcccttatttgttttgacttataactgatttgagggaggcaaaagctatgttaggctgccaaaaggacataagcagcccttgtccatttttttagctccctaaattagccaaataaagacttttttttcaaatcaggaaaactatcaaagcccaattcagatcctccatttacagccagttttgtcatacccctttgcattgcagcccctagtacaattccttggaaacaggggggctcaataaattttttttgaatgaata

SEQ ID NO: 531557 - DNA, 186 bp, Homo sapiens
  misc_feature (133)..(133): n is a, c, g, or t
tactccagaccagttgaccgtactacaagttgaccgagtataactactcatctggaaagagaagaagagacacctactgccattctcaactcctgactgctggtagctcatctacagtagaccagatggaaanggggatttacatcaatgtgagtgttcggtcacttgtctggagggatcctctag

SEQ ID NO: 531558 - DNA, 1290 bp, Homo sapiens
taaaaaaaaaaaaaaaacgtgggggatcactctcatacggtcgtctctctctctctcctctttatatataaaaaaaatatttctctctctcactatactaataatttatgtgtgggagccaccccccaaaaaaaaaaaaaaaaaaaaaaaaaaaaaaaaaaaaaaaaaacaacaaaaacagagacggcggcggacagcgacgagaaagaaacggcgaagacgcggagacgcgacacacaacgcagacgcgcgcgaccgccaggacgtcagggacgagagagcgagacgaaacagaacgaaacgagagaagcacacggaaggcaggccgcactgcgaagcacaacggcaaaggagaaagaaacgagagcgagagaagagaacggatagacacaaaaaaatagaaagaaaaagaacggaaaaagggggcgggagcacgacaaggagagcacagcgcaaaggagctgacacaggtgggcgtatgagacacgaggcgggcagacccaacacaccacaaagaacaaaaacagagaacaccatccaccccgacagaccgcaacaagaaaaagcaccacagagaaatcgcgcacaccgacctgcaggcgaatgcaaacacacaacgaccaccacagagaaacacgaggcgacagagagcccaaatccacgaacaaaaagacatgaaaaaaaaaaaaataaacttaaactaacaactccactacaatcaccactaagacgtagtaaataaataacgctcatacattccattcacacagcactcattcacatccactaacaggacaatagaagacactaagcatccccccgccacacacatagggcgcacaccccagccgagaaacacacagcgaacaccgagaagaaaaaagcaaagacggagcaggaaccagaggagcgcgccctaacgcccgaggaacggcaaaaggaaagagcacggacgagagaagcggcagaccagcaaacaacaagccggacgcagaggccagaggagcgccaggacaaggagaaaaaaacaaaggagaagacagccggcaaaagcagaccaggcagagaagacgagaaaaccaaccaggagcagaagcaaagagagagcaacaccacaacgacaacacacagagacgagaaagagaagagcaagaagagagagacgacagcgacagcaaagaagacaggaccgcccaacccccgagaaagcgaggcgcgggagaccgccaacgaacacacgaggcaaacacaacaagacgggcaaagaaaacgccgaggaagcggagacgc

SEQ ID NO: 531559 - DNA, 461 bp, Homo sapiens
aggcattgaggatttcaatctcaatgaagagggcactgagctcctgggagtgaagtgacttgtccacactgccataaccagcgggtggctgagctgagggcctagccactcctgcagcttgttgcactaacgttgctgcattggcaccaaagctaagagattctgcagaaacatgctgggcgcagtgtctcacgcctgtaaccccagcactttgggaggctgaggtgggcagatcatgaggtcaggagttcgagaacagcctgaccaacatggtgaaaccccgtctctactaaaaatacaaaaattagccgggcgtggtggcacatgcctgtaatcccagctactcaggaggctgaggcaggagaatcgcttgaacctgggaggcagaggttgcagtgagctcagatcgcgccagtgcactccagcctgggtgacagagtgagactgtctcaaaaaaaaaa

SEQ ID NO: 531560 - DNA, 418 bp, Homo sapiens
ttctggtacagatccaccagcagctcctcgcttattctgcttgccttcattacgtgttgacgttcagatctagggaacgggaggcacctagcaaacctaatgacagagcaacctgaggcaaatttaggttattaacattaagagatctgtttcagagaatgggaatcataggctcgtatgtatgacgttatatgcttcctgggctgacttatgaagaaagtaattcttttcaatcaatttctcaagctgagactgaatgtcagaaattttagaccaggaaaagtcaaattcacttaatggaaccttggattgtttcaagtagcgaagaaaacccaattcttctgggcgcaaaataagcaaggcatgccctctcccatttaggcctctggctgttctacccacacgatgaatatattcc

SEQ ID NO: 531561 - DNA, 856 bp, Homo sapiens
cgacgcagtgtgttagtttgctgagaatgatggtttccagcttcatccatgtccctgcaaaggacatgaactcatccttttttatggctgcatagtattccatggtgtgtatgtgccacattttctttatcctagtctatcattgatggacatttgggttggtgccaagtctctgctattgtgaatagtgccgcaatgaacatacgtgtgcctgtgtctttatagtagcatgatttatagtcctttgggtatatacccagtaacggtgacaaacgttgccattttaagttcctgctcccttgctaacctcatgcatttcaagaaaatctcttctaacaacaagcagccagaaaaagcaaactgtaaaacacaaataaaacagctcgggcacaaagggagggagaagaatttcttgcttaaccaccaaacttcaaactcatacaatgggccctaataagcacattcctttacttttaggtgcactaaaatagaaaagccgaagggaaacttgaggggtgggtatgactgcagctgcaggaaaaaacaaattaaaaaaggaaacaaacaaacacaggccaggggcagtgactcaacgcctgtaataccagacatttcggattccctgaggtaaggagattagagaccagctgggacatcatggagaaaccaagtatctaataaaaatacaaaaattagccgggaagtaagtggcgggtgaccgtaaatgacagttaatcgagcacgattaggaaggaaaatggttgaaacacgggagaggaggattgaataagtgagaaacggagaaggaatattagctgggaaaagagaaaatacgtagaaaataataataataata

SEQ ID NO: 531562 - DNA, 225 bp, Homo sapiens
  misc_feature (13)..(13): n is a, c, g, or t
  misc_feature (75)..(75): n is a, c, g, or t
  misc_feature (171)..(171): n is a, c, g, or t
gaaaatacaaggnttagccaggcgtggtggcatgcacctttggtcccagctactcggaggcctgagacgggagantcgcttgggcccgggaggcggaggttgcagtgagcagagatggtatcacttcactccagtatgggcgacacagcgagactccatttaaaaaaaaantaaaataaaattgattgtaaaagatgcaaagactggaaagattgaagggaaaca

SEQ ID NO: 531563 - DNA, 200 bp, Homo sapiens
cacgagcacagggctgaactaccactcgaggcagtgagcctaaggccaggtcggccaacatggcgaaaccccgtctctactaaaaatacaaaaattagcgtgggcatgccttgtactggctgcttccaccctaaagcgtcatccagagggggtgtccaattctttgtacttgcaggactagctgcacagtgaccgaagca

SEQ ID NO: 531564 - DNA, 387 bp, Homo sapiens
  misc_feature (21)..(21): n is a, c, g, or t
  misc_feature (48)..(48): n is a, c, g, or t
  misc_feature (52)..(52): n is a, c, g, or t
  misc_feature (111)..(111): n is a, c, g, or t
  misc_feature (137)..(137): n is a, c, g, or t
  misc_feature (176)..(176): n is a, c, g, or t
  misc_feature (246)..(246): n is a, c, g, or t
  misc_feature (335)..(335): n is a, c, g, or t
ggcagggctatcatggacctnttccatgaagaaagagacacagatctntctntggaaaggtgcaggctctgctgcaggaggaaaatggcaacaagaagcccagttggtganttgatgggactccgtgcagccatctngcgtggccaccgtgaagtatggaccagcccaggtgagtntttaattgatgggactctgtgcagccatctcgcgtggccaccgtgaagtatggaccagcccaggtgagtntttagttgatgggactctgtgcagccatctcgcgtggccaccgtgaagtatggaccagcccaggtgagtgtttagttgatgggactctntgcagccatctcgcgtggccaccgtgaaagtatggaccagcccaggtgagtt

SEQ ID NO: 531565 - DNA, 1044 bp, Homo sapiens
  misc_feature (1044)..(1044): n is a, c, g, or t
ggtggatgataagtacccagaagggactgtgtccaaaaaggagcaggacagaaacgggttggcgtatacggatgggctgacagatggcagccccaacgaggctttggctctgaggaccctgtttggcctgagagtgagctcaatcgtggtgagcaacacccctgtaattcctgcgatggtgaaaggatgtggccccggagacccatcacggacaagaggatgctaaaggttagcagtcaagcatgagagatatccagacatctgatgcatgaaaggaaccatcattcaagtgcccatgaatgcacagactcaccatgcaagaaaccttctctcctcatcagcatgggaccccctcaagagcctcatgtcgcgacaaaatcagtggagagagtcatcttgggcacgcccatggcccctccaacagaagagtagaggaaacaaacattacaatcgaccactctgcatacaacacacctgcgctaccgttgtcatgaagacacagaagtgggcagtaaatgaacctgggaataagccccataggcaacgcatgacaggagacgcgagcactgaacctgccgaagaacccctatgaaccgagatacacatgagatccaaccacagaacaacctgcacagcgtgcacacagaccaaacaccacaaaatataatagattccacaacacatcaagcacaaggaaaactcaatcacagaacccgcagaagcacgcaacgagaagacaagaccagagcgattatgcgaacgcggaatacgagcagcacagaacacgacaatccgtagacggaacgacgaacgcggacgcgcacggccgaaaggacggcgaaagaaagaggaaggaaaggagacgtgaacgacaaagggaacagaaaacgacagagagagacaccagaaatacagcgaccgcgcacgaggaaggaagcagcaacacagcgaagacagaaccaagaagctcaatgtagcatgatggataagcacgcacagaaagaagacagagcggacaaacacagaatgacgtggagacgaatn

SEQ ID NO: 531566 - DNA, 964 bp, Homo sapiens
acgcgtacggtcctccttgggtgactcaaccgcctcgtccggcgcatcatggacgcccccaggcaggtggtcaacttatgggcctggtcccgccaagctgccgcactcagtgtgttagagatacaacaggaattattagactacaaaggagttggcattagtgttcttgaaatgagtcccaggtcatcagattttgacaagatgattaacaatacagagaatcttgtgcgggaattgctagctgttccagacacctataaggtgatttaactgcaaggagggtggaggtgcggacagttcagtgctgtccccttaaacctcattggttgaaagcaggcaacggtgtgcggactatgtggtgacaggagcttggtcagctaaggccgcagaaaggaagccaagaagtagggactataaatatcgtacacccctaaacttggggaggttataacaaaaattccaagatcccaagcaacctggaaccctcagaccagaatgcctcctaggtagtatcattgcgcacacatgacacggtgcctggtgtgacagtttgcctttataccccgatgtcacagggagccagtactgattttgtgacatgtcttcaagagttccttgtccacgccagatggatgtactcaacgtttgcatgtgatcttagctggtgcccacaacaatgttggccccgctggcgtcaacccggggtgactggtcgagatcgacccgctggagtagggcctccgagagtgccttgggcctggatacccgttgcgacctgcaaagctctttacaggggcgccttttagatccacgacagagtgggcgcataacactcatgggtgcggacctgaaatatatcataaccaccataaaatggagcacaagaggacgagcccaaaacacactccgggacacaattacaatacatgcacccggcaggggaccaaacacggagtaattcttg

SEQ ID NO: 531567 - DNA, 319 bp, Homo sapiens
cgatcccgaccggatcgagtacgaccgcgagcaactccgtaagttctatcgtaaccgcggctatttcgacttccgggttgtgtcgtcggtcgccgaactggcgccggacaagaacggtttcgccatcacctacaccctggatgaaggcccgaagtataagttcggcaaggtcacggtcgagacggaactcaagaagctggacggcaatctgctggctcagatcctgccgatccgccaaggccagctctacgaagaccagcggattgaacaggccaccgacgccctgaccttcgcggcgggcgcggcgggcttcgcattc

SEQ ID NO: 531568 - DNA, 382 bp, Homo sapiens
cggcaggttgtactgttccatgggtgaatggctctaacacggcctgtaaaaactgggtaaggagatgtaagagacatgggccaagtgctaaatggaggaagagggtaatggcagggcctaggaagggcagtagccaggctgcccaggagttacgaaatcacctgggccgggaatctgaaaagcgctgcctgatttcagcagcttttttttttttttttttggagatgggagtctggctctggtcgcccagggggggagtgcgggggcattcattttctgctcagtgcaaggctcggacttccggggttacacccacacacgcaatttctctgtgcctcagccctccgtgagtagctgggagtacaaccgtgcgcgggggggg

SEQ ID NO: 531569 - DNA, 298 bp, Homo sapiens
gtccgagtattagaccgagtaaacctgaccgagagactacttcctaaggaatattactttaccccatctggagtccagagcctcagcatccagatgagtgtatacattctcgacaagaaggctgacgcggaccggattgtttacgagaacccagatccctctgatggttatgtcctcatccctgacctcaagtggaaccaacagcagctcgactacttgtacttgatcgccatctgccatcgacggggcatcagatccatacgcgaccttactccggagcacttgccgctgctcagga

SEQ ID NO: 531570 - DNA, 167 bp, Homo sapiens
  misc_feature (121)..(121): n is a, c, g, or t
gaaaatgcgttgagtgagtggctgacattccatcacacacgagcctctcgatctcacatgccagagtgccaggttgatacaggcgcatgtcgaacgttggcagcatgtgggtgtgctccantggtcacctcaagccacgttcctacagatgatatggcgtcctcagt

SEQ ID NO: 531571 - DNA, 439 bp, Homo sapiens
gggatggtcagtgctcgtgggatgcagtgggtcttcagggattctcgccgcattattatgtagtggttcagaagctgaggctactgcgttctctctatggtgctggcagcggggcagcttgttatccgtgagggtccgtcgctcgtgggtgcctgacgttgctgtagtttcgtgtgaagacgtggctgtactgtgggctcctgtgtgtgctggctgtgaccactgagactccgagacagactgcccatagatcctgtgtaacggtcagggcccagggccccccacagcatggctgagggagcccttcccgagtagggctgtctccaagtcgcccgacatccatggggtcaggttttcctgggcacttttgttgatagcagatggatcaatattagtagccccgatccaagattgaactgtgaaagagaggttccagggg

SEQ ID NO: 531572 - DNA, 482 bp, Homo sapiens
  misc_feature (71)..(71): n is a, c, g, or t
ctttggtcgacattgctgctgggaatgggaatcctgttcactggggagctctgggagttcttaagctttgntgaaagggcccctgccatcatttataacatcctgctttttgggctgaccagggccctgggtcagagcttcatctttatgacggttgggtattttggtcccctgacctgctccatcatccctacaactcgaaagtttttcccaattttggcctctgtgatccttttcgccaatcccatcagccccatgcagtgggggggccctgggcttgggttcctgggttttggtcttgatgccaagtttgggaaaggagctaagaagacatccccctaggaagagagagactccctccccatcaagaatatttaagttattttttcaaccagggccattttttgggaaaatgggcttaataggaaaatggggctgggttcccgttttttttaataaaataaaatcaagccaaatcccca

SEQ ID NO: 531573 - DNA, 466 bp, Homo sapiens
  misc_feature (48)..(48): n is a, c, g, or t
  misc_feature (56)..(56): n is a, c, g, or t
  misc_feature (75)..(75): n is a, c, g, or t
agatctttccatatgtcaacccatcactttaagtattaatttttttgncttagaanttcctctcacagtcatccnttttcccattcttatggattcaatgttatgttcctggaccccatatcttcttatttcttagtactccttttgtcagcagctctatacaaaggtttacagaaaataaaattggtccgggagtgacgctcatgcctataatcccaacactctgggaggccgaggcagatgaatcacctgaggtcaagagttggagaccagcctggccaacacagtgaaaccccatctctactaaaaatacaaaaattagccaggcatgatggtgcacttctgtaatcacagctactggggaggctgaggcttaagaatcacttgaacgcaggagacagagctgcagagagtcaggatcccaccagtggactccagcctgggcgacagagagaaactctatctc

SEQ ID NO: 531574 - DNA, 559 bp, Homo sapiens
taggcccatttgagttatttggtttccaattagggaaatagttggtattaggattaggattgttgtgaagtatagtacggatgctacttgtccacatgatggtaaaagggtagcttactgggttgtccccccgattcaggttagaacggaggaggctctgcggctaggagctcaataaagtgattggcttagggggcagaaatattatgcttggtggtttgggattattatggaggagtggggatttatgtgcataggattgaggagtggattagttaaatagggcaagggacgccctccataggttgggtaaggggacggactcgggaaacattggtgttaggcgaattaggaaaatattcatctcgggcattgaatggtggggaagggggtgtttacagggggttggcatagggatataatggctcggggctcgcctagggaggctccgggtggaacaataggtggtcaagggtccttaagggagagaactgccgcagaagttaagcccgaggggcgtctttgatgtgggctcagcacggggtgggacagggtgcac

SEQ ID NO: 531575 - DNA, 1426 bp, Homo sapiens
cttttgtggggatctcttcacacacgcggttctgagagttgtgatcacacaacggggacggtgttgtctgcttcgcgcttgcagcatccttcacatggggtttgtgtgtttatctccccacggcagtcttctatggggggtctcccccgttccttggccagaagagaggttttttcccgcgtttttttacaggtctccctgggcgcagactgatttttcaggggttgaagcacaggggcttgctgttacgccctttctaaggtttattgtgctccccacggagcccccaagtgggcgcccaataaggggggtagcccttttgtacgcctggggggcgccccccccccaaaggaggtaattgaaaagtatgtgataaagggggcaccctctggggagggggagataataatgtcccccctcatattagtgttgccgccctgaagttgggcgccccccgcgagaaagatatgtatcacatagaaaacgccctgtgttttgttgtggtttcggacaccggggtgtttttctcctctggagagtgcgccctttcttttttctgccccaacatgttccgcaaagaggtttttcccttttcgggtatcccccggcggggcccccccggatgtttagtacacctcctctccccgcggcttttgccagacccaccgcgttggaggaaaataggtgtttttttgtgcccagccccgtttttggggcttattaaattggaagcacttctcccccggaggaagctcacctggaagttatatatcacattttatctctctggccccaccgctcctctagatagggtttcacacgctcttcatagtgctttgagagccctcgggagacctccacagagattgagaactccccaacacacagggcctcgttttcccttcttcacgcgcacagacctctgtcccacacacacctcgggttttcccacgcgtggacaggcctcccgcgctctgagacactttctgtgtgccacaagtctcgtaacacacaaaaggttgtgagtcttgttggcacactttccacaaccactttccacaggagaggcacagccctctcgtggttctctggagacccacagttgggtgtcacaccgctgtctggctttcccgtgtaccccacaggcacatgtgaccacagaagaaacacagaagttacccctgggggccacctgagttttcctggacacacagagaagtggtgacccactgaaagtatagagaccacagtgggctttgccttttgaacaccctccacagtggtgctgctgggcgtaggcctggctgtggtggtgtccctgactttgactgctgtgtaatcctggttctcaccacggaggtgtcgcacctgcactccccaccctgtgtcttgcgttctccgaaataaaagaagaaaagccaaatta

SEQ ID NO: 531576 - DNA, 254 bp, Homo sapiens
cgccaaaacatacctttgtgtatgtgagggcattcagagattttttaagcgataatttttactgtactttgatttttgccctatatgctcactttagaatcctaaggtgggacttcactgtcatcaccacttgtgcccctccatcaaatgactacgtgaggtagtatacaaactataatgcccccacttctacagacgacggaaacaccaagagaggttatgcaacttgcttggcaagagcacagggaaatttt

SEQ ID NO: 531577 - DNA, 312 bp, Homo sapiens
  misc_feature (102)..(102): n is a, c, g, or t
ggggaaattttttttttgggagaaaaaggattttttgggggctccttaaaaaaatgccaaacccgccgggggccccttattaaattaaaaaagggccccggnggccccgaggaaacctttttcccattgtttttccccccattccaggccaggtttcttggaaaattgggggtttttggacccttccccttaggcaaaagggaaaaaaaaagggggggaaaagggcagggggctccctccccaggaaaccaagggttcccctgggggtgcagaagtttttttagccaagcccataaaactcctttccttcca

SEQ ID NO: 531578 - DNA, 962 bp, Homo sapiens
  misc_feature (119)..(119): n is a, c, g, or t
accctcgcgaggtctgagagtcagtggagctaccaggaagcatcatggggccctggggagagccgagagctcctggctgtggctgcctccgtatggtcggtagcgttcagtagcctccnagtgacctgtgtgggactggacgtgatgagaggttgggaggtgcgcctgcggtgcctgcgtgcgtgcgttgctcagcccctccgtcgtgcgagccgtgtgtgcccgagtactgtgtgcttgcgccggctcaggagactataccatgatatggctcagcttccgcgactagaaagctctgagcctagttaatgctgtttcgcggtggggcgtctttttggtcacttgtctcctggacctgctgcctgactacctggctgccatatatgaggccctggcaggccttgcagcgtgagcgtctccagttcccatcgtgcaaagagttcgatcctggccatgggcttcttcctggtcctggtgatggacgcagatcacactggcttacaaggaagcagctcagggccgtcacctctggcaggaaagcaacgggcatctgctgggaacacgtgaatggtggggcacgctagcattggtcgatgactggggccaggggatcccacgaggctgagtggtagccgccgagataatctcctctcagctcttgacgtgccttgtgtactgcgtgttctccctgggcctctccgactccggtgttcgaggggctggcggtagggctgcagcgagaccgggcttcgggccattggatgctgttgcctggcttttgcttgtccacaagggcattcctggctgtcagccttgtcacttgcggcttgttgcagagccccccttaaggggcacagggtggtggcttggttgtggggatcctcttctcatgcatgacactctagggcatcgggctgggtgcaggtctggcagagtcggcaaggactcttgacagttggcca

SEQ ID NO: 531579 - DNA, 152 bp, Homo sapiens
gttctaaaaaaggaaattctgtcatctgagacaccagttgatgaaactgttggacattacgacatgggaaatacggcacacacagaatgaagactgcatgatgccactcacatgaagtatctaaaataggcacatatggtgaaaccacatgt

SEQ ID NO: 531580 - DNA, 80 bp, Homo sapiens
aactcaatgctgaaacactttgcacaatgcctggcgtgttatgcactcaataataaacattagtgtctatcgttaaaaaa

SEQ ID NO: 531581 - DNA, 476 bp, Homo sapiens
gaattgtgatcgactggtcgtagctggatcaaggcggagaaccggggggtccgctgtccttgtagtcccctatcccatcctggcctcgggctgagacttgccaaggagggcaagacgtacaggtgtaaggtatgcccactgacctttttcaccaatgtcagagatgcagatccactccaatgtcgcacacagatgtgccaagccccacaagtgcccgcactgctccaagtcctttgccatcgcctcctacctgtgccagcacctgcgcatccacctgtgcgtcaagccctaccattgctcctactgtgataggtccttccggcagctctcccacctccaagcagcacaccagaatccacacaggcgacagaccctacaagtggccacatcctggctgtgaagaaggcttacactcagctctccaaactccagtctcacacgagccagcatcacaaggaacaagccctagaagtgtc

SEQ ID NO: 531582 - DNA, 217 bp, Homo sapiens
agacctactcacaattattatcattctagttcatgtaatattacttatgatatatgtattaggaagaagtacaagagattatttaatgctattgtctgaatgtttgtgaccccccagaatttgtatgttgaaatcctaatccccaatgtactggtattaggaggtatggtcttggggaggtgcagtaattatacatgtctagaagaaagtataggag

SEQ ID NO: 531583 - DNA, 1678 bp, Homo sapiens
tcccgggctcccaaaagcttaatggggcaaatatggctctataaaaaaatggatcaatccggtggcctctaagtcaagggaatgaaaagtctggttgtccagggaacacaccaacgcgggggctgtgaaggagaacgtggtgtggtgggtgcttcaccttcttttattacatagaacccgagttcagtaagccacaaagaacttggttagtctcaaccgagtttcttctcgaggcctttaacaccaatgagggctgtgattttcttattcacagaaacttttatataggtgaaatctccacgtggcacagagaaatgtgagtgtgtctcccgtggcacaaccgtgaaatgtgcgagaagagtctcccccagcgaaaatgtggggtgccggggggcttggaacactccgtggcgtgggcagtgggtctcttccccacaaagaacatttcaactgcgcggcgcgcgtggtcttatacaaccgagcgttgtcacgagaccccctctcccaagagacacgaggggggcccaacaaagcgggggggccccgagaagagttcacgagtgtatacttctcaacgacgagcccgcgagtggatacaaagagaggtgggggcgcggactctttaatctcaagggtgctccacaagtgtgctaaggggggcggagggctatactcgaggggggtgggctccttctacagagagggcgcccgcggggagagggaaaccctttctccaggggggcccagcggaggggggggaaaactctcccaatatcgtgagtccgccgaaaaggcggctgggggagagtgaaatctctcggccccacacccgaggggccgggcgagcagagaaaaccgctcgggatccgggggcaatagagaatgaggcgaagactacgaagggggggggcggcctccccaaagggtggggggccccaatggggctcccgggggaaaaatcgctggggaaggggggggcccaggagagccagagagaggagacagcattaagccgcttgtgggggacaaaaacgccaaaaaagaacgcttggggaaggcgagacaccacaacacaaaaacaggcgtgtagaaggggcccttctttgagtgcctgtggtcaggggagcccctcgggcgtggggagacaacttcggccgaaggagagcatagtacccagggagataaaaatactatcccttcctcgcggggtgagaacaaacactgagaagcccccggggaatgtgtgttccacaacccgggggggaaaagaagagtcccacaggcccttgtggttcccgcgtcggcaacacaagaacaaccaacacacgcacggagagacaaaccccgtggggggaccagagagggcggaggacgacgccgaggaaagtggagtgaccgacgaccagagtaagtgggagacgtgatgagaacacgcctggtgtcacgcccccgagataggagcaggatgagtgctcttgggagaacactgcggtggttccacgcgcacgatagagagagtccacacagtgggaaaggtagagccccactcctccagggagtaccatgacaccacgtgtaggagaaagagacggacacaaaacggacgtacgaaaaaaaacacaacaacaggagttcgagtgagaaaataagcaacatcaacgagctaagacgagcatct

SEQ ID NO: 531584 - DNA, 352 bp, Homo sapiens
cgttaatgatcctcagccaagatgcattggggctgaggtttgttcccacagcagagtttccctttgcagaatgcagctctgagaagcgcgtttggtgccgtttcggagatcggcccttggtgggtccctccctagcttgctctgcctgggttgccagggcctgtcaaaagatggattcttcattccaaatcagccttctctgcgaaggagaagacgtttggtgttggtttcaagctgcggagagcatcagccaagcagcagtgcccacggagccagaggcagcccagaccctccttggccctatggggagcctagggctgggtgagaactaggcaagattgttcggggcctg

SEQ ID NO: 531585 - DNA, 149 bp, Homo sapiens
tcaagaatgttgcgagaccatcaacctgccagtgagccgtgtcaggagcggtcggggagaatcaggctctcgaaggctcataaaattcaacgtgagtgtagcaagttacaaggacgcccgatgcacagtggacggtcatgaaggagcgg

SEQ ID NO: 531586 - DNA, 203 bp, Homo sapiens
  misc_feature (50)..(50): n is a, c, g, or t
aattagaaagcaaggaatgcgaagaaagaaaatgggaagtttcctgcctncaaattatgctgttggttctggcctaaaggaatgttttcaagggaagcctgtctgcctttcattgccatttcaccttgatttaatcattcagcaaagcatttattaatcatcttctgtgtgaaaagtacttaccttagaaccactgcatcctg

SEQ ID NO: 531587 - DNA, 157 bp, Homo sapiens
ctgtgtgctctcctgcgacgttggggttgatttgacgggcgcgctggctgattcagagcacaatctcttgttcggggaattgacagaggacgaatggcttgatatttcagctaggttggactgtttgattccgggaaccatttgtttaggtttggag

SEQ ID NO: 531588 - DNA, 153 bp, Homo sapiens
accgcatctctaatctatctaggtattcgagaataggcctgaatggcctccttatcctttgagccctttttagtactactcgaatataaattgcatttctcctggaatataaccaagctaatttatagttgacgttgaagccacatgaaaatg

SEQ ID NO: 531589 - DNA, 153 bp, Homo sapiens
tggccggtacgattaaacactgaactgacattacagcccaatatctacaatcacaacaagtcattattaccctcgctgtcacccaacacaggcatgctcataaggaaaggttaaaaaaaagtaaaagggatctctgcacgaggtgatcttctg

SEQ ID NO: 531590 - DNA, 135 bp, Homo sapiens
agttggcagaccgggcccccttgaaccgcaccccatcccaccagcccgggccttgttttgtttggcctcaggtgtctcagattttttaagacccaaaaaaaaaaaaggaaaaaaaccccaaacccccaaaaccca

SEQ ID NO: 531591 - DNA, 380 bp, Homo sapiens
caaacccttatcagtcgtgatatgagaaaaaacacgccagtcgtcccacctgggatagtacgccctgccttctagagcgggtccacataccctccagatctccctctgcagagagcccttgtcataactgtagacccctaaggcagtgtctgagaagctgggatggcaatgggaggctctggcaatcaggctcttcctgtaacagcccaactgtaggcagctgggtccccagtcccctgatcctgcaggtctctgctcacaccctgccttcttagaagtgttgccctcctcatctcactcccctttgattcatccttcttgggctcctagccctgccatcccttgttctgagtccctcgagactcccttggactcctagg

SEQ ID NO: 531592 - DNA, 127 bp, Homo sapiens
gctgggctctggaagaatgctttttaaatttaccatgttcactgttttttttaagtatcaggatctcgttctgtcatgcaagctggagtgcagtggccagtcatatcttactgccgcctcaaccacg

SEQ ID NO: 531593 - DNA, 393 bp, Homo sapiens
agggatagttactgaccggaaaactgggtcctccaaagggttgggttttgtagacttaaccagtgaggaggatgccaaagttgccaagggggccatggaagacattccaggacagtttccagccttggggcctccttggaaatccgcctagttaacatttaaggggcaataccgggtgggttttgactggatattcatataaactttttaaagagttgagggatagagctaaccttaatccgaaggtttggaattaatatggtttaatcccatgtccaaaaccattttttcctacaaatagttggggtttggtggtggttcctttttttggtttggtcctggtttttttttttttggcgttcggggggttgtacaatttaaagagaaactctg

SEQ ID NO: 531594 - DNA, 479 bp, Homo sapiens
  misc_feature (458)..(458): n is a, c, g, or t
gacccccgcgccggtacccaacagggatttccccatttctgtttgctgcctgaatgttgtatgaggaaggccaaggagagtccttgcacgggtgagcgtcaggatgaggaaatgacaccaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcagntgctcagggaatcctacccag

SEQ ID NO: 531595 - DNA, 390 bp, Homo sapiens
ctctcctttatcacaccatcagatctcatgagacttactcactatcatgagaacacaattgacagacctgcccccttgactcagttacctcccactggttccctcccatgacacagtggggattacgggagctacagttcaagatgagcatttgggtgaggacacagccaaaccatattatataagccacaatacacacagacacctatgtttgtgcagtcatgttcacagcagtcttcaccacagccaaaaggtggagacaacccagatgttcatcaacagacaaaggggtagtgactgtgttgtgtacatatgatggatattattagctataaagggattaggtctgatacatgctacagtttgcttacctgacaaggtgctaagtaa

SEQ ID NO: 531596 - DNA, 873 bp, Homo sapiens
gagtgttcagaagtgggaatgttgagatttcacatggtcactatcgtggggatcatcagacatgcagagcaaggctccaaccaacattgtttccaaaatagatgacatgacagctgcacccatggacgttcgccagtgggttgacacagatgacaccagcagtgaacatacactgtggttcctccagaaacatatgtgacagtggcaggccacctgagatcttttcagaacaaaaagagcctggtagcctttaagatcatgccccttggaggactatgaatgagttcaccacacatattctggaatgtgatcaatgcgacactatggtactaagcaaagccaacagccagccctcagccagggtagatgcaacctatcagtcaactcccaggacactgagctgcaagcacgcggaacctcttgcgtgcgcgacatacgcttcatgccagcaaactggcctcactgtggcccaaaacccaggtgttgcaactttgacttaacggcttgtccaagacctgcaagggttgaactcttcagcgatctcaagaaccagctgaaacacatgtctgtatcctcaatcaagcaagctgtggatatcctgagcaatgagcgggcacatctattctactgtggatgatgaccattttaaatccacagatgcagaataactggcatctaaactgggtacctgagatattttacagctggacctagtttcacaatctgtagtctccagcttctgcatatgtctggcccagggggccttctaggaagtaggctctcatctatcaaatgtctcctctgacttccttttgaaacttactgctcttctgcttcatctcgcataggttgaagctccgagggagcatgggc

SEQ ID NO: 531597 - DNA, 1026 bp, Homo sapiens
ggagggcgtccccggctcgggcggcgatgggtagtagccgaccccaatccactccgggggccgccgggtggccgcgtgaaggcatggtgttcctggggagaaacgtggaagtggagtgcgcggcctggggccggtggcgctcggctggtgggcctgcagttggctcccctgtggggctctgggctggcggctagctcccgcctgtggggaggagaaggagccggatgggcgggttcatggctgcgctgcggcgggggtcccggggccgccggctcctccccgcgagggtgcctgtccgccgctcgccgcgctgaggcagtgctggtggcgtgtgcgcgcctaggctgccgccatgcgccctcgcctgcggccatgcccgggccctagagcgccttgccgcagctttgcgccccgaagccccgaaggccccgagcccgccgccggctcttcacatggggcaacacttgctcggacggggggtcatgctttccgagagacccaaccaccgtgtaagggacctgcagacatccaccttggcaagacccggaactcgggagcccagatacccggaagaaaccaagggcccggagcaggaggcacatcgaaagggagcccagagggaccaagggaatgtttcaggaagacaagccaccagtgcgagtaaaggacacccccggaggaaagacaaaagccacggcgtgatgggagtggagtaccacggtgcgacaccaatgcccccctagaagccctgtggaatggaaaacggaaccggccacgaagagcgcgtggtcagtgtagaccgcacggataagcctatgggggtatggggatgaaatatccccacgattgaagaagcgccaaacttatgcgcctatataataccaatacaggcatgaaaaagtcttactcaaaattgactgagaacacaggggaaacttttaggactacaaatgttcccgtaacaaaccgcagttagcacaaagcagaaacttctcaacagcaatctcgcggaacatcaacaaacat

SEQ ID NO: 531598 - DNA, 625 bp, Homo sapiens
  misc_feature (295)..(295): n is a, c, g, or t
  misc_feature (519)..(519): n is a, c, g, or t
  misc_feature (525)..(525): n is a, c, g, or t
  misc_feature (530)..(530): n is a, c, g, or t
  misc_feature (555)..(555): n is a, c, g, or t
ggccccagaagccccgagccacacttcacgacacctgcccctatgtcccagggcctggaagaccggtggcctccggggggacccagggacccagcttttcaacgccggagtaagccccggcagctcctggggccccctgagagcccagccaccaacaatttcgggagccctcatagcttgttgcctcgagaggttgtttgaagggttgtcaccgagcccacctttctcacagtttacacacaggcggtttttgggggccacaaagggggtctcgtagaattctcgagagtcattncacggtgacctccctgccacgggagcccttttgccacaccaagcgccctccccagagctctcacggtggaggcaacacgggccatgtgctgccctgttgccgagcccacgctgtgggcggctcctggtgctaacaacaaagttccaacttccacggtctgcctggttccctcccccaggccacacacagggaggctccgtcagcttttccccaagccagtaggnctggcntcatntcagacctgcttaggatgggggatntggcaggggtgctcctgtgctcaccctctcttgggcatttttttggaagaataaaattgcctctttttta

SEQ ID NO: 531599 - DNA, 155 bp, Homo sapiens
  misc_feature (42)..(42): n is a, c, g, or t
ccaccttatgcgtggggtcatttccagatattaggtcacagnagaagcagcaaaatggatccccagtgcactatgggactgagtaacattccctttgtgatggccttcctgctctctggtgctgctcctctgaagattcaagcctatttcaatga

SEQ ID NO: 531600 - DNA, 722 bp, Homo sapiens
taaggttggagggggaatgctggaaatggtaatgggtatggagacatatcatataagtaaggctagggtgaggggtaggaagtttttccataggaggtgtatgagtgggccgtagcggaatcgggggtatgcggtccgaatccataagaacagggaggtcagaagtagggtctgggtgacaaaatatgtggtgtagagtccagccgacgcgcgcacatgcggcgccgccgtgatatataggcgccggcgtgcggcagggacttcaagctgcccccgtggcgccacggccgccacttgccaccgagcgtgcccggagtgtgagggcacgctgagtcccgcagggctgcggaggggcgcgcgggggctctcgaccgggctgcactaacccaggctcctcctcgccccggcctccgggtcgggggaacatcggaggggacggcaggcccggctgccctggaactggggacacaaggaagaatcccctgcggggtcccgggaaacagtgcccaccccactatcattacattccctcggcccgtgttagtgaataaagtattatatcctcaaaaaaaaaaaaaaaaaaaacccgggggcaacataatggcggggccgggacaaaacagttcacgaagggccctgggccaagtgttctctgaacccagtcttctggcaaggtgcaaaccgggcggccccaaagggggcgaaaatcgaaaccggaacga

SEQ ID NO: 531601 - DNA, 526 bp, Homo sapiens
gccatccgtgaatccctcgagagtgagatttaggcgaagaacgagagaggccagaccaacccctcagccctggtagaagaggatgatcccagtgcccgagatccctcgagatcacctttgaagaaacccatgcgctttgcgcgcccttctgtcactgaccatagacattcggaagtatgagaagtttgccccgacccttcagcaacgagtcggggctttggcagcttcagattcccctcagggaaccacgggtggacctggcccccgtcagggccatggaggcggcaaccggtggccgtgtatacaccgaagaccatgatgatgacccgtatggctaaactggctgcgtggccacgcgtgcacgtgatgctggcccgcctggaccttgttccctgggggtgggggcgcttgccccggagagggaaccacggggtgcgcccccagcctgctcccttctcccgtctgaaccgttcagctaccgtctgactctggaaacgggggtttctgttcccaaaatacccaacca

SEQ ID NO: 531602 - DNA, 557 bp, Homo sapiens
tacaggtggcacagtgtgatcccgtcgaccaatgccaggattcagagactgggacgtagtatcaaattggcgattcatgggagaagtatgtgccttgtgtcagaataccagtgctactgccaatggccgtggcataagggagtggcattcccaccctttacagacctatccaagctcaagtggtcctgtcgaagtatttatcactgagactccgagtcagcccaactcccaccccatcgcagtgaaatgcaccacagccatctcacatttccaagtacatactcaggtggagacttggaaattctgtaggccgttggaaggaagctaccataccaggccacttaaactcctacaccatcaaaggcctgaagcctggttgtggtaacccagtgccagctcaatcagcgtccagcagtacggccaccaagaagtgactcgctttgacttcagcaacaccagcatcatgctcacctataaccagcaacaccttcccatggagacacgactcccttttctcctctagtggccacatctgagtctatgaccgagtatcgtga

SEQ ID NO: 531603 - DNA, 302 bp, Homo sapiens
ttgtgtgtgtgttttatgaacaaaagagaaagctatcgaggaatactttgggaaacatgccccttccccatgtgtgtgcagcttctgcttggataatgaatggcttgctcattaatgcgttgtcccagcggaagatgcacactcagtggggagaggggatgtgtaatagtttgtattaaaaataaaaagggcgcggtggctcacgcctataatcccagcacattgggaggtctaggtgggcggatcacaaggtcaggaggtcaaaaccatcctggctaacgtggtgaaatcctgtctctact

SEQ ID NO: 531604 - DNA, 1026 bp, Homo sapiens
tccaagaaagcctgtaaccaaggcccagaaaaaggacggcaagaagcgcaagcgcagccgcaaagagagttactctatctacgtgtacaaggtgctggaacccacgctccaccccgaccaccgcgcatctcatcgcaaggcccatgggcactcactgcaactccttcgtccaatgacatctcttgcagcgcactcgctgcgcgaggccttcccgccatggcgccattacaacacagcgctcgcaccactcacctccagggccagatccagacggccgtgcgcctgcctgctgcccggcgcgacgctggccaagcacgccgatgtccgaggcgcacacacaggccgtccaccaagctacaccagctccaagctgcagcctctcgccagctgccagcaactccaaaggcctctttctcacgcagcccactcaccgccttcccagcagcccaccgcacgccctgttgccactctctccgccctcgctccgctcctcccctgccgctgcgcacctcccggcccgcgcccttccactctcccgcgcgcgaccccaccccgccggcgcccaccgcgctgccacaccctccggcgccctccccttgaccccccacctctcatctcattactcacgccctcctacccccctctccctccccttctccgcaccgcacggcttactctgcacactccaacaattgcctcctccctacgcttcaatcccttactcccgcaactcccacaccgcctcccctcgcgaacaccaacaacaaactccactcccctaatcaacctacactgcccttacccccacctacggacggctaccaacgccccagcatcctctccttgccctgactagcccctttcgtcctactcccatatccccttttccggcctcccctcggctcttcccaaatgtggtcaccccctgagggggaccagtggcactgtgggttttccatcgcttcgctttctcttagtggtgcacatttcacctttgctcacctccatttgccctggcaaagtccc

SEQ ID NO: 531605 - DNA, 417 bp, Homo sapiens
tccaaagactctgcaaaccctacatccatgcgcaaaagccccaaggacctcgcaagggctcttgtgccggaatgccttgccaacaagagctaaagaccctacagacacgacatccacgcacaaaagccccggagacctcagtcagaaagcacctctgtgaggacatctgcccagcacctgcctgtcccaccccacaccggcaccacccttgctatgggcccttgtaggcaaggataattgtctccaaacaacttacgttttctttaaaaattcttgtcttccttgacctccctgaatgtattcactgactcccattgcaatgctcaattcccaaacaaatattcttttcttcagagggtctttctgtctcttatttaggttggcaataataaagtcaaattacaaagaaaaaaaaaa

SEQ ID NO: 531606 - DNA, 537 bp, Homo sapiens
  misc_feature (469)..(469): n is a, c, g, or t
gacgagttaatgggtgcagcacaccaacatggcacatggatacatatgtaacaaacctgcatgttgtgcacatgtaccctagaacttaaaagtataatttaaaaaaaaccgaagtatagaaacctgtaggttctggataagatgggaagagatggacatctccatagcctgacggaggggagctctcaagagcttgcagtggccaccaatggaagtatttcagatgcaagcagatggatgcatggtaccactatgacgtcagaaaaatcgccaggtgcggtggctcatgcctgtaatcccaacaattcaggaggccgaggcaggcggatcacctgaggtcgagagttggagaccatcctggcaaatgggatgaaaccccgtctctattaaaaatacaaaaactagctgggcatggtggtgggtgcctataatcccagctacttgggaggctgaggcgggagaattgctngaacctggagttggaggatgcagtgagccgagattccgcaacacactccagcctgggcgacagaggga

SEQ ID NO: 531607 - DNA, 121 bp, Homo sapiens
gtctgcgatgacgcataaaactcttcaccaaacgagccctataaccgccacatctaccatcaccctctacatcaccgcccgaccttagctctcaccgtcgctcttctactatgaacccccc

SEQ ID NO: 531608 - DNA, 154 bp, Homo sapiens
tcagctcggtaccgtgatgttatcgcccaacactgtaggaggcaaggcgggtggtcgcctgaggtcaggagttcaagaccagcctgacatggtgaaacccagtctctactaaaaaaacaaaaattagttgtgcatggtgttggggataacatca

SEQ ID NO: 531609 - DNA, 221 bp, Homo sapiens
ataagcggatgaggggggaaggggagtgagctgacgctcggaaggtgtcttgagattatcatccgctgagggtggaagcggcccgcggcaaacgcggggcaggtgtcttgatattatcatctgctgagggtggagctgagggtggaaggggagtgagctgaccctcggaaggtgtcttgagattatcatccgctgagggtggaagcggcccctcatccgct

SEQ ID NO: 531610 - DNA, 273 bp, Homo sapiens
gtggctcctggcccctggtagaacagtgccctaagtaacaactcttcatggagtgagtctacattgataataatgatactggagttcccatcgtggctcagtggaaacggatctgactagtatccatgaggacgcaggttccatccctcagtgggttaaggatctggcattgccatgagctgtggtgtaggttgcagacaaggctcagatcccacattgctgtagctgtggtgtaggccagtggctacagctctgattgcctacggacttccg

SEQ ID NO: 531611 - DNA, 976 bp, Homo sapiens
caccgactaataatgatggaatactccgtgacgtcagaggactgtccgccatgagcttgaggaaaatcgaagtgactgtgtgtgaacctctgactccctgaaaccctggtcgactgatgaaaggtgtctattgcgctgcgtggtcgcagctccgatcatcatcgctgctagtcaacaatactgttaaccgtagtgtgcggatatgccagtagtcgcccgtcacaaggctgccgaccattcaaagagcccgatgtataattatagtaggactagacgccaggaagaaatcagtgtgttttgcagccacagcccacaatgcaggagaagtccataggatgaaggcctgcccaggggtaatattgtattcccttatgggaacggtcaaactcaagcgtcgtcgcggatacactaccctagtttatgccctatgtgaggaactacgttttgcctacgtagaactcatgtgttgcaacgtaagcatggatctgggcaacgacgttgtatgcgttctgaagaaagaatcctcgaggaatgagactcagttacattaacaggcaacctggtacaactattgggggagggcacttataccatggggtgttgtaagactcccctgaaaacacagttcgcagtgtggcttggagtccccatagtttggcattgatagtagctcagtaacttaaggaggatggctcttccatcgcactgcatgacgtggatgtgtgacgcgaacatgaggagtggcagtttctccgtgtgcgtggctcagtcagattagaccaaatcatacaatatacaatggtgaggcaatctgtgtaggcaaacatggtccagaggaaaagcacaggtaaggcacgcccaatgcccaccgtgggtacgcatatatctcctggctgtggttttgtcccaaaacgtgaaaactcttaattcttgtttacaaaccgcaagttttaaatttatgaggccgggtaggcac

SEQ ID NO: 531612 - DNA, 1446 bp, Homo sapiens
  misc_feature (400)..(400): n is a, c, g, or t
  misc_feature (569)..(569): n is a, c, g, or t
  misc_feature (805)..(805): n is a, c, g, or t
  misc_feature (978)..(978): n is a, c, g, or t
ggagagccgagggcgcgcacagtctgacgtgaagagccaggcccgtccgggggctctcgcagaacctcggtcttctgcgctctcgtactctccttgcctgtgcatgtctgcgcggaggaggggagggaggacgcggagctgcgagctctccgggcagagcccgcgaccaccgtccgcttcggtgacgtgcggtgtaggcccgcggccgcgtcagggacgccaggttgcacgacggtgttcgcccgggtgctgcgcgctgactagtgacatagtacatgaacactcgagaggtacacgaaggggtcgtccgggctgggaatgcgtgcgcataggatggccgggcttcgagggcgcaaagcaccctggacaatgatacgcgcacgggattgagcgccctganccgggacaataattgtaccaatgtagggggtgactgccagcaaacaatcctctgtgccaaggccctttagagcttggactctactcaaactttcgcagcaggttgagtacccggggctttcgacctatgtgtcccccagaggagttgtcccatacatgagaggcagatnccttgagagggtgggacctaggagagaaccagtagaggggaggtgttaaccttcgataagcgggttgcggcaacgatgcggcaacgagcccttcctaacaaatgggaggcagaacacaatttaaaccgtctaactatacacaaacgtcgtcgacggggagaaacggaaggtaaggagcttgatgtaacgttttagccgccgggtggacaaacgggctcggttgccaataaagcatntttccgggagagtaatattcaccacgggttgggtcgtggttgagacagcgcaggtctgtgtggacaccaacgggaacccgggcgggggaaaaggcctataggtggagaacacaacgggggatctaattggggcaaggttttacttttccacactccgaagaagaggctgtctnggctcttgggggggagcaggggccaagagtcctccgttccgaaaagggacaaggaggtacaatactcggttgaaatacttcgcacccttataattaggacattctcttcccacttagagaagcggatagggaggccttggccaagcaagggcaacacaaatggagagctccattgggcgggtgtggccacttcgcacgggaggaaattccatttgccaagatcagatacccattggagagtatgacttttcatgcaagggaatgtcttgtatggaacggagcacactgcgaggccgttagaaaccgccccggtttttgtgtgtcccccttccaagaccgcacgggagctcgcggggaaactaggcagggaggtcctgagtccatttggggcaacattaagtaaccccagatcacggaagcgaaataaggaagaggatcggcttccggaggaagaacggagcacagtgg

SEQ ID NO: 531613 - DNA, 470 bp, Homo sapiens
ctgagctctctaccccggttacagtctctccgagtgccagcattcttcactgagagcagtgagtacggctgtgtgatggacgatcagactatggcggtggccaccggagggggcaccagctcgccacagcccaaccccttccgctccccattccgccttagagcagctgacaactgtatgccctggtactgcaacgccttcatcttccatttggtctacaagcctccccaaggcggcacagtccgctcggctcccggccctgcacctagacccccaactcccgctgcacctcctgtcccggctcgaaggcgccgaggagaaaagaaagctgcacgcgggccccgccggcgcagatgagagcggacttggcagtcgtccattcccaagcatgcgccctaaaggaaaacattccaaggcccagggaagactgattgtcggaacacaaaaggttaaataaaattacttgtttg

SEQ ID NO: 531614 - DNA, 333 bp, Homo sapiens
accagctttcagaggcgtgcatgggttctgggggccttgtcaccgggaatagccgggtgtctggcaggaatgtgaggcattcataacgagaaggagaccatgtcaaagtctgaactaccgcctgtgctcttaccttgagagagtgaggagcctggagaccgagaaccggaggctggagagcaacacatccgggagcacttggagaacgaagggagccccaggttagagactgtagccattagttctagatcattgagtacctgagggctcagatcttcgcaaatactgtggacgatgcccgcttcgttctgtagattgactatgcccgtcttg

SEQ ID NO: 531615 - DNA, 858 bp, Homo sapiens
ggccgggacgaaattcggtggagtgagagatggctattgatatccatagcccagatgtgcatcataatgttggatagtaacaatcgagagttacttaccacagaatgtgcctaaactggcatagagatctggtacgagtgtgtgaaaacatccgcattgggttgtgtggtcaacaaagtggatatcacggacaggaaagtgaaggcgaaatccattggtgtcccagcgaaggaagagtcttcagctgactagcgacatttactgccaggaagtatactacgactgtcgtaaaactgcccttcctctggcttgcgaggaaagctgcatgggagaacctgaccttggaatcgtgtcgggcatgcctggtctcgcgcccaccagaagttgtcatggacccaggttggcagcacagtatgagcacgagttagaggttgctcagataactgatctcccggatgaggatgatgactgtggagaatgaagctggagcccagggtgaggaagtctagtgtgatagggagctgtgctgtggatgtcagtggtgcagcgtgtgtgccacctcgattgattatctagctaagcggaaatgtgcttcagctgtggggatgcgtgaaaggagatgagtgggtcccggagtgaatgtggccgtcgaggaaagatacgttcctgtgttgtcccttgcatattttctcctggtgatgggacccccgagaatccttgaggtttcctgtataaaaccggcgcgatcccgttccgcacagtcagtgcgcgagtctggtcgtacatgtggtccgccgcccttccggtgacccagagacaagggcgttccaaaaaaaaaaaccccggggaatccacgga

SEQ ID NO: 531616 - DNA, 266 bp, Homo sapiens
ggtcgcgtctgtaaggccaacactttggggaggcatggtgggcagttcacgaagtcatatttcaagagctgactgaccaacatggtgaaaccccttctctactaacaatacaaaaattagctgggcatggtggcacgcgcctgtaatcccaggtactcgggaggctgaggcagaagaatcacttgaacatgggaggcggaggttgcagtgagccgagatcgtgccactacactccagcctgggtgacagagcgagactccatatca

SEQ ID NO: 531617 - DNA, 683 bp, Homo sapiens
cgcaaacgattgtttctccaaatccttaaactcccgagtctatgttgtgatttatgaagcaagcattaaggcccggtaccccaatgcctcttaccttaaacgtggacagagagtgcccttgtaaatccaacccttaatcagtaggtacagcatagccagccatggtgctttaaagataaagatgacagatggcctcccaattcaggaaggggcccgcatccttataaggctctacatacatcccctcccgtgagcagatgcttcttgactcaccatggggttacctcccaataaatgcatcatacagtcaaaaagttgtaatcgtgtctgaatatatgtattggtctgttctcacattgcaataaagaaatacctgagactggataatttataaagaaaaaaggtttaggctgggtgcggtggctcacaccctgaaatcccagcagtttgggagcctgagttgagcggatcgcctcaggttagcagttcaagtccagcctggccaacatggcgaaaccccatctgtactaaaaacacaaaaattaaccgggcatggtggcacggcctgtcatcgcagctactcaggaggctgaggcatgagaattgcttgaatctggaagccggagattgcggctgcagtgagccgagattgcgccactgcattctagcttgggcaccagagt

SEQ ID NO: 531618 - DNA, 1036 bp, Homo sapiens
  misc_feature (175)..(175): n is a, c, g, or t
  misc_feature (199)..(202): n is a, c, g, or t
  misc_feature (204)..(204): n is a, c, g, or t
  misc_feature (228)..(228): n is a, c, g, or t
  misc_feature (230)..(230): n is a, c, g, or t
  misc_feature (239)..(239): n is a, c, g, or t
  misc_feature (241)..(244): n is a, c, g, or t
  misc_feature (253)..(257): n is a, c, g, or t
  misc_feature (260)..(260): n is a, c, g, or t
  misc_feature (284)..(284): n is a, c, g, or t
  misc_feature (292)..(292): n is a, c, g, or t
  misc_feature (296)..(298): n is a, c, g, or t
  misc_feature (300)..(300): n is a, c, g, or t
  misc_feature (321)..(321): n is a, c, g, or t
  misc_feature (326)..(326): n is a, c, g, or t
  misc_feature (330)..(331): n is a, c, g, or t
  misc_feature (334)..(334): n is a, c, g, or t
  misc_feature (341)..(343): n is a, c, g, or t
  misc_feature (345)..(345): n is a, c, g, or t
  misc_feature (354)..(354): n is a, c, g, or t
  misc_feature (356)..(356): n is a, c, g, or t
  misc_feature (358)..(358): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (380)..(380): n is a, c, g, or t
  misc_feature (405)..(405): n is a, c, g, or t
  misc_feature (411)..(411): n is a, c, g, or t
  misc_feature (417)..(417): n is a, c, g, or t
  misc_feature (426)..(426): n is a, c, g, or t
  misc_feature (433)..(433): n is a, c, g, or t
  misc_feature (437)..(437): n is a, c, g, or t
  misc_feature (445)..(445): n is a, c, g, or t
  misc_feature (455)..(455): n is a, c, g, or t
  misc_feature (459)..(459): n is a, c, g, or t
  misc_feature (463)..(464): n is a, c, g, or t
  misc_feature (488)..(490): n is a, c, g, or t
  misc_feature (502)..(503): n is a, c, g, or t
  misc_feature (507)..(507): n is a, c, g, or t
  misc_feature (523)..(523): n is a, c, g, or t
  misc_feature (540)..(540): n is a, c, g, or t
  misc_feature (546)..(546): n is a, c, g, or t
  misc_feature (550)..(550): n is a, c, g, or t
  misc_feature (592)..(592): n is a, c, g, or t
  misc_feature (596)..(596): n is a, c, g, or t
  misc_feature (610)..(610): n is a, c, g, or t
  misc_feature (621)..(621): n is a, c, g, or t
  misc_feature (623)..(623): n is a, c, g, or t
  misc_feature (645)..(646): n is a, c, g, or t
  misc_feature (649)..(649): n is a, c, g, or t
  misc_feature (651)..(652): n is a, c, g, or t
  misc_feature (657)..(657): n is a, c, g, or t
  misc_feature (662)..(662): n is a, c, g, or t
  misc_feature (700)..(701): n is a, c, g, or t
  misc_feature (716)..(716): n is a, c, g, or t
  misc_feature (730)..(730): n is a, c, g, or t
  misc_feature (770)..(770): n is a, c, g, or t
  misc_feature (883)..(883): n is a, c, g, or t
  misc_feature (951)..(951): n is a, c, g, or t
  misc_feature (1029)..(1029): n is a, c, g, or t
atcaaacaatgtaaggatacccactttcatccctctatttaatagactcctcaccagggaaattaggcaacaaataaataaatgaaatacattgaaattggaaaaataaaactaaaattatttcttttaaaagacatgatcttacacacagaaaatcctaaaaatgtggcaaaanactaatagggctcagttctaattnnnntncagcaatgttgcagaatacaaaancnacacatganannnngcggcatannnnngtncactaataatgaacaatctgacanggcaatanaaannncnatttcatttacttagaaatanatgtnaccnngcnggctaannncntgtacactnananctataanangnagctgacaganattaaagaagacataaataaatggnaaaccnttttcnctgattagnataatgntaanatgtcaanactacataanatgntccnnagatttagtgaaaatccctataannntttccatgatgnntttngcagaaatagaaaaanacatcctaaagtttacntggganctcnagggacctgaatagccaaaacaatcttgagaaaaaacacacntgtnggtcttatgctccntaatttcagangntattacaaagctacagtaatcnnaananngtggnacagncataaatactaattggcagtaataggcagtccagaaannaacccctgaattcanaatccagttatttnttacaggtgtgccaaaattattcgatgggaaaagaacagncttttcaacaattttgcttgggaaaatatatctacatgcaaaagttggatatttatattacaccatgtacaaaatttaactcaaaatgtatcaaagacttaaacataagagcnaaaatataaaactcttaggagaaaatatggataaaagaattcatggcattaagtttggcaatgatttnacaggtatgacaataaaagtacagataacaaaaaggaggaatagataatttggcctgatcaaatcaaaactttcattntcaaaga

SEQ ID NO: 531619 - DNA, 222 bp, Homo sapiens
  misc_feature (178)..(178): n is a, c, g, or t
  misc_feature (193)..(193): n is a, c, g, or t
  misc_feature (207)..(207): n is a, c, g, or t
atggaccagaccgacgcggcgggcatcacgttgcgcgatgccatgcaggctgccggactgccgggcacgatggaggccatccagtccatcaaacgcgacccgtctcgctacctcggctttgtcgaggtccatatcgaacagggcccggtgctggacagcctggacctgccgctgggcntcgtcaccagcatcnacggcagccgccgntacaccggcgaagtg

SEQ ID NO: 531620 - DNA, 622 bp, Homo sapiens
gcacgagtccactctaggctttctttctgcttctttgatatgtatcgtggtatttttactgttttacccacatgtaacctggtgttcatgggtcctgataccaggagctgctttatctctactagtaattcctttgatattctcagcttattcaagaagctcaggctcaagggatgatgacgaaaccgaggaactggaagaaaagggcatgctgctgaatgacccatatctaagttcaaagtccgggagattcgatatcgacgctgatagtgaggccaacctccgtggtgattcaagaacgaatttattgggtgacaattttaagaacggtactaatatcactgttgtcccagatattatttcacacaatcaagatccgaaattatcaaacataaccacttctaccacgtctgatatttctactttcgacaaagaagcaaaggacatggaaaattcaaatggttccggacttaatgaagaagaggacgatggcatggcatatgacaaaaggaggtcaacttcaacgtattctgtcattgaaagtgaaagtggcttgaaaaatgggagtgtttctaataattatgtgagaaacaatggtagtaacaccagcaacaatataaac

SEQ ID NO: 531621 - DNA, 873 bp, Homo sapiens
atatcattctatttataacagtctgtttttagtagtggtatttccatttacaaaatgcagtaattgtcagttgctgaaattgtcaaatcctagaaaatgtagcattcctacaggtgatgttaagatcattctcaaacaggtgttggctgaagattcatttgacgaatctgatttttctgaaatagatgattcttatgattccaatgattctgacgttagttttgtttagaaataactacaagaacagtttttatattttattttcacattgaaaatcagatttgcctcagcctcaaagagcatgtttacgtaaaatggaatgagcactggcagcgagctgcacttttttttttttcctaaccgggaaagggttaaggacactagaagagcaagagcaaacttgagcccaaaattggtccgacaaattattaaagataaaccacgggaatcttctcgattttcacgactctgaagaaaccattcacaaaaatctccttgaaccacaacgtgggtttttggaaaccaaggaactttggccaaaacctttagtcagactaccaagggaagactcaattaaattccagagactgctaacagactttacacctggatactgcagaatttcaaagggattcataggtggctactgtgaccactattttgccaataacttgcggaaatctacagaggaacgtgggcataaattctctaaaacccattaaaacctcccaagtattgacccattgaacactgtgattccaaagcctgaacaaacccagtacacgtcagtgagattctggactgtataagttccccagttaacgctgggaaccacgggttcacgggtggaattctaccacactttaaggacgc

SEQ ID NO: 531622 - DNA, 364 bp, Homo sapiens
cggcggaccggggctctgaagaacgcggcgtctgtgagtttttcgcgagcagctcgctcctacaagaagccctcccacagtttgatccagtagggcgttaatggccgcctttcatccgccgggcaatcaggtagaggcccagccccaccagcgctgtagcagcaccgatgtagccggtactggtccaacccaaccctgccgtaatcgccatccccccaaaccacggtcccagcgcattcgccaggttaaacgccgcatggttggacgctgccgccaagctcggcgcttcgtgggcgatgtccatcaagcgaatctgcaacggcgccgccaatgcgaccatggtgcccaccagccccatgctcag

SEQ ID NO: 531623 - DNA, 109 bp, Homo sapiens
cttaggtaacccttcccgaaagagtaaagcagagcctgaagaggaagaagatgatataaagccctaaaatgtgcactcattggggtcgggagtttgttttaaaacaatt

SEQ ID NO: 531624 - DNA, 105 bp, Homo sapiens
cacctgggcgtatggtgatgttgctcccggggcaagccgggcaggagcggacgaacgggatgcagtcggcttggtccttgatgcgggagtcattgggcgggatct

SEQ ID NO: 531625 - DNA, 461 bp, Homo sapiens
gggcggctgggacctgtacacgtatcctgaaaactggagggccttcaaggctctcatcgctgctcagtacagcggggctcaggtccgcgtgctctccgaaccatcccacattccattgtgggccaaagccaaccgcacccctgaactttctccgcacaatttcctgccggcaaggtcccagcatttgagggtgatgatggacttctgtgtgtttgagatgcaagcgccagttgccgtactatgtgagcaatgaggagctgccggggaagtactccagaggcagcgagcctcaggtggtgcagtgggtgagcttagctgattccgatatagtgcccccaaggcagtacctgggtgttccccaacttgggcatcatgcaaccagaataaacaggccactgacgcaatgcacaaggaggacagtgaggcgaacttctgggcgctgctggatgcttacttgcaag

SEQ ID NO: 531626 - DNA, 1321 bp, Homo sapiens
taacccctataatcgggtataataagggtcttataagaaatcccagcaataattagggtaataagtatatacggtctctgtaattcaaacactccacggaaaggctgggtggggccttgaaatgtccagggtttcctgaaaaagccggcacccccttccgggaccaggcacgcctaaggactggtgctccccaaatggtggggtgtctgggagagcaagaagatctcagagacaggccatctcgcacagggctatgtgagaacccactctctgggggcaccggggcataatcactggcttccgtgtgtgcaggcctcaagaaaaagcccccttcgtgccatacagggtggggcaggcataccctccgaaataggaggctgcaagcaggccaccgtgaagggggtggcctccaggggcatagaaaggcgaggtgtaaccacgtgtgctcagacagtggccaatgggccctccgtgccagcccaaataagaggtgtccaccactctcccctgtgttgtgcccccgtggggcacacaccaggcactcctcacaagtaaagtgcctgggaacacccagactgtgggcccatgagagccagccaaggaaacatagacacacgggggagccaacatccatggggagaagtgggggctattaaaccaaaaccacgggagtaaagcgcaaggagggaggccccccaccaagagcagggggccacaccataatagacaaccatttccacgacgccaacataagtgagaaacaccccggaaacaccacattattaaaaaagccccctccacaacggagccatacgcaagaaaaatctattgcgggagacaaccctcagcgggggtacaccacagtagagagcgacagacgaaaacggatagaggcacacaattccgcccatcgcagagtaagagggaacacaccagagaagctgactcagaggaacaaacatccgacaaccgaaggtcagacaaaaaggagacttgtgagagataaggatccacatagataatagtggccactccaaaaggagtatctgggaaacaacggagggaacgatacaacacacgaacagcggagaagggtcaccgacaagccgttctcggtggcacgcagggtcgacccatcaagcaaagacagacacacgcacccaagcggtagatcaaaaacacccccacaaaagaggtgtagcggcaccacaaaggaggcgcgacgtgtggaggacccatgtgagggcggtagcacacccgggggtgagcccatcatccacaacaaccacaacgatgttgcagattgaagcaacacaagaga

SEQ ID NO: 531627 - DNA, 188 bp, Homo sapiens
ggggaaaaaggcaaccaggaatcggtcaggagtcactgagtccacatctttcaacatttctctcaccttctttggaaacaagtgcttgtgtgtgcatgtcacaacctttcccagtgcccaggggcaccaaacaactgctctgaagtctcaaatgaggcttgaaaacccccaggatgctgctttgtgtg

SEQ ID NO: 531628 - DNA, 165 bp, Homo sapiens
acattctgatcatcctcacgggacgccaggggcacgagggtggttttcctgaagcagcgggctagtggcttattactggtgactggacctcgggtcctcaatcgagttcctctacgaagaacacaccagaaattggtcatggccacttcaaccgcatcacccgtt

SEQ ID NO: 531629 - DNA, 256 bp, Homo sapiens
atcctgactgaacagatctgtagtgatgatgtacgatgacattgcttacgctgaagacaatcccactccagtgaattgtgatcaacagtgcccaatggcacagatgtctatcagggagtcccgacggcctacactggagaggatgtaaccccacaaaataaccattgctgtgctgagaggcgctgccgaagcacagtgaagggcataagatccggcaaagtacatgaaaagagagcccccagtgcatcacgtgttc

SEQ ID NO: 531630 - DNA, 198 bp, Homo sapiens
atgttgcacatgtgactcgatactaacataagttcttctatagggtgatagataggtccaatcgggatgtgaggagtgcagtcatatgttcgggattaatcaggtagtgggtgtgcgagcttgaacgctaccttgataggtgggtgctttaaggcctactatgggtgttaaatttttcactctctctctcatgtgata

SEQ ID NO: 531631 - DNA, 585 bp, Homo sapiens
taatcagctcggtacctacacagataagttgacgggacccgaagggcaggtcagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531632 - DNA, 1174 bp, Homo sapiens
ggctggggaccttggggcaggtggtctccctccagaagagccctgtgttcagccagccctgtcctccagagcaagccccacaggtagcaaagtcagggagggtaatggcttagccccaggctcccaagctgggcagaacagggcagggagctggagagggttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcagcggttggtgcgggtacgcgagctcga

SEQ ID NO: 531633 - DNA, 491 bp, Homo sapiens
  misc_feature (8)..(8): n is a, c, g, or t
  misc_feature (11)..(11): n is a, c, g, or t
  misc_feature (53)..(53): n is a, c, g, or t
  misc_feature (377)..(377): n is a, c, g, or t
  misc_feature (456)..(456): n is a, c, g, or t
  misc_feature (480)..(480): n is a, c, g, or t
  misc_feature (488)..(488): n is a, c, g, or t
gcagaagntgngaacactggtaaggatgggacgagcacacactcactgaactnagaaaaagcagaaggcagtgggatgccgaggtgcagacaaggccaaagctggttctaccactccaggttacatgaacaaggacaaggcaggcaaccctccggaccacagtttcctcatctgtcaaataaatacagtgataatagcacctcatgagatgtgagagattcaacagagccagttcagggcaagagatcaccagtgaatggatgagcaagcatgggttagctgtagatgtaggagatcaggactgagaccaagccatccgatcaagggaagggaaggggtggatgtgctgggatgcctgctctaagaaggaaaaagtngggagcccagagcactgtgtgtctttgggtttggggtccacagattgagtgttgcagaatttggtttaagttagggcantgcccctttttaggaaacttcccnttttcttnatt

SEQ ID NO: 531634 - DNA, 554 bp, Homo sapiens
tctagaggatcccgtagaagacgacaggaaggggagaaacggacagaagggagtaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgcacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531635 - DNA, 284 bp, Homo sapiens
tcgagactcggtaccccgacggtctgttaccgggatcaaaccggctgagccttctttacgtgcgttgtttgaacctcgattgattgagcaagtatattgggtcaatgagtgcgcatttgacacctcgcaactttccatttgggcttcgcgagaacttaaagagagtggtgtgcaggttcactatcaaacccgcgtcgtggctatttcaaaggggcggctggcaccactggaggtggtagtcgacctggcgcagggggtaaagcctcgagaggatcctgtagtac

SEQ ID NO: 531636 - DNA, 1254 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531637 - DNA, 1189 bp, Homo sapiens
tggcacgaggcctcgtgccaagcttgcacgagggaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531638 - DNA, 1643 bp, Homo sapiens
ggctggggaccttggggcaggtggtctccctccagaagagccctgtgttcagccagccctgtcctccagagcaagccccacaggtagcaaagtcagggagggtaatggcttagccccaggctcccaagctgggcagaacagggcagggagctggagagggttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531639 - DNA, 253 bp, Homo sapiens
ctgaccccccccattagaatgtgattttggccccctctcatttctcggcgggcctttggtgccgcttctggtctggaggatcctccccctgcataagccccggagcgagccttgatgtttaggcggaggaaagggtcttcaggccgtttccttgccccgagcaattgggtggggggattaaaatccggtgctgataagagccagtttaaagggcatgggattgcttcaattaaaattacaaaagagaaaaaaa

SEQ ID NO: 531640 - DNA, 394 bp, Homo sapiens
ccgagtgatgcatgtgaatgtttactgataccgactagtgatgcacagctactgaagcgaaaaagaaagaaacagtatggagatttgctcattgatgctggagactggacgttcttcttatttcacgcctgtccccagtgatgatggaattcttattctactttgtcatagatccgcagtaccggtgacattgtcgcgatgagacactccaccactaaatttcccactacttgccaagtagctgggtgatggtgcttgccttcccatcccactcctggatgctgaaccaatgcacaatctgtaaaggtgccgacagtctgagttgtgctgccagcagctggggttgcttcaaactgctctcccagggtacaagaagactgtgttgttaccaaag

SEQ ID NO: 531641 - DNA, 1487 bp, Homo sapiens
  misc_feature (30)..(31): n is a, c, g, or t
cgggaggcaggtgttggagcgcgggcaggnnttggagcgcgggcaggctcgagcacaggccccttcaccgcaggcactgaggggactaacagtgacaagcccctggtgccccttctcaaatggcttggctctagcggggttccagtgctgggtggcgctgagacccagagggagaacagggcctggggcgacgtggctcctccgggtctcagaaggaggggcatgggcccgccaggtggaatggaaggcgcctgtggagacctcctgaaagtggtggacccccggagctgcgtgggggtggtggctgccagtgtgggggcggagggggtgcggggctgcgccccgtgcctgacccccctgccgcccctcccgctcaggccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531642 - DNA, 1182 bp, Homo sapiens
  misc_feature (30)..(31): n is a, c, g, or t
cgggaggcaggtgttggagcgcgggcaggnnttggagcgcgggcaggctcgagcacaggccccttcaccgcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531643 - DNA, 952 bp, Homo sapiens
  misc_feature (736)..(736): n is a, c, g, or t
  misc_feature (767)..(767): n is a, c, g, or t
  misc_feature (934)..(934): n is a, c, g, or t
gggaggccggtcggggctgggctcaggggccgagacctagctgggcttggggcggggccgagacggagcgaggggtccagggtgtgggaaacggggaggggtttgaggaggggatcggaatgtggctcaagttcgggaggcgttacctgcggagggtttgaggcaggcccaggagcgagcccatggtcttccgacgcggggccaggggcgggccccaggatccggagcttcgtgcggggccgagtccaggtttggggcccgggaggcggggccagttagggcgagggtccctgggatcgtcgggtcaggccttgggctaacgtaggcactctcgcagttcctccgccttcaggaaggtcttttcagcaggggccttacgggtgcatgcttcggtcctggaggccttatcctagcctcctctccatcagcgccacccgtctggggcccgaaaggagggagctttccctctgtcccccagcctttggactgtcagcaaacaagccattcgttcatcaaatactttttaagcgcctaccatgtgcctgacaagggagatgtaacggtgagaaaaactaggtgtggtccaggcccttcaggggctcaggtgctcgtggaagaagtggacattgaagtacttatcacacaaatgaggataaaagtacgatagcgatatctaccacgaagctgttgttccccaccagaaccaaatgagcgcaagatctgacaaagaaaaaanaaggttcatcttttattcctccaaacacttncatttaaatcaagaggatgggatgtggttattgctgtgttttagacagaatcaacggtttctgggtctgagatgtgcatacacttctcagtcctgtatcctgagatggagtacctgagaatcacagcagtctaaccagggatgggtctgggtgatttaggaaggttngcttcagaactgaggcca

SEQ ID NO: 531644 - DNA, 1343 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531645 - DNA, 460 bp, Homo sapiens
tcgagcacgaaaatagggtacatataggctgaggaatcaccctagagagggcttagcagcatcacattgagcctttaaaatttaacatttttaactataaaaaaagaaaggggagtaatatggcaaaggcatctgacatttgagactgtggctccttggttctggtctaagctcttttcattaggtcatacagactatgggttaactcttttactctatgtgtctggttattggtctgaatatagagtcaacaataacagtctgggtcatgttggagagtcaatatataaggctacaattaattcaatctgatgctatcatgaacatttagacataaatataattcaaagagagcaaggctggataggcagtgaattaaaatacagagcacttaaagcaataaaaaattattagattcatttactcatttactcttagtagaccttggcaaacaatacta

SEQ ID NO: 531646 - DNA, 1200 bp, Homo sapiens
aagcttggcacgagggacagacgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaaaaaaaaaaaaatttc

SEQ ID NO: 531647 - DNA, 593 bp, Homo sapiens
tggggttggatggtcatttatttctttaaaataaactccctctaaaggcaggaagtaagtattaagtgagaaaccacagaatgtggtggctctcctccaaattttcctcagtagccctacctagtgtatttttaaatttatcattagaaaaacaaacaaaacgacagcacaagttagcaggtgcagccagtgacgtggtcactcatttataatattatagttctcccgtgacttatacatatatacattccctgggaataataatatggagtgcatttgtggtgagatgtgttctccattatagtggtgtgtgacaacgtatacgtgaataagtgtggtcacaacacaccctgtgacccccttggcgcataagatggtgtggcgaacaacgtgtgctcccatatattgtgggcaacaagaaatgtgaaactctatcttggtgccggtgccaaaatattaatattattatctctatagaccatataacattcctattctccaccaacagagcgctccacaacaatacccctataaaaatctagagtgtcatcacatactatagagctttctacaagaaagcatcacctagaggg

SEQ ID NO: 531648 - DNA, 218 bp, Homo sapiens
ggccattatacttggctcacgatacgtgacacttcttcgacagtggggaaatggaaaaagattaacgtgtactcagtaggtactggatatctgatagtacatttacctccaggactccaaatagagtgatcaaatgaaggtttacaccactgatctccaggtaggatacctgtgatcttgtcctattactgccacggatcccctctgaccttgtggtg

SEQ ID NO: 531649 - DNA, 206 bp, Homo sapiens
tcatgtatctagaggatcagactctgcatgtcctaagtgtgattctcttcaggaagtcagaccttccctggtttaccttttgtctggaaaaagcccaactgaactccagtcagtaggaaagtgccacaattgtcacattgaaccggtactggaaaaaaatcttccattcaaaattaaccaatggattggaccttctggtacttttc

SEQ ID NO: 531650 - DNA, 403 bp, Homo sapiens
  misc_feature (9)..(9): n is a, c, g, or t
  misc_feature (22)..(22): n is a, c, g, or t
  misc_feature (54)..(54): n is a, c, g, or t
  misc_feature (56)..(56): n is a, c, g, or t
  misc_feature (95)..(95): n is a, c, g, or t
  misc_feature (162)..(162): n is a, c, g, or t
  misc_feature (169)..(169): n is a, c, g, or t
  misc_feature (192)..(192): n is a, c, g, or t
  misc_feature (217)..(217): n is a, c, g, or t
  misc_feature (224)..(224): n is a, c, g, or t
  misc_feature (267)..(267): n is a, c, g, or t
  misc_feature (310)..(310): n is a, c, g, or t
  misc_feature (389)..(389): n is a, c, g, or t
gcaggacgncacattgaaatgnggcgggtggacgacggcggtgatggcactctngnaattatgaccagtatacccagcgtgtggtgcacaacgtnccacatttatcgcccaccgcgaacgagtcattgtcggtcatgtaataactgcgtggatactcttgancaccatngtatatttctcaacgcatgcatngggcgccgtaactatacgacttttnacgcgtntcttatccatacagcgctcctgcttttgatcggtatggtgggntgcatactcaagttatactatattgcatcgcccaagacgtcgnaacaaggccgcccacaagcgcacccatcccgtggatttgtgcatgcgctaaaaacactcccgaaagtgctgtctttttntcttagcttcgtcg

SEQ ID NO: 531651 - DNA, 246 bp, Homo sapiens
cctgcctggacacagagtgagatccgtctagaaaactaaaaaaaaaacaaaaaaaaacaactcataaaatagggggaaatgtgtctgggctttagcacactggggataatttgggaggcaaaggcagagaagggatactggcctagcagcctcggtgtagatgcttattaaaaaagtattggcctggccaggtgcgtgggctcatgcctataatcccagcactatgggaggctgggcgtgcacggg

SEQ ID NO: 531652 - DNA, 321 bp, Homo sapiens
  misc_feature (47)..(47): n is a, c, g, or t
  misc_feature (281)..(281): n is a, c, g, or t
cgaccactagactcctagaaatttcgctgaagtgaaaggcccttgantttttataggatttattttccaccctctgacatgcaaatgtcttagtagtaagtctagaatagttgctacttcttactgcttccagtcagcattatgtcatcaatgtaatggaccagtgcgattgatatagaagggaaaggcaattaagatcccttcagattaaattatgacatagggctggagagttggcatacacctgaggtaggacaacgaaggtgtaattgcgagcttgncacctgaaaccaaacttgtttctggtggtctcttacttaa

SEQ ID NO: 531653 - DNA, 755 bp, Homo sapiens
  misc_feature (13)..(13): n is a, c, g, or t
  misc_feature (16)..(17): n is a, c, g, or t
  misc_feature (19)..(19): n is a, c, g, or t
  misc_feature (26)..(26): n is a, c, g, or t
  misc_feature (38)..(38): n is a, c, g, or t
  misc_feature (41)..(41): n is a, c, g, or t
  misc_feature (50)..(51): n is a, c, g, or t
  misc_feature (222)..(225): n is a, c, g, or t
  misc_feature (229)..(230): n is a, c, g, or t
  misc_feature (236)..(236): n is a, c, g, or t
  misc_feature (238)..(240): n is a, c, g, or t
  misc_feature (243)..(244): n is a, c, g, or t
  misc_feature (256)..(256): n is a, c, g, or t
  misc_feature (260)..(260): n is a, c, g, or t
  misc_feature (277)..(277): n is a, c, g, or t
  misc_feature (293)..(293): n is a, c, g, or t
  misc_feature (312)..(312): n is a, c, g, or t
  misc_feature (323)..(323): n is a, c, g, or t
  misc_feature (326)..(326): n is a, c, g, or t
  misc_feature (340)..(340): n is a, c, g, or t
  misc_feature (362)..(362): n is a, c, g, or t
  misc_feature (370)..(370): n is a, c, g, or t
  misc_feature (378)..(378): n is a, c, g, or t
  misc_feature (381)..(381): n is a, c, g, or t
  misc_feature (383)..(385): n is a, c, g, or t
  misc_feature (414)..(415): n is a, c, g, or t
  misc_feature (431)..(431): n is a, c, g, or t
  misc_feature (439)..(439): n is a, c, g, or t
  misc_feature (464)..(464): n is a, c, g, or t
  misc_feature (486)..(486): n is a, c, g, or t
  misc_feature (534)..(534): n is a, c, g, or t
  misc_feature (543)..(543): n is a, c, g, or t
  misc_feature (548)..(548): n is a, c, g, or t
  misc_feature (562)..(562): n is a, c, g, or t
  misc_feature (570)..(570): n is a, c, g, or t
  misc_feature (606)..(606): n is a, c, g, or t
  misc_feature (615)..(615): n is a, c, g, or t
  misc_feature (641)..(641): n is a, c, g, or t
  misc_feature (643)..(643): n is a, c, g, or t
  misc_feature (747)..(747): n is a, c, g, or t
acgaccttatttntcnngngctttcncacagggagganttngaagtaganngaaaccgacctggattactccggtctgaactcaaatcacgtaggactttaatcgttgaacaaacgaacctttaatagcggctgcaccatcgggatgtcctgatccaacatcgaggtcgtaaaccctattgttgatatggactctagaataggattgcgctgttatccccannnnaacnngttccncnnnccnncccactggatcnattnaacatacgtaattcgcnttgcactggagaagtnttagcatgtactgcccggncccccgcctcnccnccgacgtccccccncccgaaattcttaatgcaggtntggcagtntaggaccngtngnnntcccaggtactgtttgccttaataaatcnnccctccataggccccncccgcccnccccgccgctcctcgcccgcctctncacgggcaggtcaatttcaccncgtgtaaaagtaagacacagctgaaccctcgtggagccattccccccngtccccccnccccncacaagtgattacnccaccccngcacggctagggtaccgcggccgttaaacatgtgtnactgggcangcggtgcctctaatactggtgatgcnanacgtgatgtttttggtaaacaggcggggtaagatttgccgggttccttttactttttttaacctttccttatgagcatgcctgtgttgggttgacagtgaaggnaataatga

SEQ ID NO: 531654 - DNA, 342 bp, Homo sapiens
  misc_feature (13)..(13): n is a, c, g, or t
  misc_feature (16)..(17): n is a, c, g, or t
  misc_feature (19)..(19): n is a, c, g, or t
  misc_feature (26)..(26): n is a, c, g, or t
  misc_feature (38)..(38): n is a, c, g, or t
  misc_feature (41)..(41): n is a, c, g, or t
  misc_feature (50)..(51): n is a, c, g, or t
acgaccttatttntcnngngctttcncacagggagganttngaagtaganngaaaccgacctggattactccggtctgaactcaaatcacgtaggactttaatcgttgaacaaacgaacctttaatagcggctgcaccatcgggatgtcctgatccaacatcgaggtcgtaaaccctattgttgatatggactctagaataggattgcgctgttatccttagggtaatcttgttacgatggtcaagttcacttggatcaattgagtatagtagttctgctaagaatggtgcagtgatagcatgtacagatcggagattgggttctgttccgcggttgtctac

SEQ ID NO: 531655 - DNA, 292 bp, Homo sapiens
gagctcgtacccgttctcctcctgctgctgattgaggagggagtgatgctgcagagacttagggcggagacagtggtgatcagtatgagtggtgcgctcagcatggccatgagacgatgatattggagaaatattagacctcctgggttttttaactggatgtcaagtgaaagcgagggtgataacgacccctccccgtttccagtttgggtgagtgagggggtagtgctgctcactgggaatgggtcctcatgcgtgggcatgtttgggagggaaaatgctgagctccaca

SEQ ID NO: 531656 - DNA, 219 bp, Homo sapiens
tactgccggtgctctacttactgccgttcctcttcctcatgtggttgtgcaggcagagcttgatgcatccagatttcaaatattcaaaaattaaatgactatctcagtttaatatatctgtaattataatcaccttttagtctatgactgcgtgtagtgagcacccagttatctttcactcatattccattcatcccccaatcatatccacagatagag

SEQ ID NO: 531657 - DNA, 161 bp, Homo sapiens
cacacgattggaatggttaaaaggaaaaatactgacaacaccaatattgtaaagacaggaggtacagaactctcattcattatattcataaatggacaaatatgaaaactgctatagtagggcagtcttccttagaaagggattgtggacagtggcgtgag

SEQ ID NO: 531658 - DNA, 949 bp, Homo sapiens
tggggggggttgtctttctgtccccattgtgcgcgccctctctttgtcgtggggtctccccctcctctttcagcgggagtgtttttgtctctgcccacacagcttgtggttgatctgttggtgtgtgtggcgcaccctctctttctttggtgtgtccgcccgcgcgcgttttgttgtgttttgtgttgtggtgtgttctgtgttgttgccaatatgtgttacccacgcgactgtgtttatattgtttctatttttgttggagagtcagcacgcgcgcagcccacacacccctcctcttgtggaaggggagactcggcgcgttatatatgatggtcctacacgcgctttttgactacatatatttattctcactatatgtgcgagcaaagtcattctgatttgtcttcccctctcgcgatgaagataatctacactctctggggtgtttgttgtgtttctctcccggtcaccacagagtcatctcttctctctcacacacgaagagactatttgtgtgcgcacacagaggaggcgcgcgcacgctctcttgtgcgcgctgatatagttttcgcacgacttatttttgttccccctcttcccacctctttctctctctctctcgggggtgtgttcccgcgctgctttctgggtgtgtttctctcttgtcgctctgctggtgtgtcgcacactcgtgttgttctcctctctctcgcgaggctatgcccctctgctgtgtggtgtttgtgtggggcctccgcccccgtgtgcgagatggttttttctctccctggtggggggcgcgccccccccccattttttttctctctcccgcacgccgggtggggggggcgcccccgtctgtgtttgcccccccccgcgcggggggggttccttttgttttttctctctttgtgtatatatataaaaacccccctttttccctctccca

SEQ ID NO: 531659 - DNA, 533 bp, Homo sapiens
  misc_feature (44)..(44): n is a, c, g, or t
  misc_feature (61)..(61): n is a, c, g, or t
  misc_feature (63)..(63): n is a, c, g, or t
  misc_feature (66)..(67): n is a, c, g, or t
  misc_feature (144)..(144): n is a, c, g, or t
  misc_feature (195)..(195): n is a, c, g, or t
  misc_feature (314)..(314): n is a, c, g, or t
  misc_feature (330)..(330): n is a, c, g, or t
  misc_feature (370)..(370): n is a, c, g, or t
  misc_feature (408)..(408): n is a, c, g, or t
  misc_feature (453)..(453): n is a, c, g, or t
  misc_feature (488)..(488): n is a, c, g, or t
ccccaccccctcgatttcctcctccgctttccttaaaccgtttnggggggggatctacgantngtnntcgctctctttctcctcgaattctccttgttcgttggctgtggggttttggtattgttggtattcggacaccaggtngtttatgttgctcttggctttggtgaactctattttgttaatgctctcgcncgtgtacaagtggaggaaggctttgggctggaacatgggcgtgaaatgatcggagatgggcttgaaaagtttttggatgggtgtgatgttggtgatgaaggtgggggaaatttttaggngggggggtgggatgtngcacacgggggtttttaagttgttggggatttaataaaanaagtagttgctgttcttgttctgtacgttgaggatctnctcgttcactttttttatggacatgggggtccggaagatgggagntaacgttagtagcggccgtggcgcgggtcgcaggnggccatcatgttcttggagtcgaacatctgctgggtgagctcggg

SEQ ID NO: 531660 - DNA, 187 bp, Homo sapiens
gcgagacatactcaatacaggatacgccgtgagcgcgtatctattactctcatcgcgtagcctccctaacaagcgcctatagcactcgaataattcttctcaccctaacaggtcaacctcgcttcccgagccttactaacattgacgaaaatcaccccactgtactaaaccctattagaactggctt

SEQ ID NO: 531661 - DNA, 1356 bp, Homo sapiens
ggcaagtgcctctggtaccagcgtggatgcccgcatgtatcatggaccagccagctgtgtctacgtacacggaagccactggtggactcaggcacactgggcacctaaaggcaagtgtgcagggtggtgatccgccttcctgacagaagtctgtacagttccgagcacgagggacaccaagctgagacagtccgatcccacatgcatgtacccgtgaagaatttcccataagtgccatccgaggcacacccgtgcattgggctcgcgaaatgaggttttagaagggccctcgtgtccaaacatggcgcagcgagaacaatggtacaacccagggtaccatcactatgaagcgccaatagtttgatggatgcgatagcaacgtgcgtggcgtggtcagaggcacttcaagtcacatgtcgcagtggcatggcgtgggagagacatgctgacagtaagcaaaaccatgggaggcttgacacgctgatcgcgacatggaccttgtggtcgtgattagacagttgaaccatggggcgcttgccacatccaactggagtcaacatccccagtaactgcagaaacaaactatccgggcagccttgcttgccaaccaaaactttcccactaccttgaacacaaggactttcgaacaagaaggcgttcaaggggaagggccggccccggtttccttgggatccgtgggaggccccgaaagaacgagccctgattcaccaaacaacatctcggacatacaaacccttttggaatggttccaaacaaagttcgcccctggacacattcatggggacactaatggctgaactgggcgtggcgatggcgcaaacccgtggttattgacgcccaaagaaccccttaaccagggggcgcttgaacccaagtggcgttcctacacaggtggaaccccaagaaaggccttggctttcgatagggacacaaacaatatatccccgtggcaaacgtatccctgtgtatgggacaggggggatcaccccccggaaaattttttcatagccacccacaaaaacgtacttgggggccgggttccaaaaagacatcccccaagtggtatttcagttggcagccccaagagggaagcacttggagcaaggaaaggcggccccaaattgcgaccgtacattggtcgggaatcgagaaccaaggtcaggagtcacttaaggacaggggaacgcctcacaacacatggcgccaactttcccttggcccccaatgcgccacaagtgacagcagacggcattcccccctgggggacattttccaaacggaagtggtcacccccccaatttggaccctttcggaagacaaaggacttagaatgga

SEQ ID NO: 531662 - DNA, 230 bp, Homo sapiens
gccaggttttgagttttgtgaccaaagccaggggggttccctttccttcccccccctggggcccaagttttggagtgggagggttggttgcccctcccctcagagttcccccaaaggccagtaatggatccccggcctcagtccctattttgttttgggatagtgtgagtttctttttggacaggggtgattttgtccagttccaaccccaataaactttgtagggggga

SEQ ID NO: 531663 - DNA, 251 bp, Homo sapiens
ttcattgtgccctatgtacacttgacgaaacatgttaatgaaagatttcaggatagaaaaaaattaagatgttgttctcatgtgcattggcgtcacttcagagaattggactactgctcttatgtcccggattgcagattatgtgcctggtgtgaagaaagttaatctacaggttctctcctttttcttcattgttctgatgtccattatttattcctttttgtaaaatctatgaggccctcattgctgtg

SEQ ID NO: 531664 - DNA, 290 bp, Homo sapiens
  misc_feature (62)..(62): n is a, c, g, or t
  misc_feature (65)..(65): n is a, c, g, or t
  misc_feature (80)..(80): n is a, c, g, or t
  misc_feature (84)..(84): n is a, c, g, or t
  misc_feature (88)..(88): n is a, c, g, or t
  misc_feature (254)..(254): n is a, c, g, or t
  misc_feature (271)..(271): n is a, c, g, or t
gtccgacttattcgagagcagcatccaaccaaaatcccggtgataatagaacgatacaaggngtngaggaaagcagcctntccntgtntctggataaaacaaagttcacttggtacctgaccatggtcaacatgagtcgagctcatcaagataattagaaggcgcttacagctcaatgctaatcaggccttcttcctgttggtgaacggacacacgcatggtcagcgtctccacaccaatctcagaggttgtantgagagtgagaaagatngaagatggattcctgtaca

SEQ ID NO: 531665 - DNA, 913 bp, Homo sapiens
tggcgaccaggcgccttggggtcggggagacgctgggggccctcaacgcggcctggggccaggcggtccggtgtgtgatcaatggatgacgcgcaccctgtcacctgcgttcccgagactttctggcacctgcaccgcgctgctgcaggcgcgcttcgatgacggccaggttcctggagcatttgctccatgccctcgcctgcctgcatgggccccggtgtggcccctggtgctgctgctgtcgcgcctgacccccggcggggtctgtctctccaactgcagctggtccgccgtcttcggagcgcgtcctcaggcgccgtggccgcctattgccatgcccgcctcgcctgcctcgctgggccagcgcgtcttactacactgcccagcactgcgcagtccccctgcgcactccgcttgagccagcttgcgtacggtgctcgtggccgatcaccttggcgcgagcccttgagcgctcacggggtgtgcagtgcgcctagtgccagcttgtgcgggatccgcacattgcttgaccctatcctgcagcaaacttgcgcggtgaacttggccccgcatgccatcggaaagagaagcttacctcccaaaacccttgaggagccaaggcccttgcaagaactttacctcatgctaattgaccgggcagcgcacactgtaccccatggcaatcctaaggccagacctggtgtcatgacaggaacagatgatctgaacataaccaagtgtgaccgccaccaagccttggcctaagtgaacccccaaagcgctggcaacacaccttgtcctagtctgaccctcgcagggatataaccctacatcaaggtgactagggccttgacgacttgccaacgaaggcctccaaattgcgcactggggccagagggacacgacgcaccaa

SEQ ID NO: 531666 - DNA, 201 bp, Homo sapiens
attacatacatgagcgattctgtctaaccttatttttttttaaaaaaaaaagagagaaagaaagaaaagaaaagaaatggggtcttactctgttggccccgctggagatgaacggcgtgatcacaacttactgcaacctccacctcctgggtccaagagaatcttctgcctcagcctcctgagtagcttggattacaagtg

SEQ ID NO: 531667 - DNA, 296 bp, Homo sapiens
tgagacatatagttatgcaatgcaatcaggattcttatcatcttagtatgactttaatatgatgtcggtacctctgtggttatagtagaaccaccatgaaaccctcacttccactatgtcctatccctaggaggctgtatttgccatcataggaggcttcattcacggatttcccctatcctcaggctacaccctaaaccaaaacgtacgccaaaatccatttcactatctatattcatcggcgtacatctgactttcttcccacaacactttctctggccgttcccggatatgca

SEQ ID NO: 531668 - DNA, 538 bp, Homo sapiens
gctgctctagagtatccccgatgcgtacaacttggtggcagcgcgcagggcttctgctgagggggcaggcggcgcttgaggaccccgcagataagtattttctctttgaaagatagagataatacacctacttaaaatatatagtcaataggtcactaagatattgcttagcgtaacgttttaaacgtaattttcatagcttaagatttcacgcagcaaaatatgaagcattagcaagcagtagcatgaggaaggcacaagcataacatggtttctaaaacatgacggaggtggagatgcaagcttcttcatggagtacaaacatgtctttccaagcaaattgagagcaaaggactcacagagccccgaattaataccaatagaagggcaatgtttttagattaaaatgaaggtgacttaaacagcttaaagttacgtttaacagtggtaggtgattaaaataattggagggccgatcttttacaaaaagagattaaaccgagagtggttaaaagaccttgaaatccatgacgcaggg

SEQ ID NO: 531669 - DNA, 758 bp, Homo sapiens
ctagcgccgtggctcatgcctgtaatcccagcacttgtgaagccaaggtgggcaggtagcttgagcccagaagtttgagaccagcctgggcaacatggcaataccccatctctattaagaaaaaaatttaaggaaaaaaaaaaaaagataaaatggtttgggaaaggcaaagtgtctttctcatatctaatcaattcctgtattttgttttttttatgagttgttctgcaccaatccaaatcaagcgctttaattggtaaagggtattatcctttaagttcaagtaataaaaatattttataaaaacacaatttatcactaaaaccaagttatatattggtctacaaagttattattattggcgccggcgccggggcatatgggttggcgctcaatggcctgtaaaatccccaagggcttggaaagcgctgaggtgagtgggactcactaaaaggtcggggatgtttggaggaccagccttggaccaatcttgggaaaaccccactggtgctcctactaaaggttatacgtttcggcaagggggctacatttggccaacacaaaagaaccttttctacttgaacacgtcaggggcgggggtataaactccaagttccaagttggatgtaacctctggaaatatctccaggggtggagggtccagacgctacccataccatatctggcctgggcggcacaccaggttcgtctcgcttccaaaaaggaacctttctggccacgttcggtatccgaaaatg

SEQ ID NO: 531670 - DNA, 285 bp, Homo sapiens
gcgcaggactcagcagcactccagaactcgggggaccagagtggcccaaccagacagggatcacgcgcacgctcatccagactcataacggcactcgggagggccgctgtacaggcccaggcacccgctcaaacaagtctgcacacaactcctcaaattccccacgagtccctttagccttgaaggccagatcatccatcaggacttcagtctgtgccatgtggtcagtgtcagggaccgaggacggttacgagccgattagccgtcacgcagcagttgggccat

SEQ ID NO: 531671 - DNA, 101 bp, Homo sapiens
ccccccccccccggggtttttttgaaagggtttttttttggggttggccccttttccttttttttaaacaaccccccccccttaaggggtttggggtttca

SEQ ID NO: 531672 - DNA, 381 bp, Homo sapiens
tactactcgccagtggtagagcgtgggtctggtattaaaagatgcaacagaggtagctgtgtctcgccaggtgcccagccactcttgaatacccccaaaaaggagaaaagaaaaccaaaattaaaccaacaaataaaaccaaaaggaggaaaaaattcagatcattttcttcaagcctggcaggaacccacaacagtttgtgtgtaacaggcgttacagtggggagaagccaggctccagaaggccagcccgccagctcctgcagatggcgccagcgctactgctgcatgtctcttctgcaggaagggcaccactgtccctcactccctcccctcccccagtgcactggggctgttcctttacaacatggaagatgggcag

SEQ ID NO: 531673 - DNA, 360 bp, Homo sapiens
  misc_feature (37)..(37): n is a, c, g, or t
  misc_feature (148)..(148): n is a, c, g, or t
  misc_feature (186)..(186): n is a, c, g, or t
  misc_feature (225)..(225): n is a, c, g, or t
  misc_feature (249)..(249): n is a, c, g, or t
ccccccagggttgcactgtggctctggcttctgatcnctgctccatccacctgcagcttcaggggctggtgaaccctgcacgggagctgggcaagctgcaagccaagcgagttaaggcccaacggcaggcccagcgtctgcgggaacnccgtgctgcctcgggctatcctgtcaaggtgccgctcnaagtccaggaggcagataaagccaagctccaacagacanaagcagagctccccaaaatgaatnaggccatcacaaaaataaagaagatgctgtgatccaccacccagcttcacccctcacccccagcggctcaccatggggatggcagcaatataatattttcccacaaaaaaa

SEQ ID NO: 531674 - DNA, 570 bp, Homo sapiens
ggctgccaagaggacccgtagccgatcaaacatttaatttctggacacactctcaatctgggccgacaaaaataacatagatcttcaaaacattaaggctacgtgaaagaacatggacacaaaagaccacatatcgtatgattctattcataggaaagtccagaatagggaaatctatagaggcagaaaggttagtagttgcttaaggctaggggaggagggggaataaggatggtagctaaagggcgaagtgttactttttcgtgtgtgtgtgtgtgtgtgtgtgtgtgtgtgtgtgtgtgttacggtggtgtagtcgggtcagagggagttactacttgaggtgatgaaagtgttgtaaaagagagtgtgatgatgggtgcactcttgtgtgagtacagcaaaacaacagtgaggggtacattttaagggggagaaggggcgcgtgaattatatgtgaataagagtgtgtatatagagaacatagggccatcacagaaaacgtacgtggagacatttgagagcgtgtggagagtgagtcactctgtagtgtcggggaggatgaagtct

SEQ ID NO: 531675 - DNA, 196 bp, Homo sapiens
ctgtcagccagtctggtcccctcgccctctagcagttgcggtacgaggcgatctcgtatgtccatggccagcttcacgctcatgagttcctggtactctacgcagctgcctgtgccatatcctgcttgcccctgccgaagtggcgggcttcctagctcctccgtgcttgtgctggagctgtgacagtggggatcct

SEQ ID NO: 531676 - DNA, 565 bp, Homo sapiens
  misc_feature (19)..(19): n is a, c, g, or t
  misc_feature (25)..(25): n is a, c, g, or t
  misc_feature (28)..(28): n is a, c, g, or t
  misc_feature (30)..(32): n is a, c, g, or t
  misc_feature (36)..(36): n is a, c, g, or t
  misc_feature (46)..(46): n is a, c, g, or t
  misc_feature (48)..(48): n is a, c, g, or t
  misc_feature (50)..(50): n is a, c, g, or t
  misc_feature (54)..(54): n is a, c, g, or t
  misc_feature (56)..(56): n is a, c, g, or t
  misc_feature (75)..(75): n is a, c, g, or t
  misc_feature (109)..(109): n is a, c, g, or t
  misc_feature (151)..(152): n is a, c, g, or t
  misc_feature (192)..(192): n is a, c, g, or t
  misc_feature (241)..(241): n is a, c, g, or t
  misc_feature (440)..(440): n is a, c, g, or t
  misc_feature (490)..(490): n is a, c, g, or t
  misc_feature (525)..(525): n is a, c, g, or t
  misc_feature (546)..(546): n is a, c, g, or t
agttatgaccttttggtcnatgacngantnnntatntgacagaggncncncganantaaaatggagctgaaatanttctgttgcctagtagtgatgtctaatgacatcntagccattgtaatgtagtagcacaaagcattaatcatgtgtnnatagtgatgctagtgtaaacacacatactgcactgctagntgtataaaaatataacacattattatgtatggtatataatacttgatangcataataaacaactgtgtaactggtttatgtatttactataccataccattcattattctagaatatattctagagtttactcctactttttaaaaaaacgttgactatattccagaagaaggcattgttagcattgtagatccatatgtgctagtacccgtgaagacctttcaatgggacaagatgtggaggtgganggtggtgatattgatgatcctgaccatgtgtaggcctaggccattgtctnagtttttaacaaaacagtattgagctgggattacnggtgtgcgccaacatgcgtgnccgaaggagggtccgagct

SEQ ID NO: 531677 - DNA, 188 bp, Homo sapiens
cacgagggttaatccctcccagctgacctcagactatgcatatttcaggctttatattattctactttccagactgaattctcctgtaatgccaggtatcagaggcgtccttaaatacttgtagggatgacgttaggaatattcagttccaaaacaagacatcttctgtccgccttacatgtagcagt

SEQ ID NO: 531678 - DNA, 538 bp, Homo sapiens
  misc_feature (1)..(1): n is a, c, g, or t
ntcaggccagcatcgggttttattgctgatcaaagtggatttcagagggaaggtgagctgaaaagaggggggtgggacaggccggtatgtagtcttcccttgaagtccagctatctccagccagattcgtctcagaagttacgccttaagctgtccctctgaagacaagctgcttctctctgacatccagccatggtcgtcccctcatccagctgcttctcctctctgccagatgagtctggggtctttctaggcacaggatgaggcagggcagagccatgggtggcttaggaaaaggcaacattcaactggaaaaacatggatagaagttctcactttgggccatggtttcaggctttttggcttgagggtggggtttcaccagggacccgctcttttctacctagcatttatctgcctcctgtccctatgcactgcctttgtggcaaaaaaaggagagtgagagctggtcctctctttctctgaaattctgagcctactttgtgagccgcttacgtattcagggatgaattctctc

SEQ ID NO: 531679 - DNA, 343 bp, Homo sapiens
actctagagtatcccgctcgccactgcagtgcagtggcgccatcttggctcagcgcaacctctgcctccctggctcaagcagttctcctgcttcagcctcctttgctagctcgctattgcaagcctggcactactgcccgaatgattttcgtatttttagtaacgactggggtttcaccatttaggccaggtcggtcttaaactcctgacctcttcgtgatctgcctgccactgcccttcccttcagtgctgggacatacaggccaccatgcccagcatcgtgctccttttttgtcgagaacaggtctcatcacgttgcccgcgcgcagtctcgtgatcgggg

SEQ ID NO: 531680 - DNA, 968 bp, Homo sapiens
gcgggtctggctggcggcgagcggcgggagggagcctgagagacccgagtgcacgtgtggagaagcggcggcacgaagcgcggtgtgcagggagactacttcccagccctcgaccagactcaatgccctctactcgagtcttcgctggccgttcggttggcttctgcactagtcgtcacctggcccaggactaggcatggccggcattgcagtgggttgatgtggccgcgacgctaatggagtgccggcagaccttgaagggccggcagaatctacggactggcgattgagtaatcgagtgcgtacacgaacggaccatcgagtcacggacgggcgaacgactgcaaaggcccggctcgacgctgggagcatgtgacacacacacagatattaagacagttgaacagcattgaaagtcaggtcatcttttccgagtctagactacaagtgtacatagttctgacaaggcatgtgactggacggttggcagagcgtagcgaacaacttgcctactttcaatgtatcatggctgtaggtgcagtatgcttgtagggcggatcattcaccagaatcagaagagactttacactcatgacgctaggatgtctggcaccattaccgaaggctagggaactaggagagctaaatgtgttaacatcatgtgttaaacagtctgtgaaaaagatggtactttgtgacaacattgatctgcatgtccaagatcagaatgagtcgggaattgattctacaggaagtgtgggtgtgagattagtgagacaaaggaagaactactattagaggatagagcccgagatgctcatgtgctggagaaaaagcttaaggtacctactgggtcagaaggcgatggtgaaagacggcaaggaccattagcatgaagctattgggaacctggctggtggccaagaaaaggcagggggccgtgaacgagcaggcacaaaacacaggcg

SEQ ID NO: 531681 - DNA, 95 bp, Homo sapiens
tcaggggacacagcactgtatttctgtgccagcagggctcgggactcttatacgtcggggagctgttttttggagaaggctctaggctgaccgta

SEQ ID NO: 531682 - DNA, 634 bp, Homo sapiens
ctagttcatcgcgagcggcgcacaactttgtacaagaaagttggctggtgcatgcctgtcatcccagctactggggatgctgaggtgggaggatcgcttgggcccaggaggtggaggctgcagtgagccgggatcgcgccactgtactccagcctgggcagcagaacgatgaccctgtctttaaaaaaaaaaaaaaaaaaaaaaaaaaaagggggggccgcttcttaaattttcccttcgggggggcccaagtttaccgcgtcaccccagttttctttgtgtcaccaagagtgggcccctatataagtgcggagtcgttatttataaaggctaaggcactgggccggccggtttaaccaacggtctgtcgactggcggaaaaactggctaaacctgggggaatacttgggcgagaagggacaccttacacttcctggggggtggtgacccattatttttggggaccaaatttaccgctaccagaaaaggattttaaaagcgctcataagggggtgacaattatttaacaagtttttaacaggtgtgtattaatgtggtgtgttaacaccttaacgctggcaatattgcgcttgagcgtggcttgagaaaagttacgggcgttatcgggagggtc

SEQ ID NO: 531683 - DNA, 109 bp, Homo sapiens
caacatccagcagataagcttcagtatagaagagccctgagccagttcaagccctagacagctgagtagacctcagagctctgttctaaaccagcagatgcatttggca

SEQ ID NO: 531684 - DNA, 650 bp, Homo sapiens
  misc_feature (6)..(6): n is a, c, g, or t
  misc_feature (105)..(105): n is a, c, g, or t
  misc_feature (116)..(116): n is a, c, g, or t
  misc_feature (124)..(125): n is a, c, g, or t
  misc_feature (148)..(148): n is a, c, g, or t
  misc_feature (155)..(155): n is a, c, g, or t
  misc_feature (162)..(162): n is a, c, g, or t
  misc_feature (640)..(640): n is a, c, g, or t
cagggncggaaaaaaagaggtcctcatggtccccttaaggaagggggccagggtgggagacttgattcaaaaaggaaaaacgtcggggcccctttggcccttatnatggggatggnacagattnntcggcctcatacccctccccctncccgtcnttccctnttttttctttccttccatcaaaaagatgtatttgaattcatactagaattcaggtgctttgctagatgctgtgacaggtatgcccccaaccctgctcacagcctttttgaggacaccagtgaaagaagccacagctttttttgggggatttatactccctgagttttaacttttccccaggggtgctcacctctgcccctattgggagaggtcataaaatgtctcgagtcctaaggccttaggggtcatgtatgatgagcatacccacagggtattattaacccccctttcttcccctttcccacataagaaaattgaggtttggaagagggaagggttttttttttttttttttttttttgagacggagtttttccctgtcgcccagggtggagggcagtgagctgagattgggccattgtgatatgaatatgccttatatggtgatatgaatatgccttaaaataaaagtgttccnccccccctga

SEQ ID NO: 531685 - DNA, 138 bp, Homo sapiens
gtctcacagacaacaagcattcatacgtccttgggcacatgtacaactgaatactgggacaatagacttccctgatcttctgacgttgcagacatcccttcattctgctagcactccaagcagtccagaccccaaaag

SEQ ID NO: 531686 - DNA, 600 bp, Homo sapiens
gtatgtgttcctattgatcataggatattaggtgtgggtaagtaagagagtcttatcccaagaaagaaagttaatgcaaggtcacggcccagttatttgaataggagatgttgaacagactggaataatgactcaatacaatttcagaaagatgtagtgtatctggtctgtttgccaagataacaaagaataatataatacagagaaaacatttaaaaacactcttctatacatcaaatataacaattccacttaaaaaaatcaggtataataaacatctcaatctaatttttcttatgcactaaccaacttctaattctctgagttagtacttttagatttaagaggtaaaaatatataaaagaaactgtaacttatcagaagaaacagcacaggctgggcgcagtggctcatgcctgtaatcccagcactttgggaggccaaggtgggcggatcacgaggtcaggagatggagaccatcccggccaacatggtaaaactctgtctctactaaaatacaaaaattagctggatgtggtggcgtgtgcctgtaatcccagctagtcaggaggctgaggcaggatagttggttgaactcgg

SEQ ID NO: 531687 - DNA, 186 bp, Homo sapiens
  misc_feature (158)..(158): n is a, c, g, or t
  misc_feature (184)..(184): n is a, c, g, or t
gatccacgggaaagagacatgcgaatgggtggcggaggagcaatgaacacgggaaagtgacatgcgtactgagcgctttgggcagggaggtgcgggcctgtgggtggacagggtctagaggaatggggcctggaactccagcaggatatggtagaggnagagaagagtacgaaggcccaaacanaa

SEQ ID NO: 531688 - DNA, 3802 bp, Homo sapiens
ctgtgctcgcatctctggcagcctggattggggtcctgctggagtgaagggtttcctgaggcagggagtactcatagccgtctgtgcctcctgctctgctggactctgatagaggcagtgggcagcagggcaaagaaggaagcagccgccgaggaagcgaaggtggggtgggggtgcccagccctgcggccggaggtgccattgaccctgagagcaagagccatcagtctgatggcttcctctggccggaagctgtggctgagatatccttccttcctcccagcagcctggatttgcctcctcccaggctgggaaaggctagggaggcccaggtggggctgtcagggccaaaggctgtttcaaaagtgtcctttattgccaatcagggggtttggctggcatctgcttgtggcatggggtgctggctctcgtggagcaagactgagggctgtcgagccccaggggtcctgcccatcagcagccatgcttacccctgcagagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531689 - DNA, 397 bp, Homo sapiens
catggatgcagctagaccaatacttcagacatctcacaaaccctactagcagagagatgcagagggccagagtcccctttctcagaagatacagacccgatccacagagaaatgcctgacctagattcaggagatcttatgacagggatccagacacactactttatttacttcaacaaaagagtgagccagcagagccatgtattggaagcaaagcccccaaaagatgatcaaaccattatagaggagcaggcaaccaaaattgcagatttgaagaggcatgtggaattccttgtggctgagaatgaacgattaaggaaagaaaataaacaactataggctgaacaggccagacttctaaaaggcccaatagaaaaggagctggatgtagatgctg

SEQ ID NO: 531690 - DNA, 3573 bp, Homo sapiens
ggcagagaggccgcggagggctggcgggcgagcgcgggcaggcggcgacgcgggggcaggggtggacggcggtcagagccgaacgcgagggcggcgcccggggactggagctgcgcgcaataggacagctggcctgaagctcagagccggggctgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531691 - DNA, 3668 bp, Homo sapiens
ctgtgctcgcatctctggcagcctggattggggtcctgctggagtgaagggtttcctgaggcagggagtactcatagccgtctgtgcctcctgctctgctggactctgatagaggcagtgggcagcagggcaaagaaggaagcagccgccgaggaagcgaaggtggggtgggggtgcccagccctgcggccggaggtgccattgaccctgagagcaagagccatcagtctgatggcttcctctggccggaagctgtggctgagatatccttccttcctcccagcagcctggatttgcctcctcccaggctgggaaaggctagggaggcccaggtggggctgtcagggccaaaggctgtttcaaaagtgtcctttattgccaatcagggggtttggctggcatctgcttgtggcatggggtgctggctctcgtggagcaagactgagggctgtcgagccccaggggtcctgcccatcagcagccatgcttacccctgcagagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531692 - DNA, 152 bp, Homo sapiens
aacgcagctgatcattaagttaacgggtcaccttgaccgagcgccagccttgtgtagcgtagccaaagccgcgttgcttgtaagtgcaccttgacagtacctgaagaagctgtacacagtgtgcaagacttggcacggtcgcactataaact

SEQ ID NO: 531693 - DNA, 2859 bp, Homo sapiens
ggcagagaggccgcggagggctggcgggcgagcgcgggcaggcggcgacgcgggggcaggggtggacggcggtcagagccgaacgcgagggcggcgcccggggactggagctgcgcgcaataggacagctggcctgaagctcagagccggggctgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggccctgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531694 - DNA, 710 bp, Homo sapiens
ggacgcgtgggtccggacgcgtgggtccttgggcccaggaggtcaagcctgcagcgagctgagatcacaccactgcactccagcctggggtgatagaacaagaccctgtctcaaaaaaaaaaaaaacaacaaaaacttacaattggaggagttgtaacctccattgggtttcctcactccaaaatagggagctagatccttcctatacctaataccttaggccacctataaggggtagtaggtgtacaccatgcctgttaagccaagtagcttggggcataggctgcccaatctgagcaaacaccaggtgaaggcctctatgtgagccacgaccaagctccctcaaagcaccctgaaccacgtggggcccttctcgagccttacagccactgatggtcctcttacattgtgccaccaaacgggcgaccacaccaggtgaccaaacaggactcggcaactgttcacccaacgggcacacacatgcagtgactccccaaattccgacgtgaccagacatattaacaactacggcttaccaagagcgacacaatctttgccctacgtgggtacaggcggtacagacatcccatggccacgcctctggcaatttcccaaagcgtccacccagtccccatacgaagcttcgcaaagctttacaaaaatgtaacacccgtataggtcaacctcaaccactctctataaaggaaacc

SEQ ID NO: 531695 - DNA, 3096 bp, Homo sapiens
ggcagagaggccgcggagggctggcgggcgagcgcgggcaggcggcgacgcgggggcaggggtggacggcggtcagagccgaacgcgagggcggcgcccggggactggagctgcgcgcaataggacagctggcctgaagctcagagccggggctgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531696 - DNA, 107 bp, Homo sapiens
tactatttccagagggtagatggtagatggttacacaatattgtactattcatatctcttcgcttttttttcttttcttttgggaaacaggctctccttattgtcgc

SEQ ID NO: 531697 - DNA, 2871 bp, Homo sapiens
ggcagagaggccgcggagggctggcgggcgagcgcgggcaggcggcgacgcgggggcaggggtggacggcggtcagagccgaacgcgagggcggcgcccggggactggagctgcgcgcaataggacagctggcctgaagctcagagccggggctgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatcttgccgcaccaccggctgaggactgtctgtcaccggcactgacttgggtggtcccgggccccctcgaagggttcccctcggattcaaccgggccc

SEQ ID NO: 531698 - DNA, 941 bp, Homo sapiens
  misc_feature (9)..(9): n is a, c, g, or t
  misc_feature (12)..(13): n is a, c, g, or t
agcgggtcnggnnccgccgtctcgctgaggcggagtaggatgaggcccgcggccgtggctccggcgtcggcgggggcagcagcagctgaggcagcagctgaggcagccgcgacggccgcgcccccccccgcgacctgatagccccatcctggccgccgccgccccgcggggggcgcggcggctggggaagctgcttcggtctcccccgcccgcccgcccctctccgctccctcgcacccgcccgtcccacctcttcttacctccctccccgtctgacccctcctccctctcgctccaaacctcgccccccctgccccccccccctccgcgcccgcgctctccgcctcgcctgaccacccctcctcgcgagcctccacaacattcaccgccccactcttcaacacacatgcctacactctcgcgcacgaaccaccctcgctggactcagtctgcacgagatagccccaacccatcctttgctgccactttacgagtcccacgtcctcacgcctaccaactcgtcatgccgaagccgcgcagatcagctccattccacctcatcagcggcttacacaaccagacgcatacagctcccccgcccactgatgtcaacgactgcttagtgtcgtaactcgaatcttcgcaccacccgaccacgcacgaccgaatccgatccacgtccaccacaccaccccctgccatgcctccaccactacccctctctgctcccacctcgcaccccaccccctcactacctaccacgacccgtcaccaacaatcaccccgccacgcccccaacaccactctctatcgaactatctgtccacaccatgcaccacctcatgacctcgcaccccatcatcaccccacatcgctccgctcatcccacgcccgccctccacacgtcgcacgccacagattctcctccccgctctacttcc

SEQ ID NO: 531699 - DNA, 2173 bp, Homo sapiens
ggcagagaggccgcggagggctggcgggcgagcgcgggcaggcggcgacgcgggggcaggggtggacggcggtcagagccgaacgcgagggcggcgcccggggactggagctgcgcgcaataggacagctggcctgaagctcagagccggggctgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531700 - DNA, 223 bp, Homo sapiens
  misc_feature (9)..(9): n is a, c, g, or t
  misc_feature (12)..(13): n is a, c, g, or t
agcgggtcnggnnccgccgtctcgctgaggcggagtaggatgaggcccgcggccgtggctccggcgtcggcgggggcagcagcagctgaggcagcagctgaggcagccgcgacggccgcgcccccccccgatgagatgagattaggcccaggagcgtccggggccgacgccgacccgcgagggggcggggtggggaagtgcttcgtctccagacctacgatag

SEQ ID NO: 531701 - DNA, 158 bp, Homo sapiens
cccgactagcccgacaggtagttctgggaggtgtgaggtctgtggaggaagtgaatggtaggctggggttcatgagggcgctgggatggttgtgcggagacgtgtgcttgaggagtctgctccgggggccgcttatgctgtgagggtaccctggttcc

SEQ ID NO: 531702 - DNA, 464 bp, Homo sapiens
tgggccccgtttgctccagcgtgcttgcccgcggcctgctcggcgtcggacgatctggtcacctagcagcagctagcaacacaggcacacagccgcgacaagggacccacccaacccgccagccacaccagccccaggtttttcatgttggccccgggcctccaaggtcagccgactgggcctgccactacacgtcggatgcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 531703 - DNA, 291 bp, Homo sapiens
  misc_feature (139)..(139): n is a, c, g, or t
tctgctggaccagggtgtgcgccatcaggcgtttttgatggcctacagtgatgcgttctttctggcctgtgtggcgttggcggcctgtgcggtggcggcgttgatgttgcggcgtacctagggtcaatgttgtggttgnctcaagtgagtgcaatgtttcgggtgtgtttttatggtttgggggggctgagtacatatccgttatttgggtaacggctgatatgggttccgctcttacagcggctcacttttgaacagcgcaaaagtaagcaaaacgctcttgccccacca

SEQ ID NO: 531704 - DNA, 383 bp, Homo sapiens
  misc_feature (33)..(33): n is a, c, g, or t
  misc_feature (37)..(37): n is a, c, g, or t
cgcctcagaatgagaaagcctgagaagaaagancccncccccagccccccggaaggaaagcgccggaggtgaaaatgcttttttggcccgggtagtaagaattaaaggttaaagcaggggctgtaaaacccccctttttgcttcaaaatctaaatcccggggagctttgttccctgcccttattaaacaaatgttggtaaacccaaactaaatggacccctgagcttccctgagttaagttatgaaaccttccaatccttcctcatgtcagttcccatgagggggggatggaaaaaaccattgttgcttattaaaaaaagccttaaccgtttctgttttgtaagccttaagcgccaccttttttggttcccataaagcctttt

SEQ ID NO: 531705 - DNA, 131 bp, Homo sapiens
acagagagagaaacagtgagagaccaagagagcaaaccagagagatatggagggggaatgcaaggggtccctgggggcatcaaggagtccagtggagaatgagaggcaggccccccagtggtggcggggcc

SEQ ID NO: 531706 - DNA, 176 bp, Homo sapiens
tagtgatatgataagtatacttggtgactaagtaagcagctgaagaagatgctgacgactaccgaagaggtaacccgattgggcgaaaaagaagtgaaataccgtaagatattggcgagtgagaagagataaattattgaactaaatgagataatgataaataatacggcgctgct

SEQ ID NO: 531707 - DNA, 517 bp, Homo sapiens
aggataaaactacgtcaagcgagcccaccctcttgatcttagctactcctgagagaaaaaaatacataaatcagatccctggatttgatagacagcattcagagagctacaagagagccccacagaccttggaaagaaggtgacccctgtcattcagagttctaagaattgactcttattattatttttccttttatgagacaagggcaagctctgtcaccgaggctagaatacagcggcgtgatcatagctcactgcagccttgaactcctgggctcaagcaatcctccgcactcagtgtcctcagcatcctgagtggctgggtcaatggtcacatgccaccacacctagctaatgtaaaattttttattagagatggggtctctctatgttgccaaggctgttctcaaacttttgagctcaagcaatcctcccccgttcagtctcccaaagtgctgggattacaggtgtgaaccaccatgtttggccttttaaagtcttagttttttgtaatgtt

SEQ ID NO: 531708 - DNA, 882 bp, Homo sapiens
  misc_feature (542)..(542): n is a, c, g, or t
gggaaagagcgcagggactcgcttatgattgttccgctaagtgactaggagctcaccgtgagtcggatcgagatatactggcaacgaagagctgagacggcagtactagctgaaaggcgatctgccagtagctcaccacaggcgagatgacgagtggcaatcactcgtatgatgcaacgttagaatggcagttctcctagtctagagagccgacacttggggagaaagcgcccaacgcaacacgaacgcaagttattgcactacgacacgtctagtgcgagcaggcattcagtccatgaaagggcagcaggaagacatccagtggtcgctgggcaagtctgcatcccgccatgtaagcgtatgctcagccttttctctgtcggataatactgcctcgcacagcataaaggtagaatagtctagtgagtctgcacgcagataagaggactattggccctgatcttgtgagtgtcaggatactccaactccgagattagaggcctagtacttcttagggatacccttgctgtgcgattctcttnaataattaattgccctcgctcaatgacatggtttatattgttctactctatgtttatggggactaagccacattggcagtcgcttgggaacccactacacaccaaatccagtggaccgtgtgttgggcttggcgggttctttctgccccaccaatgggaaccccttggtgtgcaccaaggcttccccagagctccggagcgccctctcctcacttccaggttttggagcaagagcttgcaggaagcccgcacccagcttccctttctgacctttccagttcacttttgtcgcccttggagaaagctgtttttctttaacttaaaataacccaaaatgctt

SEQ ID NO: 531709 - DNA, 484 bp, Homo sapiens
caaaggttaagccaatgagatataattacattagacattatggactcatacactcactattaatagagaaatagtgcaggggggataataaataaataagcaagagtaaataatcatgggctgtttaaagatgacatatttttagcagaaggtaatgaatagttgaaagtataaggatagcagaataaataccatacaaacattcgatgaaagagcacatggagacgccatttagaaaaattacaggatctgagtctcctgagacatagagtacacgtggagagctcacatggtcgctttccctatattcagacacagggtctgttgcccaggttgaaatgcagtggtgatatctagtaccttactgtacacctcaaaactcctgggctgcagcgaatctcctgcctcagccttcacgagtagttatgacccattaggccttgtagtctgcacacgtggctatcatgtctcattgtctcatatg

SEQ ID NO: 531710 - DNA, 1092 bp, Homo sapiens
  misc_feature (370)..(370): n is a, c, g, or t
  misc_feature (378)..(378): n is a, c, g, or t
  misc_feature (380)..(380): n is a, c, g, or t
  misc_feature (388)..(388): n is a, c, g, or t
  misc_feature (395)..(395): n is a, c, g, or t
  misc_feature (518)..(518): n is a, c, g, or t
  misc_feature (534)..(534): n is a, c, g, or t
  misc_feature (566)..(566): n is a, c, g, or t
  misc_feature (573)..(573): n is a, c, g, or t
  misc_feature (580)..(580): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (841)..(841): n is a, c, g, or t
  misc_feature (856)..(856): n is a, c, g, or t
  misc_feature (922)..(922): n is a, c, g, or t
  misc_feature (929)..(929): n is a, c, g, or t
  misc_feature (933)..(933): n is a, c, g, or t
cctaatgtttgtcaagacggtcgacgcactgacccactcctggactttcccatgggtcccctgtctccactaacgtagcatcggacgttctttccattggtaccatcgggacgtactcggtggacctcctatctgtgctcccgcatgatcgcgtacataccattttgtctcgtgcaacctccgtatggtgagtgtttgcgttgtcctctaactgatgtctggctttccccatgcaccttgcgtgcctgtctctggctttggtggtcgtctggggtggctgttctccggtttccaggcaccttgtgtcaggcactgtccctgtcatcctcggggtccgtgctacacgctcccccttgagtcgttcgctgtntagctttncnagcacccntctgccngtctctgtccttatggctgtcccggcctcgccagccctctggggcatttgggagatgcctccccggaatgagccagctctgttgctcgggagcctcttgtcaccttcttggacttattccccncctgataccttatagngaaaagtgtgaattcaggtggagagtaggccncaggccnccatgangncanccagtnggaagtcactggctacctaatgttcatgacatggtgactctcttagtacgaggataacaagccatgtacatggcaatactgcactttacctcgtggacgatttgagaaccctgacaaacaacatggtggcatctcggtgctgcctgttcttgagttttcgtttaggacttagttgagttccacgtctgggttttgcggagcaaacggaccgattgcctaccaagtcttggactgttacgggtcgagaccnctgcaagttgagtantagagagcttgtctttcaaggcaggttcctggggcttcagggctaggagggaggagcctgcccttntaacagnaccncagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagga

SEQ ID NO: 531711 - DNA, 1072 bp, Homo sapiens
  misc_feature (370)..(370): n is a, c, g, or t
  misc_feature (378)..(378): n is a, c, g, or t
  misc_feature (380)..(380): n is a, c, g, or t
  misc_feature (388)..(388): n is a, c, g, or t
  misc_feature (395)..(395): n is a, c, g, or t
  misc_feature (518)..(518): n is a, c, g, or t
  misc_feature (534)..(534): n is a, c, g, or t
  misc_feature (566)..(566): n is a, c, g, or t
  misc_feature (573)..(573): n is a, c, g, or t
  misc_feature (580)..(580): n is a, c, g, or t
  misc_feature (582)..(582): n is a, c, g, or t
  misc_feature (585)..(585): n is a, c, g, or t
  misc_feature (591)..(591): n is a, c, g, or t
  misc_feature (821)..(821): n is a, c, g, or t
  misc_feature (836)..(836): n is a, c, g, or t
  misc_feature (902)..(902): n is a, c, g, or t
  misc_feature (909)..(909): n is a, c, g, or t
  misc_feature (913)..(913): n is a, c, g, or t
cctaatgtttgtcaagacggtcgacgcactgacccactcctggactttcccatgggtcccctgtctccactaacgtagcatcggacgttctttccattggtaccatcgggacgtactcggtggacctcctatctgtgctcccgcatgatcgcgtacataccattttgtctcgtgcaacctccgtatggtgagtgtttgcgttgtcctctaactgatgtctggctttccccatgcaccttgcgtgcctgtctctggctttggtggtcgtctggggtggctgttctccggtttccaggcaccttgtgtcaggcactgtccctgtcatcctcggggtccgtgctacacgctcccccttgagtcgttcgctgtntagctttncnagcacccntctgccngtctctgtccttatggctgtcccggcctcgccagccctctggggcatttgggagatgcctccccggaatgagccagctctgttgctcgggagcctcttgtcaccttcttggacttattccccncctgataccttatagngaaaagtgtgaattcaggtggagagtaggccncaggccnccatgangncanccagtnggagcaccagctcccagtgtcaagaccaggtgcccctagagagggacaacccatgaccaggccaaagccatattcctctgggagatttgagaccccggccgaaaccaaccaggtggccattctggtgtgctgtttttggagttttcgctttaggattatttgagactccacgctgtggtttttggagagaaagagaaggttcccaattctttgaattttaggcgagaccnctgcaagttgagtantagagagcttgtctttcaaggcaggttcctggggcttcagggctaggagggaggagcctgcccttntaacagnaccncagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttagga

SEQ ID NO: 531712 - DNA, 1038 bp, Homo sapiens
tggaatattgtttttgtatcggtggtgcggatgttatagttttgtgtagagttttgtttttattgatgtagaaattgttagatgttaccgtgggtgcaagtattaagggttatctcgaaggtagtgagctggaatggtagaagtggaggtggtcaaaggaattttcgtggtgggatttagaggctgttgtgtaaacggtgcgcagtggtagagttggtgtagggtcccgtcttaatagtctgcgagttctggtttggaaaccgtctcattgtgtggactttgtcaagggagtgctgattaatctccacgaatgttgggtgcatgttctctggcccaatgccgtgccaggttaattttctgcttagccatggtagtattacttgtgggaaatctgaatcgttaatcgtccgtgtttctgattcaactagatcagtggaggaagtctcttgtggaagacgtctctgcgattcttctcacccacgtggtgcgcctctcccctgttcgaggttgcgctcttgctgttcgtccttaaattgttctctcgtaacaccgtttggatgtgtgacattaatgaacattcgcgatatgctgcaacggataaagttgccgttacttatcgaacaatttattacttcctcaatttatcttctcttttgtcgttatcacccctcgtgctctcagcagcgttctgtacaagctcgccgttaggactcagcagttctacgtagcaagagtgcaagaggagaaatccctaacgagatctgtccgtagtgagttttacctttggtgctagaaggcgcgtccttttcagggttgtggtattctataggattagcggagcatgtctttcctctgtttccccacccatctccccaatattgcccatggtattaattaacctctttctttgggttggaaccctggcagttcgtgctcccttcctacggatcctgccagtgcagttgtagcttgcttgaaccggagcacttctccgtttttcccaaaggtctacatatactacgggtggtgggctagatg

SEQ ID NO: 531713 - DNA, 1997 bp, Homo sapiens
ctcggtcttgttttttttctcttgtgtctttgtcttccgtctgtcgctcatgtgtctgttgctccgcgtcgcttgccttccgccgcgtgtctttgtgtgttcttctgtggccgcctgtgtggatcgatcgttgtgctcgcgtcgttgtcgttgtcttgtcttccttgcgctgtcttcgtacgcgcctcgttttgtgctgtgctgctcttgctctgtctgtcggtggtgccgtcgcgctgctcattggcgtgtcttccttctgctcctgcggtctgtcttactgccttgttctctctgtgtcctgtcgctctggcgttgagtctgtgctgtctcggtctttctagtgtgttgtatatgtgttttgttgtgttgtttgctgttgataatgatgtggtgtgagtgttttggtacttgtgtcgtttgttatgttagttattgttgatgtgtgatatactttaaatgtagttgtgattttgttgtgttgatttgtgtttgtgtgtcggtatgtatgtgtgtgattatctgttgtgtgttcgtgatgttagtgttgtgtaggttagtgtgatgttgttctcagtgtttgtaagcaggcaagcgaagagagtaagatcaagagatcaaggaagcaggatgtatagacagatcgtgttgtcggtgtttgatggctactagaatgtatttttagtcgtgcccgctttggggctcgcgcagtcgtggttgcttgctatacagtcctcgtgccgtgctcgtttttttgtcgggagattcttcttctgtttcgctcgtaaacgaagaggggtgttttcgtccccacactccgcttggtctacgccgagctttagtgttcacatgcgggcgacattataaaccctccaaaggcacctgtgtttgcgacggttttggaatgttcagcgtctaataaaacaccctgagggtttaaaaattgttgttgatttgaaacgcaattatttgagggcgcatttaatggtgaacaccggaataatttacaagggggacacaagtgagcattctcttgcggactgtgataaaatgggggcgagatgaccacccaacggcggagcccccagacacaggggtttcacccgcggcgccaattgtcgcttggttctgcgttaaaaattaagaccacgtttgtttgccgcgccaccctttggctggtcgcatatactgtgttgccgaacagcacggactggtgggatttagaagaggggatctctaagaatatagtgcattgtgtggtgctcatagggggcgttctcaattctcacactgcgccgaaaatctcgccacgagtgtcgcaagaggtgcacccttgggcggtcttcccccccggggagaggggagaccaccagaagaatatcttccttagagctttccgcgagagagcacaccgcgagagggcctctttttaggagcccgctctgaaaggaaccccctcttgggatatggggactcgtgccaaatttctcagggactgtatatcctcgcgatatatattagagaaagaggaaagaggaccactgttggggttaaatatctctgtctgtcccccccccactatagagctctctctgctggcgctgtagagtgttacacatatttatcatctcaggcatctcacttaccaccatatctcctggtaagattcgttctctctccccagagtctccaggagacgctcacatgtggacaccaatagcgctctttatatgggaacacttaataacacatataataacaacccaccacataggagggaatagtgaggacctcataatatagggagagtccggcattagagctcatacctcatatcatatcccgtttccctggcccggtggaggcgagagtccatagggtggggacccccattcatacccaacccccagactttacattccggcatttcaagaaattgataggttatattttttgggattttaccgagttaattaataaaaggtttggagagtggg

SEQ ID NO: 531714 - DNA, 196 bp, Homo sapiens
  misc_feature (74)..(74): n is a, c, g, or t
atgacatgttagattttcacaatgtcatctcatcgatgttagacatgttccatagacagtagtttaagtcgagnttttttaattttttgtagtatggttagcacagcaaacttgtaggaattagtatcacatagtaaattttgggttatttagtgattgtttgcatttcagatgtatttttataatagaactttgt

SEQ ID NO: 531715 - DNA, 800 bp, Homo sapiens
  misc_feature (112)..(112): n is a, c, g, or t
aagggagttaaccggagttctcccgcctccaaagaggggcggtccctagtaaacgggagggacgagattaatgtgatgtcgtgtggcccaccgcccacactgcggtttgtgntgcaagtggctgcatatacaggtggtgacacccgcgccttggcgttaccagagaaggaactcgctgtggagaatacaaaccagagtctcttaatgtttgtgtgtcataaaatgtggcctccgctgggtgtgtagaaagattcatgtgtcgtctctcgcggcttgctacaagagccctcctctccttgtgtgatataatctctcctccctcgctcgccacggtgtacacccgtttagatagatagttccccctgcacagcggtgcaatacgccccgcgcgttttcatacactgtgcgtgaaaacctattaaatacaccaacccgcacctgtgggcgcgcgaaagacacccccccgttgtttcttcttgtgcgaagcaccctcgtggtcctacgtccatgtgtaccagtacaccatgtatcacgcttgatgtcgatacccccgcagtggcctccaccattgaaaggggcatgacccccgcgcccaaattcccctgccagaggggtctaacaaaagacgatggaggagcacacaccctccagaccccacacaggagactctaataggaaagaacatacggaccccacgcacatagacggaacaaaggggtggagggagagaccctgtggcgacccccttatttcacagccggcgaacccacgagaacacgagaattcttccacaaaacaca

SEQ ID NO: 531716 - DNA, 819 bp, Homo sapiens
  misc_feature (248)..(248): n is a, c, g, or t
actccagcacagccacgtggatggaaggattcgtaagaccagaaaaaggtaaatgatgtacagaacattgaaaagtaggaggtacaaacaccagaactggaagtaggattctcaggattgagtgtctatggccggtatttgaaacacgagtttgtgaaacgtcctcagacgagatatagtgaaatagattgagagctgcagaacctctgggagatcgtgccaaagacgacagtgcatatgcttgacanttaggcagtaactcccttgttagaggtatttgtcaaatcgtagtcatatccgtgattaacggctagtggcttgacagtatatacattcacaatcgaaggtagcgtgcaaaatactagaagaatactgcaaggtcctttacttcagggtaccagtaatcatagctatgtgacttcagagcaaaaactagcgccatactaatttgggtacatattaatcttcaaattggtggaggaaggattgaactcaaaaaaagcattttaagaaatagtaatgggtcaggtaatcgaaccgataaagtgaagaattggtaacgttaatctatggacttcctttggaaaaatcacaggttcgggggaaagagccgaagtacgaaaacatactggagatttttccatacacgggttaggtgaaccaaaaagaactgtgaagataagaaggggtaacgctccatatttattgcgtggggaaacgattcgctatgattatacaatgggaaggaaaaagaacccttggggtcctggcttcttaaggcgaattttaataattggtaattcccttttaggttgttga

SEQ ID NO: 531717 - DNA, 519 bp, Homo sapiens
acacctcacatgtatacatataccatgatcacataaagtcgagtacttcaaatccaattctaacgtgaaacatgcatgattttgaattgtacactgcatgattaatagtatcagtgaaataagaatcaattcacttacattacaaaatcaccaaatatacaaagcaattttgcatattagttacaacttaaccccccagtctccatattaactgcaagtaacatttcatgaatgaagccacagagcattggttaaaaagtcataatatagttccagtttcaaatctttcatgtcttcactagttaatgtcagcacacagcacaaaatctccatgggcagcaagcagtcaacaccaacacttgctcaaaaataaagggttgctttctcaccaattggtgtgtttacagtctttcaaacatacacatctgaatgctcaacaggttgtttccagcagcccaccattaataatttcattttcagggcccgggcaggtggctcacgccctgttaatcccagcac

SEQ ID NO: 531718 - DNA, 617 bp, Homo sapiens
tacttaaacacctacctttttgtggggaaggcaccgcccaaaaatgccgtgggcacgtccttagctgttcaacgccgaaactttatattgttccttgaaagagagtggaaacgtcccttctttggtaatggtaacaatcgcaactcccaggtgacatcgggaacccttctttcaggacttttgctaacaggttcgaccagctattagccagcgatcctggtggacataacacctcagcgttccttctctcaaaaaaattaagggcggcggtacaggaaagaagcctttggccactttcgacttatcaaactacgtctgaacggccaaccttcgacaatactcccctacctaccaacgctggcctcccccgcgccgagccctctttagactcgtggacgctattctatgcgggcaaatttggctcgctctgggcacctcagtctatttggcccactaaaatccatcggcgggagttctcaccgcctggacgggggaaccctgcgggacagcaccctaacaccccctgacgctatgctcttttctcggctggcgtatcacgctaggacacgtaccgcgccacatcttttccaaaccacggcgcgtttcggtcacaacgc

SEQ ID NO: 531719 - DNA, 221 bp, Homo sapiens
tggctgtagtggtctacttgtataagggtttcgatgaccacgtctgccctatcaactttcgatggtagtcgccgcgcctaccatggagaccagataggacagacaatcaggtaaggcacggcgactaccatcgaaaggtgatagagcagacgttgagatggaaactcttacacagcaagaccactacagcgaggagatcgattgactgtaagccctgaaga

SEQ ID NO: 531720 - DNA, 1162 bp, Homo sapiens
atgacctttggtggacagtctaatctataaagatgtgaagttgacagcaagcaatgatgattattatttgtatttgaagattatttatatcaggtattacttgtttttcccgggatacatctgtgttgagtcacttgcattcaacagtgcctcgccacaaaatcatacataagaggaaaactaggactggaagaatatgctgtcttttacccaccaaatgataaagaaactgaggcatagagtgttaacctgcccaacaggtgttatcccttttcatggattttcaatgtatgttgcaccacttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaacccacttcgcatatcatttaagtggatggttcgagctttctctggatacttagcctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgctaaattgagcattatatatataatattataatatatatataatcctgacttgtcaatggcatgtaataatatatgcaataagaactaaagatactgtaataaacttcaagaggtaatgtagcttcttggataattcttttatgtcagtttataaatttatctctagataatg

SEQ ID NO: 531721 - DNA, 274 bp, Homo sapiens
ctcttggtgacggactcgacctgagatcccaaggggtgagtatcagggcgttttccacatgcgccgtggagacagcgaagctcggtgcctctggccttttacaaggtgcctcgttcccagctgttatccggctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcc

SEQ ID NO: 531722 - DNA, 1122 bp, Homo sapiens
atgacctttggtggacagtctaatctataaagatgtgaagttgacagcaagcaatgatgattattatttgtatttgaagattatttatatcaggtattacttgtttttcccgggatacatctgtgttgagtcacttgcattcaacagtgcctcgccacaaaatcatacataagaggaaaactaggactggaagaatatgctgtcttttacccaccaaatggtgttatcccttttcatggattttcaatgtatgttgcaccacttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaacccacttcgcatatcatttaagtggatggttcgagctttctctggatacttagcctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgctaaattgagcattatatatataatattataatatatatataatcctgacttgtcaatggcatgtaataatatatgcaataagaactaaagatactgtaataaacttcaagaggtaatgtagcttcttggataattcttttatgtcagtttataaatttatctctagataatg

SEQ ID NO: 531723 - DNA, 579 bp, Homo sapiens
  misc_feature (16)..(16): n is a, c, g, or t
  misc_feature (22)..(22): n is a, c, g, or t
  misc_feature (64)..(64): n is a, c, g, or t
  misc_feature (116)..(116): n is a, c, g, or t
  misc_feature (122)..(122): n is a, c, g, or t
tgtgtcataggatacngcatcnggtatatgtgagatgatactaactatccggcagaaactaccntgtggaagccaagtttgggctttacacctctgtaatcccagcacttgggagncagagncaggccaaatctttgaagttagcctgggctacataggaacagccagggctgcatattgagaccctgtgttccagttttctgaggtgggagtggggctctagagagatggcttaggagtccagagcgcctgctgttggcaggattgggttcttcacattcatgcccagtgtctcacagttgcttgtactctgcctccaggggtctgacactctcttctggcctctgtgggcacctagcctcatgtgcacttacccacacacagacacacatacctatgcataaattaaaactaaaaataaatttaaaagtaggctagtgtcaagcgtggtggcacatgcctttagtcccagcactctgaaagggagaagcaggcaggtctctttggaggccagcctggtctacatagtgtgctccaggacagtcaaggctatggagagaccctgtctcaaaaaaaaaa

SEQ ID NO: 531724 - DNA, 337 bp, Homo sapiens
ccgaggatttatggcatggtggaaatcaggtcatagtgggcaagacagttgtgggagggagaagaaaggaggcctggctagcagagtaggtcttgtaaatagagataaaacttcacaggtagcagccctacagagagaattgatggtaaatgtttctttcagacctttaaaggtgtcagacactcggttcatctttcctatatcttgatattggagggcctcagagcaaaccaggctgcattaatgcagattttctctacagatgcaaatctacccccaaaaagacagcttttcagtaattcttgcatttccagccttcctgatttccaccttgcca

SEQ ID NO: 531725 - DNA, 417 bp, Homo sapiens
  misc_feature (184)..(184): n is a, c, g, or t
  misc_feature (199)..(199): n is a, c, g, or t
  misc_feature (211)..(211): n is a, c, g, or t
  misc_feature (273)..(273): n is a, c, g, or t
  misc_feature (287)..(287): n is a, c, g, or t
  misc_feature (301)..(301): n is a, c, g, or t
taaaataagtgcatacaaatacagctagaagcatttctgatttgccaagtgctctaaaaaagcagcgcaagtcacagcctacatagaacggtaactgtcaccaggataataaagcacaaagatatgctaataacgttaacaaaagaaaaaaatgtctttataagtacataccttttgtcgtcanaaaaaatatagatanacactcgtatgnattccaaaatcaatccaaatttataccagccatgttttatggaaggtctacattttcccctngtcctgggatatantatattatatgggngatatatataccaattccaaggcagtttttaaattaaaggggtaatcatttgggggttttttcctggaaaccgggaaaagtcacgagtctctctcttttttcactttccacatatc

SEQ ID NO: 531726 - DNA, 384 bp, Homo sapiens
  misc_feature (383)..(383): n is a, c, g, or t
gggaaaacatttttattcccagcctgtgtcccatgggcacaagcaaatcccaaattctcctcctgaaccctcccaatttgtctctacagactctcttctccttgtttttctgttttcttatggctgaccttgtgtctggcctgaaaaaggtagggagggggctttatcagccctgagccctatgtggtagaagaggcttcagagagggacaagaaggagagtcctcaagatcaagttgcttctcgctgtcaccgacacatccccttctgccacgtcttttttttcttgtacctattccatgagctacaaggggacagctgaggctttggaaacaagctcacacttttcccccaggatgaggagggagggaagccccttgggtng

SEQ ID NO: 531727 - DNA, 886 bp, Homo sapiens
gaaggaagacgctaaacccaaagaaaagacagaggtggccaatacaggagcacccagattcataaagcaagttctcagagacctacagagagacttagactcccacacaataataatgagagactttaacaccccactgtcaatattagacagatcaatgagacagaaggttaacaaggatatccaggacttgaactcagctctgcaacaagcagacctaatagacatctacagaactctccaccccaaatcaacagaatatacattcttctcagcaccacatcgcacttattccaaaattgaccacatagttggaagtaaagcactcctcagcaaatgtaaaagaacagaaatcacaacaaactgtctctcagaccacagtgcaatcaaattagaactcaggattcagaaactcactcaaaactgcacaactacatggaaactgaacaacctgctcctgaatgactgctgggtaaataactaaatgaaggtagaaataaagatgttctttgaaaccaatgagaacaaagacacaacataccagaatctctgggacacgtttaaagcagtgtgtagaggaaaatttatagcactaaatgcccaccaagagaaagcagggagagatctaaattgacaccctaacatcaccattaaaagactttgagaagcaagagcaaacaatcaaagctagaagaggcaagacatactagatcgagcagagtgagggatatggcacgaaaaccttaaaataatgatccggagcggttttgaaaaaaccaatgtgacgtgcagcttagggaaagggggggactggggaaaaaaaaaaaattggggcgcccaaattaactgggggcgagaaaaggtgtgaagggggggttacaaaggg

SEQ ID NO: 531728 - DNA, 248 bp, Homo sapiens
ttgcggattatatataggtaaagatctaagactcctgagccaacttttatgtacctggcttcctagtgctggggcttgcaactaagtaacgaagccaaggcgtacagatctagatagcagagaagtaagtctcattctaaaacatatgcacctactgttagagtccaccccatgaagctgtctcagatatgtgtatcttctgactagaattctagtaagtatatataggtacagcactacaaacaaat

SEQ ID NO: 531729 - DNA, 403 bp, Homo sapiens
ccgccgcctgattctaggctggtcactactccgagcctgtgactgtttgcgcgcacccaggccgtcgacgatgcccagtgaaactctctgggaaattgcaaacgctgatgtggaaaaagaggggaataaagtggaagtgaaggtgatggagcgtgaatattgcagaaaaatgtgttctctactatgtggcagtaaaataggggggagagactacatatatatctctaggggtgtcttgacgagagatgaaccaccaaaaccaaccttagtttgggatatatacttattggcaagaagagcacaggggcacaacacaccaaaagagatctcgcacactttgtggagaacctcgggggggaggaacctctttatatggggactaaatcagatataccccatcaca

SEQ ID NO: 531730 - DNA, 134 bp, Homo sapiens
tgatttttcataattttattaaatcatcactgggaaactaatggttgcgtatcacacaattacctacaatctgataggagtggttttccagccaatcgatcaggaaagacaaacgcacttatgctgctgattcc

SEQ ID NO: 531731 - DNA, 323 bp, Homo sapiens
  misc_feature (21)..(21): n is a, c, g, or t
cagcctttgttaccagaagantcctcaggatgaaaggcaggggcctgaggccctcctgcctacctggcctgcccccctttcccatcccagtggcctgctgtttccccaagacgggctaagcgtttccttatcctgaaatgccttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatg

SEQ ID NO: 531732 - DNA, 237 bp, Homo sapiens
  misc_feature (83)..(83): n is a, c, g, or t
gctaagtgtactgtgataaaacattagcttactattagcggaatacgcagtccagttacgagctaatttgagatcaactgccntacagcattcagcttctccacaaataaagacttttctttgatggcttcatgttttcctcaaaagttccccctcggcctcccaaagtgtgggattacagatgtgagccaccacacccgggctcatacagggctttcaaccacagaccccacccct

SEQ ID NO: 531733 - DNA, 246 bp, Homo sapiens
cttgaaaccggggagcataggttgagtgagccaatatcacaccattacactccagcgtggcacaagagggaaactccatctcaaaaaaaaaagtagttgggtatggtggcgtgcgcttatagtcccagctactcaggatcagagaattcttctggcctttcgttaaaatgttggatgcagtgttgtgctaagaggaagaagcatctccagagactcaaaactgtaactgttgtctttccagggtac

SEQ ID NO: 531734 - DNA, 503 bp, Homo sapiens
  misc_feature (137)..(137): n is a, c, g, or t
  misc_feature (226)..(226): n is a, c, g, or t
  misc_feature (256)..(256): n is a, c, g, or t
  misc_feature (260)..(260): n is a, c, g, or t
  misc_feature (280)..(280): n is a, c, g, or t
  misc_feature (294)..(295): n is a, c, g, or t
  misc_feature (299)..(299): n is a, c, g, or t
  misc_feature (303)..(303): n is a, c, g, or t
  misc_feature (358)..(358): n is a, c, g, or t
  misc_feature (381)..(381): n is a, c, g, or t
  misc_feature (402)..(402): n is a, c, g, or t
  misc_feature (428)..(428): n is a, c, g, or t
  misc_feature (450)..(450): n is a, c, g, or t
atggttaataaaaagacacattataaatatatatatgtaacctgctatatttatatatatatatatatttgcttatttaatttctaattggtgtatccaagtcactgtgaacaccccatttaattactctgtaactnagcttccaggagctggtggtcttgcaataaatcaggcaaagctattacaatataacgtgcatccaaatgttatccaataggcactatgnacaaattatttatagtatatgggattaacnagtngaaacatccaaagggagtcnaaccccgaaagttnnaacncaanccactaaatctttctaggacttacacttcatcctaatttttaaaacttttctagnattcccattcatcctattttttnaaaaagaatttgctttggttnttcaaaaattggcttcttaccaatanccaaaattaaattatatctatnaaaatcctaatggcctgggcttaccctggagctcgggccgaattcggacgagg

SEQ ID NO: 531735 - DNA, 463 bp, Homo sapiens
  misc_feature (28)..(28): n is a, c, g, or t
tgagagaccgtgttgcaatggttatcancacaccctgaggagagatgtacttgtgttcacatcaaatcaatgttttctgccaaagccattggggcagtgatagcctctgaacagagggaaagcccctcccctcacacacacctggctctggccccaatccctccatcttcagctccacctcctaaaaaggtgatggttatcagcacaccctgaggagagatgttacttgtgttcacatcaaatcaatgttttctgccaaagccattgggcattgcaacacggtctccatgagagaccgtgtggtaatggtgaaaacctgtctctactaaaaatacaaaaaaattagccaggcgtggtggcgggctcctgtagtcccagttactcagggggctgaggcaggagaatggtgtgaacccaggaggcggagcttgccaagagccgatatcgtgccactgcacttcag

SEQ ID NO: 531736 - DNA, 125 bp, Homo sapiens
ggaccggcgacagcttcatgaagcagatctcctccttcactgtcagaaatctcggatgaattcaggctggctttgagtataagcgcgctatcgtggactgcatcatcagcatcattgaagagaac

SEQ ID NO: 531737 - DNA, 576 bp, Homo sapiens
  misc_feature (82)..(83): n is a, c, g, or t
  misc_feature (145)..(145): n is a, c, g, or t
  misc_feature (260)..(260): n is a, c, g, or t
  misc_feature (301)..(301): n is a, c, g, or t
  misc_feature (433)..(433): n is a, c, g, or t
  misc_feature (543)..(543): n is a, c, g, or t
  misc_feature (562)..(562): n is a, c, g, or t
  misc_feature (565)..(565): n is a, c, g, or t
aatggatatgttctgatggtttaattcttgagccagggccagcaggcattaaaattttcggccaattgccttgagagaaaanncttaggaaaggctgacagggaacgggtgagagaagacaccgggattctatcgggccacactnaacaaatattaaaggtcaaagcaagatctgggcacggctttccttgggcccctccagacaagtgaggctgttggcaaagtcctcatcaccctcggcaggaagcgtcacccgagancagacttttgtctcgtgggtcccagatggcacaggagcacngcatgcttgttttctagagcccagccagtcatgggtgctagccgagtctccacacaccagcaagtagaacccaagtgtattgtataaatatttcctgaggaccagtaagagaatgcattctctctcccaaanaggccaggaatgttgaaaatgctcagccttacatagaaactcctagattttcacaaacgcatttcacaaaagtaaataagtatttcacacaattcagaggatgtttaaanggccagcattttaataaanacntgcaccagaaa

SEQ ID NO: 531738 - DNA, 932 bp, Homo sapiens
  misc_feature (610)..(610): n is a, c, g, or t
  misc_feature (625)..(625): n is a, c, g, or t
  misc_feature (747)..(747): n is a, c, g, or t
  misc_feature (769)..(769): n is a, c, g, or t
  misc_feature (772)..(772): n is a, c, g, or t
  misc_feature (807)..(807): n is a, c, g, or t
  misc_feature (815)..(815): n is a, c, g, or t
  misc_feature (828)..(829): n is a, c, g, or t
  misc_feature (840)..(840): n is a, c, g, or t
cgtggttgttccttagaaagggtaggcatggcaacattccagcaggctccattctccagtatctcattaactcattgaaagattccagttgtatttgtcacctggggtgacaagaccagacaggctttcccaggcctgggtatccaggaggctctgcagccctgtgtgaagggccctaactagagttctagagtttctgattctgtttctcagtcagtcgcttgtcttcagcagagcatatgccttactactagtgggtctgtctctctgaaggttacgagtcgtaccatgtcgttagatgtactgcacagcaatcgggtagttgcgattctgatctgcaagcacgcacagagtacaggatgtcagtgggctgctctggcccctggttgtgcgacgcgctgtgagcagactgtcgatgccagatgtccgtcgtaagctcatgctggtccttgtgattaggacaccgtctatctcccttgggaataagcacatacaggcttaagctcttaacgatacgataggtgtttgtccttgttaccatctgagctacttgcccataataaccactttgtcatccaacactcttcacccacctcccatacgcaatgtnatgtggatacttggnccaaagtaactggtggtaggaatcttagaaacaagaccacttatactgtctgtctgaggcagaagataacagcagcatctcgaccagcctctgccttaaaggaaatctttattaatcacgtntggttcacagataattcttttnttnaaaaaacccaacctcctagagaagcacaactgtcnagagtctngtacacacaactnnacatgcatcangagtctaaaaatcaaagaaaatcaaagaaaaaaaaattgtttgattacaaaaagataatttctaaataaacaatatattaattaaaaaaaaa

SEQ ID NO: 531739 - DNA, 362 bp, Homo sapiens
ggcgcgtggggagttggagagtttgcgtggcgtggaacgcagtgcggcggtgagagcgagtcggttgcctggtcccttgcgtccggtgcggctgatgcttgaccccggcgttcgaccatcagtccaggatccggacttcctgactatcgcggcatccgcgtgccctacgcccgggtctccgagttcgactgtctacttcgaggggtctgactttcaagttctacgccaagccatactttctcagtattaaccccttcctgtgaagaacttgtaccaaaatggaagtgatgcatggggtcctactgatgcagagttaaggggaggtttttaagcacttctggctgtgcctcaatgagaaaccc

SEQ ID NO: 531740 - DNA, 947 bp, Homo sapiens
  misc_feature (610)..(610): n is a, c, g, or t
  misc_feature (625)..(625): n is a, c, g, or t
  misc_feature (747)..(747): n is a, c, g, or t
  misc_feature (769)..(769): n is a, c, g, or t
  misc_feature (772)..(772): n is a, c, g, or t
  misc_feature (807)..(807): n is a, c, g, or t
  misc_feature (815)..(815): n is a, c, g, or t
  misc_feature (828)..(829): n is a, c, g, or t
  misc_feature (840)..(840): n is a, c, g, or t
  misc_feature (854)..(854): n is a, c, g, or t
cgtggttgttccttagaaagggtaggcatggcaacattccagcaggctccattctccagtatctcattaactcattgaaagattccagttgtatttgtcacctggggtgacaagaccagacaggctttcccaggcctgggtatccaggaggctctgcagccctgtgtgaagggccctaactagagttctagagtttctgattctgtttctcagtcagtcgcttgtcttcagcagagcatatgccttactactagtgggtctgtctctctgaaggttacgagtcgtaccatgtcgttagatgtactgcacagcaatcgggtagttgcgattctgatctgcaagcacgcacagagtacaggatgtcagtgggctgctctggcccctggttgtgcgacgcgctgtgagcagactgtcgatgccagatgtccgtcgtaagctcatgctggtccttgtgattaggacaccgtctatctcccttgggaataagcacatacaggcttaagctcttaacgatacgataggtgtttgtccttgttaccatctgagctacttgcccataataaccactttgtcatccaacactcttcacccacctcccatacgcaatgtnatgtggatacttggnccaaagtaactggtggtaggaatcttagaaacaagaccacttatactgtctgtctgaggcagaagataacagcagcatctcgaccagcctctgccttaaaggaaatctttattaatcacgtntggttcacagataattcttttnttnaaaaaacccaacctcctagagaagcacaactgtcnagagtctngtacacacaactnnacatgcatcangagtcttgtctccncagcaaaatcaaagtggcacaacttctttgtctacactatcgctactttctaactaaactctctcttctacaaaacaaaaaaaacacaacaac

SEQ ID NO: 531741 - DNA, 361 bp, Homo sapiens
ctgtgcgagacggcacgcggggaattgtgacacatcactctatacactctttggggacacattatgcgcacaggcgactctctgcgagacctctgtggagaaagggtggctggtgtgcgcaacacggacctgtgagaaatggaaggttcttggaacacaaaggtggccacccaaaccttccccgatatggtgagacaccgaaggtgaggggaagggcactcggttttaaggccatggagaggcatttttggatcctttctttggttaaaggtgttaaggtggttttacaggaaggtggccagctgttgagataaggtgtctggctgttggccaaggtctggggaccttgggtggggggttt

SEQ ID NO: 531742 - DNA, 110 bp, Homo sapiens
ccaccttggtctcccaaagtgctgggatgccaggtgtgcaccgccatcctcggccttatcttctcttctctctcagccctctgctcaatatcctcttctgaacctgccta

SEQ ID NO: 531743 - DNA, 212 bp, Homo sapiens
gcgaacgcgcggagccgtgacgttaaggccgcgagcgagcgcgggtggctgcggcggctgcgaccggcggggcggggcgggaccacctggcagtgactgcctttagggcggaaccggctcccgctatcctcagtctgcggtgggatagcggacggtccggcttccggcggccgtttctgtctcatgctggctgtctcgatgagtcgcggccg

SEQ ID NO: 531744 - DNA, 175 bp, Homo sapiens
cacaggctgaccgtttgaggctgttagtgaagtgatttgtggggcttgttctcagctgacccttatgaggtgatagtgtttctgtggatgggattgtgttatgctcttatgcccttggtccttaattatcattgtgacatcatagatatcttctcagacacaggattttctgttg

SEQ ID NO: 531745 - DNA, 100 bp, Homo sapiens
ctacagaaaaggaactgatgtcaatgccctttctatgacccttcccattctagcaagacctcccaccccatcatactctttcacccacagcgcaatggag

SEQ ID NO: 531746 - DNA, 151 bp, Homo sapiens
acctatctatctatcggtctatccctagaacagtatctggtcaccagtacaataaccacctgtatctctcacatgcatgtatgaatgcgcagagctcatgacatgagttacaccttgaaagctgcaggaagagctgatgaggcaaagggga

SEQ ID NO: 531747 - DNA, 271 bp, Homo sapiens
ctactccacttggttgcaccacaagagtatgagccctcggcatgtgcctgccggatggagaccacccattcctttgggatacccagcatttcagtgtctacacaacagccaaccaaaaagttgtgcccggtagttgctccaaaagctaagtacaatccatacaaccaacctggaggtgagggtgacttacttccacccccacctccacctctagatgattccattgtcccttccatctatctctggaaactattctcctccattagctctt

SEQ ID NO: 531748 - DNA, 248 bp, Homo sapiens
caaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtgatctcagctacttgggaggctgaggcaggaagttaatacttgatgagcctaag

SEQ ID NO: 531749 - DNA, 227 bp, Homo sapiens
tgctatgccgacggcggatcgggaattactgctgtagttcagaagaggttggcttccccagagggcagtgtagagctttatgctgaaaagtgtggtcactagaggtctgtgtgccattgccaggcagagtctctgcgtaacaaactcctaggagggctatgctgtgcggatgtgctgctatggtgtgctagcggttcatcatggatgagtgggtgccaaagggtgcg

SEQ ID NO: 531750 - DNA, 109 bp, Homo sapiens
cacttcttcaagaggcgtgtggaggctcatcccattagccaaggtggctacaaaattctccatgatgcagtactgcggcctcgtgctgccgccatcttcaccctgccct

SEQ ID NO: 531751 - DNA, 645 bp, Homo sapiens
  misc_feature (5)..(5): n is a, c, g, or t
  misc_feature (43)..(44): n is a, c, g, or t
  misc_feature (47)..(47): n is a, c, g, or t
  misc_feature (51)..(51): n is a, c, g, or t
  misc_feature (53)..(53): n is a, c, g, or t
  misc_feature (73)..(73): n is a, c, g, or t
  misc_feature (78)..(78): n is a, c, g, or t
  misc_feature (105)..(105): n is a, c, g, or t
  misc_feature (112)..(112): n is a, c, g, or t
  misc_feature (115)..(115): n is a, c, g, or t
  misc_feature (147)..(147): n is a, c, g, or t
  misc_feature (217)..(217): n is a, c, g, or t
  misc_feature (250)..(250): n is a, c, g, or t
  misc_feature (259)..(260): n is a, c, g, or t
  misc_feature (274)..(275): n is a, c, g, or t
  misc_feature (285)..(285): n is a, c, g, or t
  misc_feature (315)..(315): n is a, c, g, or t
  misc_feature (319)..(320): n is a, c, g, or t
  misc_feature (322)..(322): n is a, c, g, or t
  misc_feature (324)..(324): n is a, c, g, or t
  misc_feature (355)..(356): n is a, c, g, or t
  misc_feature (368)..(369): n is a, c, g, or t
  misc_feature (374)..(374): n is a, c, g, or t
  misc_feature (378)..(378): n is a, c, g, or t
  misc_feature (382)..(382): n is a, c, g, or t
  misc_feature (398)..(398): n is a, c, g, or t
  misc_feature (409)..(409): n is a, c, g, or t
  misc_feature (438)..(438): n is a, c, g, or t
  misc_feature (460)..(460): n is a, c, g, or t
  misc_feature (470)..(470): n is a, c, g, or t
  misc_feature (483)..(484): n is a, c, g, or t
  misc_feature (503)..(503): n is a, c, g, or t
  misc_feature (513)..(513): n is a, c, g, or t
  misc_feature (531)..(531): n is a, c, g, or t
  misc_feature (543)..(543): n is a, c, g, or t
  misc_feature (553)..(553): n is a, c, g, or t
  misc_feature (571)..(571): n is a, c, g, or t
  misc_feature (577)..(577): n is a, c, g, or t
  misc_feature (581)..(582): n is a, c, g, or t
  misc_feature (607)..(607): n is a, c, g, or t
ggaantgcgatgtgttgcattttattaaccaccctggagagcnnggntgtngngattaaggcaaacagctaangtganggcacatataaaaggtccacagttggnattcaanggnaaaaaattcagggaaaaatagcagtataatantccctgtgtcaaccagcattctgcagcagccatcctgtcaattacattacataaaatacagataactggngctagacaataaaataatggctgtgttgcgggngtgtaattnnggtatcatcttgtnnagaccttttnttttaaaaaataaaattctgcttaaaaaanatannananaggtgggggggaaaagcgaatgacaaaaagnnagttaaagggannccaanccanaccnccccattgtggcctgngacttgctggngtgaacttcacccaaactagcttggcggnaaatcttctgtcctcttctgcnaccttgaccnaatgcctatgtanngatgttgccacttaatggnatggaactgngcctatggaaatggatgnatgtggaaaacnggtgcaacgngcacgaccacaatctccntgccanatgnntgaatgagtgcctggtgatgatgcngcatgatgtgaaatgctcattgtgaacatctgtcaaaa

SEQ ID NO: 531752 - DNA, 807 bp, Homo sapiens
ctgggccgcacctccggggagcctgagcgcaagagccaagcctgcagcgctgcgatgtgggccactgctgcctgctgctctgcgccggggtcgtggcgtcctgggagttcccctgtctgcgtgtgccggctgagctgtgcgtgaactccttagtggaagtttcgacttcaagtcaatggatgtcgtaagcaccgtgagaccgtacagtacggaggcagtaccagcacgggcgtgcggacgttgtgccgagcaactggaggaagataaacgcgctcacaacaatgggaaccacacatttatgaagtggcactgaaccaattttcagacatgagctgggctgaaataacatcgacaagtatctctggtcagagcctcagaattgctcagccaccaaaagtaactaccgttcgaggtacgtggtccctacccaccttcctgtggactggcgggaaaagaaggaaatttctgtctcacctgtgacaaaatcagggtgccatgcggcagttgctggactttctccagtcactggggccctgtgacgtctgctgatcgccatcgcaaccgtgataagatgctgtccttgtgctggaacagcaagctggtggacatgcgccctaggacgttcaataatcacggctgccaagggggtcttcccaggccaggcttgcgagatatatcctgtacaacaaggggatcatggcgtgaagacacctatccctatcagggcaaggatggttattgcaagttccaacctggaaaggccatcggctttgtccaggatgtagccaacatcacaatctatgacga

SEQ ID NO: 531753 - DNA, 1044 bp, Homo sapiens
tggtctgggcgtgggccgtgcggggtcttcaggggtacctgggctggttacatgcagctctacccctcacgacgcagacattgcagcgcagaaggaccagcagaaagatgcctgaggcggaacgggctgagctggcactgaccctgctggcctgaagctgattccctcctggtgcaggccgggagtggcttggagctggctgccgttgcagacatcctggtcccttggagcaccttcgtggaccagcagcgcttctcacggccccgcaaactggggagagcttgtgccagctgcctcgatacgcaaccgtcggagtactaccagagcacctatgtgtacgtgttcctgggcctcatcctgtactgtgtggtgacgtcccctatgttgctggtgggctctaggcttgtcttatatgcggcgcctgtgacattctctatctgcgcacctttggagtccaagcttgtgctactatggaccgaagaggtgagcacagacgcatcagtatgctctggcttggaggcatctccttcccctttctatccttggccttgagctgagtgcggggctcggacgtacgtatcatgggttgctggtacacgccaccacatggttggatcacatcaggaatcaccacgcattgaccttccaaccacgaagttgacggacatgtggacaggtgaaggaggcttgcaagacttggcgaccgcccaggatgtttaccgggtatgttcctaccgtaggggaaccccttggccaggggccattccctcggaggagcccaaagcttgtaccacaaaaccaccactggacccccaaattggccctatgtacccattggaaaccagggcgtcaatggcagtggctaccaggggcgccagagtatagcggaggccacggccccccagttcagacaatagaccccaggggggagaggaggaatcccccggaccgtatatgggagacaaatacgagcgggtggaccacagtgagggtgtgaccatctcgagggacaaggagtattcgacacaaaacagtgaataatag

SEQ ID NO: 531754 - DNA, 309 bp, Homo sapiens
agtagggtctcgctcggtgtttctactgagcggggtgccccttgtgcccagtgtggacccagcaccactctgaccgaaaacgaagtggtccggccggaagatctggccgaagggccccgagcgcacggagtccatggtggcgggctccagatccacgagcacggtgcggggcacgtacttgccgccagtgttgggctcattgtagtacacgttgatgcgttccagctgcaggtctgctgtccccgtggtaggtgcccgtgggggtcgatgccggtgctcatcgctgatcacctcccaaaaacgacattg

SEQ ID NO: 531755 - DNA, 279 bp, Homo sapiens
agagtaagaactgtcgatcatgtaataggagaccactactgtaactatatagagtgtataagaaccaacatatcatgctaatcctctgggtaacatctacattatcacactaatcattcagctgtaactatgcaaatcacagtctaagatggtagtcagaaaagactaaaatagggagaagaggcaggagtatcaaaggatagtcagtctgacactgctagacattatatcaagatacatatagcagtgatgcactggaactggtatatacaacttcat

SEQ ID NO: 531756 - DNA, 580 bp, Homo sapiens
  misc_feature (365)..(365): n is a, c, g, or t
  misc_feature (461)..(461): n is a, c, g, or t
gacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcncaagactgacctcaaccatgaaaacctcaagggtggagacgaacctggaccccaactacgtgctcagcagccgggtccgcactgggccgcagcatnaagggctaacacgtttggccccaaaattgctcccgtggcgagcgccggggcggtggaagaaactctcttgtggaagcttctcaaaaaggctgacggggggagtttcaaaagggaaattt

SEQ ID NO: 531757 - DNA, 890 bp, Homo sapiens
  misc_feature (65)..(65): n is a, c, g, or t
  misc_feature (145)..(145): n is a, c, g, or t
  misc_feature (172)..(172): n is a, c, g, or t
ggatggtacctacccggcaggtaggttagatgtgggtggtgcatgttaatttcccttagaagttncaagccctgtttcctgcgtaaaggtggtatgtcagttcagagatgtgtataatgagcatggcttgttaagatcaggaggnccacttggatttatagtatagcccttnctccactcccaccagacttgctcatttttcgagtttttaactagactacactctattgagtttaattttgtcctctaggatttatttctgtgtccaaaaaaaaaaaaaagagaaaagaaaaatttagggagaaattttgggggtaaaggctgaggaatggctggaggggttagtggtaccaatttctctttggacccttgggagctaaggatgctgattctagaagaaaagtggctagtctcaagcccggttaaagcccctcggtttctagcccggtaagttcatagcatcagtgaactgggagccacaacagcaaattcctatcaagttggtgtaccatacagttggtggctgaaggcgaatttctggagccattaactcagttataaagcactgagtcctatcttaaggatcatcttaaagagcaaatttctgtcagtgtgcttctgaacctaaaatattacgggagggaggtgtgggcaggacggcggattgatcatgtggccggcaagaaaatctacttccaataatgggtccgggctatacccctattatgtcgtttcccgaagcacattgcctggggtgcactacccaaaaggtgtgacaggtaataggcatggtttgagcagggtcgacatcgcctgccgaaatccaaaggctccaaagagggatttcagcagaccgttccaattgcggcacgactatcccagaaataaac

SEQ ID NO: 531758 - DNA, 684 bp, Homo sapiens
actgtgacggggactcctcgatgtggaaggttcgggtgagtgagattgtagaaggatgccgtagcacacgggcaccacaggtgcacgtgcggcagatcacgttgtagggcatgctgaagtccggtgtcggcaggttcaccagcagcggctccgtgtagagccgcacaaagtagttagagccatcagagactgggaacaggctgttgaagaggggactctcttcccagtccactggcttggctgctaccatgctgggcacaagggcgctgaggaccgatggggctgacatagaatccatggttaggatctggtgtgtactcggtccacttcagcagctgcccgctcaaactggatggaaaccttggtgactgagttggccggcagctgaatcagcatctccaggaggtggggttgcagccggtcctgggcaggctggtagtggatgtcacttggtatagttctccttgcccttggaggttatggtgagggtgtgcacatacggccgcagataccagggtacggtgtccagcagcagcaccgggaaggcccggtatgggtaggtgttgtacagcagtgtgctcagatccccttctgcagccatagcactccgtaccggggacctctaagtgactgcggcttaagctggcctggcgtgttaacttgggggaaaaaggggcggggaac

SEQ ID NO: 531759 - DNA, 101 bp, Homo sapiens
atgacgagccggtccggaagaagaggcaggcggccctagaggtcaccgctcgctactgtggccgggagctggagcagtatggccagtgtgtggcggccaag

SEQ ID NO: 531760 - DNA, 953 bp, Homo sapiens
gagtgttgaagtattgccagcattgtgaatagataacctgtgtgtagttcctcaccctgttaatgcgtgcggtaaatgtagagttgggatgtgtaactggaagcgaggtgggagggacgatctgtcagatgaatgtctctaatgttcgctaggagttgggtgggggtcgagaatattgcttgtcgaggttcattggttctaccctctcagggatcccggtcgttacgatgtaccttatcagtgcataattcgatctgctaggtcgatatatcagcatataagcaaagtaaaatctccacatatgcgagggaattaattccaagaagaaaacagcagcgattatgacagttcttactaaagaaaacttatgaatgacaagtatcttcactgtctaggaaggatcctagtggtgaaaagcagaagttgtaccatctcggaagcaaaatcggcatgggtatgttaaattccatttgtgtctcgcacccacgctacccaccatgtaactcagcactctgaataatttgtttgaaagctcgcattagaacttggtttgcttttattgacctggtaaagctatattcgggattggttcgaaaagaacgggtacaagaagacgacgcggtcggtgggcatgaaaccatggtggtcctcaactaaggtattattcgcgaaatcgcactagtcctagacgattctaaattcgtggcccaaacttggcgggttgtgaatgaacgcgatgtggttacgcgactaggaagcttcgtttaggacctgtagaatccactctcaaggtggcctgggagactgtcttttaactcccgtttgaggctttagtgtgtacctccgattcgaaggcatgaaaggacgtaacaagtatcagagcggcgccgggaggaatccacattcaggtccctcttgaggagaaactttcgaaagcaaattggggtagggca

SEQ ID NO: 531761 - DNA, 393 bp, Homo sapiens
  misc_feature (332)..(332): n is a, c, g, or t
tgtgcgcgctctatgaggatccccgctgagatgacagtcggcccagttagaatggcgatcattcaaaagtcaggaaataacaggtgctggagaggatgtggagaaataggaacacttttacactgttggtgggacagtaaactagttcaaccattgtggaagatagtgtggcaattcctcaaggatctagaactagaaatgccatttgacccagccatcccattactgggtatacgcccaaaggattataaatcatgctgctataaaggcacatgcacacttgtatttattgcagcactattcacaatagcaaagacttggaaccaacccanaaatgtccatcgatgatagactggattaagaaaatgtggcacatatacaccatggaatact

SEQ ID NO: 531762 - DNA, 660 bp, Homo sapiens
gcccctgcgagtcaagagcacaccagcctcgtcgccaaaaaaggtttttccgggacagaaaaggtggcccgcaaaaagggtgtttccgttgggttccgcagcaggtgcagaaactcttgcgagaaagagcccttttcggggaagtaataaatgctgttgtggactggagtctattcttgtggagcattctttcccccaggccgcgcccgcagcgcctggagggcctccccgcttggcggtgcagtacgcccccgcaatgggccgacacgcgggactcccgcctcgtcaacatcatcgtgggagccttacgattgtttcttgggtcttccatatcatgtctccagaccgctcttccgatgtgtcaacaaagtctttccgcagcagtgcctccgcggagtagatcaccacgcctttgttggggtcctattgtggggacaatcaacattcggacacgtcttcgtcgctgtcatgaacttcaaacaaccctcattaggcccggcggtggatattcaggctgtttatgtgagatcgggccgtttcccgcacgctgcggacgagattatcgtctcacccctgcttgccgcacagttaagagaataattctcgcactggttctgaccccctcaaaaatggtgggttcaacgccccatcaatgaacaa

SEQ ID NO: 531763 - DNA, 368 bp, Homo sapiens
cgcatgatttatcgtcctttgggtctatacccagtaatgggactgctgggtcaaatggtatttcttggttctggatccttgaggaatcgccacactgtcttcctgcagtggttgaactaatttacactcccaccaacagtgtaaaagcatcctatttctccacatcctctcccacatctgttgtttccattgtctttttaattgcatcaccattctcaatttggtgtgcacattggtatctcacttgtagtatatgcatttgccatttctcttgcaatgcaccagtgcatgcagctcttcttatcatcatgtcttatttggcttgactcaaatgtcttcatcttgcagcaactgtcttgttcaatcat

SEQ ID NO: 531764 - DNA, 1216 bp, Homo sapiens
  misc_feature (944)..(944): n is a, c, g, or t
gccggcgagaggcggcggcggaagcggcggtgattgtacgggtaccgagggaagctagtgccagaggactgggggtgctccacacagctcatgcatgcagtagtcattgaatgacatgtggtgcccgttgttgcttcagaggtttcaatcctagggatcgagcgagcggcagatatggcgcggggcgaggcaacccagatcttggactcttgacccagcgtgcctccaggatgcgttcccagcgaaggaaagcgtgaccggagtgtctcgaagacgcagtcgtgggtactaaatctggaacagatagatcaatggatgtctgcagaagggactgcattgccagcctgttgagtaccatcaggaacatcgctcgcgccgaagtaggatcgttcttgtcgctgacgctggtgagcctagagcaatgttttctccttgacggtgcacaacttctacaccttgggggagcgcgggtgtttgttgctggccgcgtattgtgcctatcgttttagtcgccaaggctagacatcgtggggttgcctaactacaaaggggcgccactagtgtggcgagcccacaagggttggccctggaagaccttgggaattgctaaggaaaaagctccatttgcgagtagagagagctttgcggaaccggagttttcgaggaaacgttttgcccttaccactaggtgcgcaagtgtcgggagaccgtttgttttgcggatgcgggcctttgtggcacttctcggaaataggaactccacgatgcgattgcggtttagggggcaaccgtgtctctttcccgttcattctcataagctttgttagggggaacggctccgctatctgggtgcgaccagaggaactcctgtttgtacccccgaattccttttgttgtttgtgcctgtggggcagttgtcctacagcgctggcacccttacaacnttctaggcctaggttccttgtggacacgagaaaccacgaaattggtgggcgttagaaggagccctcgcccacaaggtattagccaatattgggggaccctatgttcggtttgtattaacccccgtctcgacgtacaacactttgactttcgggccgctctatatacctttggggagacaagtgagcgggttgggcggcgaattataggggcgggaaccatactttgagaggaaaattttatacaatttagcgttgtatataggtaacaccca

SEQ ID NO: 531765 - DNA, 183 bp, Homo sapiens
ccaaaccgggggccaacccccctttttccccggttttttgggaaaaaccccccccttcccccctaatttttcccccaaaaagccttttttttggggggggggggaaccttttccaaaatacccaaaaaaaaggttttttttttttttttccccttttttttccccccaaaaccccaaagggga

SEQ ID NO: 531766 - DNA, 111 bp, Homo sapiens
tctgaagacacggccgtgtattactgtgcgagagatgataatccgcccggagtagatggtaggctatggttcggggagtggcactacattatggacgtctggggccaaggg

SEQ ID NO: 531767 - DNA, 135 bp, Homo sapiens
  misc_feature (38)..(38): n is a, c, g, or t
  misc_feature (72)..(72): n is a, c, g, or t
gcggatgaccggctgcagcgggggggcccgggctgagntggcatgggactggggaacgcggtggcttccganggtttcggcagtggcatccggggccggggtcgcgcgttggacggggccggggcgaggcgcgat

SEQ ID NO: 531768 - DNA, 129 bp, Homo sapiens
tgcaattgtaaggggtaatacaacctgcgagtgatacgtacaaggggtttcttatcccctattatcccccaaaaggccggacccccttttcccgcccctaaatgggtggcccccgccctcctctgggaa

SEQ ID NO: 531769 - DNA, 189 bp, Homo sapiens
  misc_feature (133)..(133): n is a, c, g, or t
  misc_feature (178)..(178): n is a, c, g, or t
gtagatagagaatttaaagcagctattataaataaatatgttggaggatttaaagtaagatgaatagatgtaagtaaagtaagatgaccttaggcagataaattgcaacaattaaaggaaccaaatggaattnctagaactgaaaaataaaatataccaaaaagaaaaattaactggnatgggccttaa

SEQ ID NO: 531770 - DNA, 415 bp, Homo sapiens
aagcgcactgcaacaaagaacttccctgagatcggggtaattaataaaagcaaagaggtttaattgactcacagtgtccacatggctggggaggcctcaggaaacttacagtggtggcgtgaaggctaagggaggtatgtcttacatgacagcaggcaagagagagcatgtgaaaaaggaactgtcgaatgcttataaaactgtcagatcttggtgtgaactctctcactattacaagacagcatgggaggaaccaccctcatgatccaatcacctcccaccaagtccttccttcgacacatggggattatggggattacaatttgagatgagatttggttggggacacagagtcaaactatatcaaagaaagtgatgcaacaggtaatatactacctgttgcagtgtgcttccg

SEQ ID NO: 531771 - DNA, 1173 bp, Homo sapiens
catttgctgtcactcgtcttctttccgtttttctctgttgctgcttctatctatctcctctatgtgctctctgtctcgttgcgtgcctctttttgtgcacgcgctttttctgctctccatatttttgtccttttagcttgttccccccccggtgttttctcggttttccggtccaccacagggttttgcccccttttttccccgggggtaccaaggtttatcccggcgccatttcctcgggtgcttggatctcccgctcatttgggcgattttccgccgagcatcagtcctcgtggagccctttcagatcccggtcccccaagaggagggccccttcgacaccaggtcccggaccacttcctgtaacctttgattaaatctcctttgaccgcgttcaaggcgctcccctcaacgctcccggttctgtcctcccaccatagccgagttgaatctttctaagcgcccagtctgccaaggagaaaaagtcctctttctaaggatatccggcccatctcaggctgccggggataaaccacgggagatgaggttacaggagccgacactttcttctggaggcccccttctcccagataccccaagcacttctgaggagccttcgaagcccctggcccagatgccacccttcgcgcacctggtttctgcacttcccgggccttccacgcacgcttttctgagagctcgaggtgtcctctcgggaggcgcaaagcccacggcttctctcacaaaggccccctcccacgttctcgttggtggtgagggcggcggttcacccccgctgtcctaagccccgtgcccacaaacctagtgtcctccacactttccacgcacacacttcccacgaatgggctcacaacttctgccgaagtggtgccgggtaatcacgttctgggacaccaccccaggtcacgttcgagcccatggtttctgggtccctgaggtccacttcccaaaagagcccctcgtgggtaagaagtccacccctccacactggctccacacacataatggctcacatctcacgaaaggaaggagaagtgcttgcttcacggagaggaggcacgcctatacacaaagaggtaattctagaaagaagcacgaaagacagagaatggaaaagataagggaccagaaacccaccaataccgattaaga

SEQ ID NO: 531772 - DNA, 378 bp, Homo sapiens
ctagtgcatctattagcatgtagtaacatcgtgaagtacactgccacacagccttattcgtcagtatcgtgtgttagcagtgggccgattggtcctctgtaacaccaggtggaattcggtcttccagcaggggatgaagaacaagatcttgatattaggcctctttgaagagacagtcctggctgctttccaattgctactgccctggaatgggtgttgctcttaggatgtatcccctcaaacctacctggtggttctgtgccttcccctactctcttctcatcttcgtatatgacgaagtccgaacactcatcatcaggcgaccgccctggcggctatgggttggagaaggaaacctactataagccccctgtccta

SEQ ID NO: 531773 - DNA, 609 bp, Homo sapiens
gtgggaggatcgtttgagctgttcgagaccagcctggccaacatggtgagaccccatctctatctaaaaattgtttaaaaattggctgagcatggttggtgcatgcctgtggtcccagctactcgggaggctggggtggggggatcgcttgaactcgggaggttgaggctgcagtgggttgtggttgcaccacttgcactccaccctggtctcaaaaagagagacacagaaaagaaacttggattaaacccaaaattattcctacagacatatcacaagctgatggtatcctgaagaacagttctagaacaatatcagcttagacatcaaagatcttagcctctggggccaaacgataagccaactggtcaacgttcaggcacggactgttgatatcagcagatgaagcggcggagtccagagaggagtgttcctgtcgacctgcatggcatcctgatcgactggcaggtagggataataaccttcaatttctgccatatggagagaacagctacaagtgattataatgggggatgtcctgttaatgaggagcattctgctgatgatatcatgggagttacgtgtcattcaaaagtcatggcgaaagat

SEQ ID NO: 531774 - DNA, 614 bp, Homo sapiens
  misc_feature (15)..(15): n is a, c, g, or t
  misc_feature (66)..(66): n is a, c, g, or t
  misc_feature (75)..(76): n is a, c, g, or t
  misc_feature (94)..(94): n is a, c, g, or t
  misc_feature (104)..(105): n is a, c, g, or t
  misc_feature (114)..(115): n is a, c, g, or t
  misc_feature (130)..(130): n is a, c, g, or t
  misc_feature (142)..(142): n is a, c, g, or t
  misc_feature (149)..(149): n is a, c, g, or t
  misc_feature (163)..(163): n is a, c, g, or t
  misc_feature (168)..(168): n is a, c, g, or t
  misc_feature (170)..(170): n is a, c, g, or t
  misc_feature (198)..(198): n is a, c, g, or t
  misc_feature (203)..(203): n is a, c, g, or t
  misc_feature (208)..(208): n is a, c, g, or t
  misc_feature (268)..(268): n is a, c, g, or t
  misc_feature (271)..(271): n is a, c, g, or t
  misc_feature (275)..(275): n is a, c, g, or t
  misc_feature (286)..(286): n is a, c, g, or t
  misc_feature (294)..(294): n is a, c, g, or t
  misc_feature (302)..(302): n is a, c, g, or t
  misc_feature (306)..(306): n is a, c, g, or t
  misc_feature (363)..(364): n is a, c, g, or t
  misc_feature (378)..(378): n is a, c, g, or t
  misc_feature (389)..(389): n is a, c, g, or t
  misc_feature (393)..(393): n is a, c, g, or t
  misc_feature (398)..(399): n is a, c, g, or t
  misc_feature (407)..(407): n is a, c, g, or t
  misc_feature (414)..(414): n is a, c, g, or t
  misc_feature (419)..(420): n is a, c, g, or t
  misc_feature (450)..(450): n is a, c, g, or t
  misc_feature (475)..(475): n is a, c, g, or t
  misc_feature (482)..(483): n is a, c, g, or t
  misc_feature (486)..(486): n is a, c, g, or t
  misc_feature (489)..(489): n is a, c, g, or t
  misc_feature (492)..(492): n is a, c, g, or t
  misc_feature (506)..(506): n is a, c, g, or t
  misc_feature (511)..(511): n is a, c, g, or t
  misc_feature (553)..(553): n is a, c, g, or t
  misc_feature (606)..(606): n is a, c, g, or t
ttgttacaacttttnctcccacccatatcttctgctgtgtagtatctggctcttccttgttgtccncatcctttnncttatccttccttctgcntcatcctgtnnttgtagctnngaagtttcttgcttnttctctagggtnatttganggcctctgcatggngattnanggcctgagaaagggctgtgactgctccnatcanacggnccagctcccaggtttcaatctggctttggaattgctgcaggaagtggtcagggtgtcagnggncctnttggaccttcnagtacctncttagtgncccntgttcctccaaaggggggcccctggccaccagggctgctagctatggcctctgggtnncctccccctgggcngggccagggcncttntccanntcgccagnggctgcnccttnncgtttctttggggtgtttttttttgtggcntgtttctgtttggtttgggttcttnccccccnngcnccnccngcgccctcctggcncggcnctcacgcagctcttcctccttggcccgggctcgctccctgangagccgctgctcctcctcctgctgtcgccagctctggctggagccctcagcangtgggggt

SEQ ID NO: 531775 - DNA, 244 bp, Homo sapiens
  misc_feature (29)..(29): n is a, c, g, or t
  misc_feature (128)..(128): n is a, c, g, or t
  misc_feature (186)..(186): n is a, c, g, or t
aaaaggcccaaggtggagtattcagtagnggcgctgaagacccacatcagcaagtgtacgctgggcaagttcactgtgcccatgctgaaagaggcctgccgggcttacgggctgatgatttgtctgangaagcaggagctgctggtagccctcaccaagcacttccaggacttatcagaggccgcncgtccagctgccctttcgcagttttgccaggctgcctggtctttttctcagccagtta

SEQ ID NO: 531776 - DNA, 569 bp, Homo sapiens
  misc_feature (332)..(332): n is a, c, g, or t
  misc_feature (443)..(443): n is a, c, g, or t
  misc_feature (489)..(489): n is a, c, g, or t
  misc_feature (543)..(543): n is a, c, g, or t
agtctctaaaaatcttgccataggatttggtctatacttttaaaaaccactcttttttcatgataaagcccttcaacttgctctaaaaggcaacataggaagagagagacgatgcaggccagtcctctccaaataaggcaaaacccagctttatttttagtaatgactttcccaactgcaagagggcacaagtccatgatccagcattacagaaacccaccaacttccagaaaagtttcaacaactcataaagactcacatgtgcatgcagacacaaagacccattttagggaagaggccccaagacatagtctgaagccccagctggggcnctttctccatgacaactcttcagccagcctgggacagtgcaacccttggagtaaccccagctttgcttaactggggacaacccacctctcctcatcctcctgggagaaatngcagttttgtatttttcctgatgttttgatggggcccgacatcagngggtcctcggaaagttcatatttcctggggaaattttgaccaaaccgttaaggnacggaaaaggctttttgggttaactt

SEQ ID NO: 531777 - DNA, 315 bp, Homo sapiens
cccccgggcccaaaatttgggcccgggggaaaaagccccccaaaggggtcccttttcccggggttttagggccccaggggttttaaggggtttctcttttttccctttgccttgggccggggggggcccccccccccccccccctttttgggtttcctggcccccccgttaaaaggggggggtttttttttcccttcttaaagggggggggggggttttaaagccccccggctgggggcccccgggccccaggttttaaaaggtcgtttttttaaccccttcccgggaaaaacccttggggttggggttttttga

SEQ ID NO: 531778 - DNA, 759 bp, Homo sapiens
acaaaatgtcaacatcagcagagatgcccagatctatttatctctaagtatattgaagtgatgctgtttatatgtgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttactttttttttttttttttttgggcttggcttaattatattggtagtggggggcaaacgtttctctctttccttctctatggactccgtgtgggggtggggttcccgtggttggagagagtagttggctccgtgtgcgcctaaaacattatttactcactaaatggagttttccagtcaattaacaaatatttattaagtccctactatgtcccaggcatagtagggctacaatgggtaagcaagacagagtcccgtgcccccaaagagcttatatctaagggggatataaggggatgattagaatcccattggtgtgccctggtacaggaatcatactatttaacaaataatcggtataacactataatggcttagcacagatgggcgagttatctggtgctatgtgaaagcggtgaaatagtgctctaagagttgtcaagagctgtggtttcacatctttcctcatggcaaattcagggactttctaccccctattg

SEQ ID NO: 531779 - DNA, 844 bp, Homo sapiens
  misc_feature (485)..(485): n is a, c, g, or t
  misc_feature (518)..(518): n is a, c, g, or t
gggtgatggcacctgtgaaaaggaggaacgtcatcccccatgatattggggacccagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagctgtgatggaatctgacattggaaagtttggacaaggaaccatgatgggatctctattgacaactagtggagcgctatcgcaagacacgagactctatagatgggatggggtagaccacagggcccccagtggcttaactggtggcagggtctgtggcttggcagcctgtggcttgtgactggtccagaatgcgctgctctgtgtggggcacaggatcatccaggcataacgttttctttctatcctcagtccggggccaagcaagcctatgagnagactgctagtggacatggcccgctattacaanctatgacacgcagctctcggccctcagtctcgtaagtgtatatgtcgttgaccagtgtgcttggaacagtggttacctgaaggcctgtggccataggagcaaggagacactgaggtgttttcctacccaacatgtggtccgtgctctccaaactatctttgagctgaacgtccaggcctttgcaggaggggccatgggggctgtgaatgggatgcagcccatggtgtccctgataaatccagtgtgcagtctgatgaagtctgggtgggtagtggtctacgggctggcagttaccatgatccaagaggtaatgcactccttttccc

SEQ ID NO: 531780 - DNA, 124 bp, Homo sapiens
gcaccatacttattattctgcgcttgagctgtaagtcctaggcacagctctatacctccttattcgagccgatctgggccagcctggcgaccttctaggtaacgaccacatctacaacgttatc

SEQ ID NO: 531781 - DNA, 304 bp, Homo sapiens
agagaacttccttattactgccttaatttcgttatttacccagtagtcattcaggagcaggttgtacagtattccatgtatttgtagcagtattgagatgagtttcttaatacctgagttctatatttgattgcagatgtggtctgacgagacgtgttatgactttccagttcgtttcacactctagctgaggcagtttttactattcaacatattctggtgaattttcagaataagtacaatagtggtgctgagcaagaatgtatattctagtcaactttgggcgtggagcagtatctgtaga

SEQ ID NO: 531782 - DNA, 114 bp, Homo sapiens
ggggggagggggttgaaagttcaatcgacgtaaatcactaaacgaagattctgtacatttttgtttttattttgttttatttcttgtcgatacttttcacttttgagtggaaaa

SEQ ID NO: 531783 - DNA, 321 bp, Homo sapiens
cgttgctgtccagtgcttcttacccatttaagagttttgagaactaggctttacgatcggtttcgtcgcccccaaagatctctatagtcattcgttcttaccggataaaactgcgtggcgggggtgcgttcgtggatctgcgaaaaaccccggctatcctgagggaaacttcggagggaaccagctactagatggttcgattagtctttcgcccctatacccaggtcggacgaccgatttgcacgtcaggaccgctacggacctccaccagagtttcctctggcttcgccctgcccaggcatagttcaccatctttcgggt

SEQ ID NO: 531784 - DNA, 158 bp, Homo sapiens
cacgagatcaaggagcattgaggagcccaagaggaaaggatgtggctcaggctgggagggactccagttagaatggtggggaagaaccagtaccacatacccagtaggtattaaggtgtccagcagaggatgaaggtcagcaagttaagcagggccag

SEQ ID NO: 531785 - DNA, 934 bp, Homo sapiens
gtccacggcactgcagggggggactgctgattatagacactcatgtgctaaacacaagcgcttttctaggctttgggatttaaagctacacttctggaatttgtggaagatctggccatcttggaaaattaggtagaaggtgacataaggactggactaaaccactgatcatcccaacagtgcccgtggcttatctgttttcttagtttttgctttgtttttttagagatgaggacgtgctgtgtccctcagtgttggagtgcaatggtacaatcatagcttattgcagccttgaactcctgggctcaagcgatcttcccacctcagcctcccgagtagctgggactaggccctgctaatttatttatcttttgttatagagacaagggtcacgctgtactgcccaggctgggtgtaggttttttctgaagagcatttgggagtttgtttaatgcttggttacttttcctatgcacccttctaccactagggggagatgattaatcactaattgaagggatatgttccgtttttatgtaatagggttaattgataagtagttagatagtatcaataaaagaaagagtttaatccgcacgtaaggcacggccgcgccacgagatggcgtacttattcaaatcggtctctctgaaggctccagaggtaaggggtaaacacggcagaaggtacttgcataatcattcccactactttaggtacactgaaagatgggaagaaatgtgtagttcgaatcgcaaaaataatcgaggtggaaggcatgcaccgctgattgtaaagaaagggacagcaccagaagacggaagccacctagaacaaaagcaaaccctcacaccgcagggacaataagcggaacaaccaccaagacctcaaaagagtgtgaaggacaaaagcgaaaacaaatacacacactgac

SEQ ID NO: 531786 - DNA, 886 bp, Homo sapiens
cccccgagtgcggtctttaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgcttaagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgttactgcggatcaaaattagactctacattttcaaccacagaaataccgggcagtaaaaatttttcttaatattgattgcctacataggttgtgtaattagcatatgtttacagttctatgatttctgcgtggctgctacagagctggagggggtaaagcaacagtattttctcagttgtgcgagcagcattacattataataaataggtaatattaaactgggctgatgagagttgcaaaagtctacttatgtttactattcgtacgacataacccccggggtaacggctcgattctatatgta

SEQ ID NO: 531787 - DNA, 957 bp, Homo sapiens
  misc_feature (957)..(957): n is a, c, g, or t
cagacgcagatcttcaccacctactccgacaccaacccggggtgctgatccaggtgtacgagggctgagagggccatgacgaaagacaacaatctgttggggcgcttcgagctgatgcggcatccctccgggcccccagggcgtgccccatatcgaggtgaccttcgacatcgatgccaacggcatcctgaacgtcacggccacggacaacagcaccgggaaggccaacaggagatcaccatcatccaactggacaagggccggcctgagcaaggaggagatcgagcgcatggtgcaggagggcgggataagatacaaacgcggaagaggggaggtgcacgcgcgagagggtgtcagccaataacgccctggagatcctacgccttcaagcaatgaatgagcgccgtgcgcattgatgagggcgctcaggggcacatatcatcgaggcgtgccacaaacgaagtaagtgtgctgtgacaagtgtcaaggaggtcactctcgtggctggacgccaacatccgtttgtgtcggatgaatggacgatggtttgagcacaaagaggaaggaagctggtaccgctaggtgtgtaaccccatcatcagcggactgtacccgaggtgccggtggtgtccctggggcctgggggcttcggggctctgggctccccggggataggtctgggggtcacggccccaccattgaggaggtagattagggggcctttccaggattgctgtgtctgtttgggcgcttcggactttgcttttcctagtatttctgtttgtcagttctcacttctgggttgcactgtttgagccttcttggtgaagtctgactgttttcccgcgtctacctgggagatgaatttctgccccttcactttctctttatccttatccggccttttagtgccgttcacgctacttacaaaaaaaggggggatcccggggctccctn

SEQ ID NO: 531788 - DNA, 105 bp, Homo sapiens
ggacatcgtacgccggttgcgcgatagccgcccgaacgcacacgcgcccggtggcaataaaaaaaggcccgcgaagactgcggggcctttcggctacgaagcccg

SEQ ID NO: 531789 - DNA, 705 bp, Homo sapiens
gccacactcaactacacactgcgggacctaccgcaagttcttccaggacatcggtctttgccacatggctggctcatgcgggaggacacagaagggctgggtggaagccccgatgccacctgggcgtgctgtgtgcactgcctctatggatactggtcgtaccccacagccagagctccgtatcgtactatgaagagcttccctgcagccgtggacccttagaacattctgactattgcgtggactggccggactgtggtacatgttgaacctctggagcacgagatgtccctggcgagtagctccaagggcactggctacgcatgcgctgccaggaagccaccaaagtcgtatagcctgcgagtgaggcctgcgcaacgcgcacggccgacgcgaacagtcgcaggcactagctaggaccaagctgccagacaagccttgggcccttattctagacagaacgatcgtgcctcgctttgtaggcccactagactcccttggtgctcgaccacgggacctaccttggatggcccttccggccccggagggaaccatggcatggttttggacctatccttggaggaccttggtcactcgggcgccacaccgacagactcttatggcaacaggttctgtcgacacctcgaaccaattcccaaagggccgcccggcagtttccttgggaaccgatggttcacagacatt

SEQ ID NO: 531790 - DNA, 382 bp, Homo sapiens
  misc_feature (52)..(52): n is a, c, g, or t
  misc_feature (346)..(346): n is a, c, g, or t
  misc_feature (357)..(357): n is a, c, g, or t
catgtttttaccactgcaagtggatgggcagggtttttaaaagatttgtttncctgtttgtaaacacttttttattgggagacagagtttcattcttgttgccccatactggagtgcaatggcatgatctcagctcactgaagcctctgcctccccaggttcaagtgattctcctgcctcagcctcccaagtagctgggattataggctgccaccaccgtccctgctaatttttatattttgagtagagagtgggttttgtcttgttggccaggctggtcttgaactcctgacctcagatgatttatctcctcagcctcccaagtctgtaaacattttatgtgagnaaaaaagtagnaaataatcctaaaaactccactttt

SEQ ID NO: 531791 - DNA, 323 bp, Homo sapiens
tctggccaatgttgactctacaaggtgttgaaagcgttccacagggatgctggcccatgttgactctacaaggtgttgaatgtgtccacaggatactggcccagttgactctacatggtgttgaatgtgtccacagggatgctggcctatgttgactctacaaggtgtcgaatgtgatgcacagggatgctggcccatgttgactctacaaggtgtcgaaagcatccgacagggatgctggcccatgttaactctacaagggtgtagaaagtggcagcccatgttgactctacaaggagtccaaaggtgtaccacagggatcc

SEQ ID NO: 531792 - DNA, 872 bp, Homo sapiens
atgcccccgggcgtcttcccctccatcgtgtggcgccccatgtgcaccaggtcgtgatggtgggcatgggtcagaaggattcctatgtgggcgacgaggccagagcatgagaggcatcctcaccctgaggtaccccatcgagcacggatctgtcaccaacgtgggacgagcatgcgccgtaaaatctgtgcatccacaccttctacaatgagctgcgtgtggctcccgaggagcaccccgtgcttgctgaccgaggcccccctgaaccccaaggcaaccgcgagaagatgacccagatcatgtctgggaccttcaacaccccagccagtgtacgttgctatccaggctgtgctatccctgtacgcctctggccgttgaccacctggcgatcggtgatggactccgggtgacgggggtcacccatcattgtgcccatctacgggggggtatgccctccccctatgccatcctgcgtcttggacctggcttggccggggtgaccttgccttgactagcctcgatgaagatccttcaccggagcgcggtaccagttcggccacccaggggcgacgcgggaatcgggggcgtgaccttaggagacagctgtgctacgtctgcccctggactttcgcagcaagagatgggcaggggtgccttccaggctcctccctggggaagaccttggagggtgcctgcggccaggtcattcaccattgggacagcggcggtccggtgccctgtggggtcttccagaccgtccttcctggggtggggccctggggtccacgagaagtcttcactcctcatggagggtgcggggggctcgcgagaacgttggcccctgtttttgtgcgcccacgttccgggttcgg

SEQ ID NO: 531793 - DNA, 237 bp, Homo sapiens
tatatggaccccttccccactgtgagggtgggagcagcggaacagcgaatgccagacaaggctcgctgctgctggaaggcggggtggacttccttcctctgtccggaaggcacaggtgtcaccagttccagccaaagctcctcacaggcgctgtgattttttgtacaagtcttgtacttttcgaatcaacaacttgtatcaatttattaaaaatgctcattgtgggagaaggggtgt

SEQ ID NO: 531794 - DNA, 528 bp, Homo sapiens
  misc_feature (366)..(366): n is a, c, g, or t
tctagaggaccccacgcccatgtcacaacagaatctctgtatatcatacttctgttaggtaacagggtaggtatgttaggtaacagggtaggtatggaacactcagagaattctggaggtggacatgggcacctgagtgggtgccttcagagttggtgtgaaagcgagggaaccaggctcatccaccaaggagccctgggctgcaaggcctgtcaggtcccagaggtggtggaggtcaggccttgtgggccgccatgtttggaaactgggagctgaagctactgcagggcattgagactatggatctttgctcttagtgcagaaacaaggttaggggaagagagggatccttgccctggaggtctnggggctatgtaaaacctgagaactaatgtctcatctggaggacccaggcctagccaaataacggggcggtggtagtggccacattatcaggcgttatctcttgtaaagaggagagagaatttcctgattattgggtactgcaccgagacaagaaatggtaac

SEQ ID NO: 531795 - DNA, 482 bp, Homo sapiens
tccagcaggaaacccaattaccgcggtccctgagtgtagagctcctgagtctctccatacatcttcagggtctcggcagccttttgaaaaataaccagctggtcccggtcccttcaaccctgctgtggtcggggcaagtccagaactcttaactggaagaaattgtatttctgcgtagaatttgaaccccctgaggccccccagcaaggtagtaactagtttaacctgtggtaaccttagggcccaacctgttggatagttttagcttcctgtgaacatttggaacccctggttcagtcccctccccctttttgccccctggtggtggtatctggccttacttgtggggttttccctgctgggcccaagggtgggtttttttaccccctcttttgaggggagtttgggattttggaattgagaggtcctttccaaagcagaaaaaggcccccaatatttaagcaaggaaaaggggaacttga

SEQ ID NO: 531796 - DNA, 544 bp, Homo sapiens
  misc_feature (218)..(218): n is a, c, g, or t
  misc_feature (251)..(251): n is a, c, g, or t
  misc_feature (256)..(256): n is a, c, g, or t
  misc_feature (305)..(305): n is a, c, g, or t
  misc_feature (342)..(342): n is a, c, g, or t
  misc_feature (344)..(344): n is a, c, g, or t
  misc_feature (356)..(356): n is a, c, g, or t
  misc_feature (364)..(364): n is a, c, g, or t
  misc_feature (369)..(369): n is a, c, g, or t
  misc_feature (374)..(374): n is a, c, g, or t
  misc_feature (396)..(396): n is a, c, g, or t
  misc_feature (414)..(414): n is a, c, g, or t
  misc_feature (494)..(494): n is a, c, g, or t
  misc_feature (526)..(526): n is a, c, g, or t
  misc_feature (529)..(529): n is a, c, g, or t
ccaataattgtgttctctcccacagaaagtatgctgaggccttggattaccaccgtcaggcactggtgttgattcctcagaacgcatccacctactctgctattggatatatccacagtctgatgggcaactttgaaaatgctgtggactacttcacacagcccttggtcttaggcgagatgatacattttctgttacaatgcttggtcattgcatcnaaatgtcattggtgattctgaagcttatatcgnagcanacattaaagacaaattaaaatgttatgactttgatgtgcatcaatgaanacactaaaaaacattatttcacctccgtgggattcangnaatttgaagtancagactgnataanaaacngggcttacgccattggaacctnaaggaaactcagattcanaccttccttgaagaaacctttgaaattgaaatgaatggtgccatgatgtagagcattatgtagaccacagacgtgactcngcagtggcctggccactggccaatgtaggacnganaccgcttgagatggt

SEQ ID NO: 531797 - DNA, 360 bp, Homo sapiens
aaaagccccctgtttgtattcccttaaacccgtcggggtgggggaaaggcaaaaacagctaaacccccccggggggtttgttttacatttataagggggccctcaacaacccccctgtttttcccttttttgggaagggtggattaaggggggtgagttgggggaaaaaatgccccccggccctccgggattttttttttttttcaaaaacccccccggaagatccccaaaaacttgagaaaaattgtttcctgatttgtccccttttgggggcaaaaattttattcatttttttaggaccttttatggtttttaaatggataattttaaacaattaaaaaaaaatttttgtttagggga

SEQ ID NO: 531798 - DNA, 2363 bp, Homo sapiens
  misc_feature (1171)..(1171): n is a, c, g, or t
  misc_feature (2064)..(2064): n is a, c, g, or t
  misc_feature (2074)..(2074): n is a, c, g, or t
agcgggcggagctctgaagcggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccaacgctgcggcttccagagcattttggcaaatcaaagccagggaccgttgctgggcctcatttccgcaacttttcggctccgaactgcttctttgacttagaaggatatcttatcctgccgttgtaatggcagctgaactgcgaatgatactttatgaagatgattcagtacaagtacaatatgttgatggttccacattgcaactttctccctgtggctctgaatttttatttgaaaagtcaccacctgtttcagcacatcctttagaacaaccagaaagaattcgtcaaaggacacattttgtcattagcacttacagagagcaactacagcgagccctagattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataanaaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaggtgttacatatagacttacccatcaaaatatgaactcaatagagatttattctggggatggatctgttttcaaatcagaaggggcttattttgggaactattttacttattattctattcaagaaggatcaggaaagagagaagagaaaacttactcagtaaataaccttcctccagatagaccgggaagtccattcactgtcggttctctaattaaacaggcaacaagaattcttcaacattgtgtgaagatgagactttctttaagccataactatcgtatatgctgctggaaaatggtacctgggataaatgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaatggtatntttcttttanacttaaatctgttagaagagctaatacttaaaaaaaattaaaatgtcaaatggtaaactgagacttttttccccaaaaaaactttcttagttttgaatatgtttaactcctaaagtatttttgatagcttaagcttgaaaataatttctaatcagacatctaatttattacatttcatcatattctattttacctaaaggtaagaaaaccttgcattgaaaacttaacatgaaaatgagtggctctttttatgtgacaaattcatccctgaaacttactggcaaaggta

SEQ ID NO: 531799 - DNA, 108 bp, Homo sapiens
tggtggtcctgttgaggtgtctgcccagtcaactccccactggccgtcccggagcgggtcgcgcccggcgcggcgttggatgcagtcaggcggcgttggatgcagtct

SEQ ID NO: 531800 - DNA, 703 bp, Homo sapiens
  misc_feature (236)..(236): n is a, c, g, or t
  misc_feature (445)..(445): n is a, c, g, or t
ggggtgaagaggatgccgtcgccatgggccgtggtgatccggggacagaggaagggggccgggtctgatgttccgtgcgcaggtgaggcaccgtagaggggctgtgcgccgtgcgcgccgtggattacgctgaggggcacggcgtacgtcaaggtgcatcgttccaggtacatcattcgcatcgagccctgggcacgtcgagtcgcgtccccatcggccgaatggtggatcttccngaggaactcgcgtaatcgcgttataatgaaagctgcgtagcgtgagcatggttcatcttgggcgacggaggagcatatcatatcggggcgcagctcttgattggtagtttgacgagccaatggaatggccacatgttcacatatctgcgcacatgattgcatcccctgattggagcaacctacttgtccctgaacgcgcgttccaaaantcggtgttggcattgaccgttggcatggtaggtaaatgctcttggtacgaacccagtgcgcaaaaggtcctatgtgcctcgtgggcgaatcgagcgggagacatcattgcgccacacgtgttcatgcatccccaacgaactcgcttggaggaactcgagaggagagacgctctgtgtggaacgcgtagcctctcctggggctcccaagaggaacaggttagtcgtcgctccagtccaaacacgatgctagttggtttg

SEQ ID NO: 531801 - DNA, 2041 bp, Homo sapiens
  misc_feature (849)..(849): n is a, c, g, or t
  misc_feature (1742)..(1742): n is a, c, g, or t
  misc_feature (1752)..(1752): n is a, c, g, or t
agcgggcggagctctgaagcggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccaacgctgcggcttccagagcattttggcaaatcaaagccagggaccgttgctgggcctcatttccgcaacttttcggctccgaactgctcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataanaaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaggtgttacatatagacttacccatcaaaatatgaactcaatagagatttattctggggatggatctgttttcaaatcagaaggggcttattttgggaactattttacttattattctattcaagaaggatcaggaaagagagaagagaaaacttactcagtaaataaccttcctccagatagaccgggaagtccattcactgtcggttctctaattaaacaggcaacaagaattcttcaacattgtgtgaagatgagactttctttaagccataactatcgtatatgctgctggaaaatggtacctgggataaatgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaatggtatntttcttttanacttaaatctgttagaagagctaatacttaaaaaaaattaaaatgtcaaatggtaaactgagacttttttccccaaaaaaactttcttagttttgaatatgtttaactcctaaagtatttttgatagcttaagcttgaaaataatttctaatcagacatctaatttattacatttcatcatattctattttacctaaaggtaagaaaaccttgcattgaaaacttaacatgaaaatgagtggctctttttatgtgacaaattcatccctgaaacttactggcaaaggta

SEQ ID NO: 531802 - DNA, 768 bp, Homo sapiens
agcgggcggagctctgaagcggctccctgagggcgctggttttgaactggtcttgtgcggtttgcgctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccaacgctgcggcttccagagcattttggcaaatcaaagccagggaccgttgctgggcctcatttccgcaacttttcggctccgaactgctgtgagtggaagacttttggtggttgttttgatcaggctccttctgtaactagagactatagcattttgaaagaaatgagatttctcattcatgtcaagaacagactttgtggatttttgagtgttaaacattaccctgacgtaatgtgctgggtgatgagaacgcaagcgggaatgagactgtagagatgagaatggcagtgtgggttggagccgggttatggtttcctatggtatgccaagaaccttagtcattacactgtttgttgtgtatgcttgattatttaccaattagaaaaccgctcagtaaagctattaaaaaaaaacacctgaacaaagatagactatttttcccaaattgggaatcagaaaatgtcttccatctatgtatcagcaccgtttttcccctaaaataccaagtaga

SEQ ID NO: 531803 - DNA, 103 bp, Homo sapiens
ggcagaggtgccattgtgtcctcttgttttagtgtcactggctctccctggatcgctccctgagggaggggcacctggatgtgtgattcacaccgtgttgagt

SEQ ID NO: 531804 - DNA, 280 bp, Homo sapiens
tggaaatttaaagaaaaaatttatggaagatctgaaaaacaatccctaaaagatggacttttccaaaaactctagctcacccaaggcatggcgtctatcaggttaaaccgtgcattagacacaaatacaaaaaccatgaacacaagccaccattcttcaacaacttggcagccgaagaaaaaaaagtgcctaagtacccacacagggcagtgcactggccaagaggcagtgggcctctataacctctatacagccacccataacacaaaaaaaacaagcg

SEQ ID NO: 531805 - DNA, 206 bp, Homo sapiens
tcatcttgctacacaagagcaggaatgcttctgtcccttttgttataaatgtatccccgggacctcataacagtgcctggcatgtactaggggttcaataatgtgtttgctacataaacgagatgctgatgtgcatagcggccccacagtgggcgtgcatcactatcccccagtgtgtagaacattgacacgtggtacccgagctc

SEQ ID NO: 531806 - DNA, 292 bp, Homo sapiens
caggagaatcacttgagcccaggatggggaggttgcagtgagccaagatcacaccactgcactctagcctgggcagcagagccagactgcatctcagaacaaacaagtaaaaggatggggaaaatatatcacagaaacactaatcaaaagaaagatggagtagttgtgttaatatcaggcaatgtatattcaaaacaaatatcaacagggataatgagagacattactcaataataaaagaaggcaaaacaatccaaattgtgtattcacctaacaatagaatttcaaaaca

SEQ ID NO: 531807 - DNA, 274 bp, Homo sapiens
ccgccttagtgtaagagcacgcgcttccctttgacagcatcaaatgtctacaggtggatgaagactcttcaggggcgctggactatagagagattccaggccaccacagtcagtcagatatacaggaaagtctcgcagtccatgtacgtgccacgagaggtatcccatgctgcgtcattcgcatgcagggttcggcaagtcagctcagctgtcagcaatcctccataaaggtccatgcaggtaccagcgggtcaatgcatgagctctcgtattc

SEQ ID NO: 531808 - DNA, 146 bp, Homo sapiens
ataggtagaggattaaaaactgcatcagacaggtgctgataataaatactacctatgagaaggaggtgagagccctctgtgtggggcagagtcaaaacagacatctttttagtatgggtactttatctgccacttattttctacga

SEQ ID NO: 531809 - DNA, 505 bp, Homo sapiens
  misc_feature (291)..(291): n is a, c, g, or t
  misc_feature (293)..(293): n is a, c, g, or t
  misc_feature (300)..(300): n is a, c, g, or t
gctcctaggacccggtcggtagtcgtcggcccagcccgccgggggcgcagcgcccgagccgcggccctcgatgacgggaccgagtagcatcatgggctagcactgctcccgctgctcctgcctcacgtgctggcttctgcatgcatgctccatgcgcctgggcctgagcagcacctgccggggccggagctcgaccattacgagccctgccgagacaactgccgaagccatgtgcattccccacgagcgacggtgggcacgcagtggctgttgacacgttcttcccctggncnattacancaagtgtcaattcacgtgcaacgcgcccacgatacgcactgttatgcacgtggcgtactggttagcagctgaaccgccacaagtggtgtaacacagcacagtcatagcaggaacgaaacacggacaagacagacagctacacgaacgagtcttttcaacggttacccgaggacttggacaaggtccacagggcgccgatatatca

SEQ ID NO: 531810 - DNA, 235 bp, Homo sapiens
aatcgagccggtacctgttgctaggtggagtgtggtggcgtgataatagccaagagcctgactcgtgtgctcaagcagtcttcccacctcagcctcctgagtagctgagaagtatgggtgtgtaccaccatgcccagcattttttttttttttttttttttttttttttttttttttgaccccaaaaacccccttttttggggtttttggtccggggaaaggggttaaaaaaatt

SEQ ID NO: 531811 - DNA, 933 bp, Homo sapiens
  misc_feature (735)..(735): n is a, c, g, or t
ttaataggtagcctgttttccttgtttgtcttgacttgtgtcaagctccatgtcgttgttttgtgatgagcagggatttagaactggctcagcagcttagaagagtcttcagcaagctgcgcctagggtaggggcatattctctgttgttattgtactggtaccccaggaggatgcctggtaactgctctttggtcatgatagtggtaatgaatccattcatgtaaaatgcaatatgtctgtatagtttggggccagccgaggctcagatagaggtttagtatgatgccttccctttcttctttgagttatgaagaaacataatgtctggcacagtgtgactgcttcaaatctatgttctgctgctatctcctatagaggagggcagactttttattcttagtgcattggctggtaggtcaaggagggatggactttgaatctaggtgttcagagtcacagatccttagcggtatgtgcgtcttccaggtagaggagtttgtctgtgagtcctatgaatgaagggaaagctatataatttattggtacttcctaaagatagagaggtaaagtcatggtagttatggcaaaattaattttaaaaactgaaacaagtcatgaatttcatataaatcaagaagttttccttataaaagcttccgtttttgacaagtggatcagtgtagactttcatcctagtatcggtgacataatccacgtggaacataagcctggnttgaagggaccggggcccagactggttccgggcccctcgcaacaaaggggggaccaaggccggaactgagcccagcccgtaggggcaacacccggggggggggcaccggctgcacctgagtcgagcaaatgccgccgacagagacaccaagaaccacgcggagcgggtaaaaaaaaggcccacccggagcaaataacg

SEQ ID NO: 531812 - DNA, 224 bp, Homo sapiens
  misc_feature (171)..(171): n is a, c, g, or t
cgcaccgattgactacgcggctgggtctgtgggtggggaacgggagatgagtcaggttttgagctggtgagtaggatttggaaagtagagcaggagtggcagagagaagggtggttacggagaatgaagaaagcctgaatataaggagtctcagaccatttctcattgcgnatggcaaaagttgtctaagtctctaagtatattgaaatcgaaagtgccatttt

SEQ ID NO: 531813 - DNA, 162 bp, Homo sapiens
tcttttgcggtgccttttccaagtgctggccttcctgcagcttcacactcatccctctggctagcgtcttcttccgcaagatccagtccaacactcatcagtgaagatctctgctgcatcctaatgggcaggatggttcacgtccagtcattcgtctgtcac

SEQ ID NO: 531814 - DNA, 192 bp, Homo sapiens
cttccgaggatcccagtaagatgggtataagtgataacaacggtttatggagcttgagtagtttctctattcaatgtggtattggttaaactcgaagccaggggtggcaagacactgcatacgttcgtattattagtgtagaaggcatgaagacttttttccctgcttggagagtgtcatcagacaatgtat

SEQ ID NO: 531815 - DNA, 187 bp, Homo sapiens
caggccgtgtggtgctgagctgggccgactacctcagaggagtggctcccacagctctggcgacgggcttgaggtgggcttgtcgaactggcgcttccggtatgtcaccgtctcgctgtacgcactgaccatctcctcagctgtcctcatgtacagtggcgcagggggtaccggagctcggaattcg

SEQ ID NO: 531816 - DNA, 761 bp, Homo sapiens
tacagacttaactcaaaatggatcatatatctaaatgtgaaatggaaagctataaaacttgatatacagacttatcgtttacaacgctgaggcgtaggtatgagtttttagacattacaccagaagcacatgccgtgtgaagagaaaatagataaattggtggatttcattaagaattagaaaactttttctctctgaaaaatcctgttaagctgggcgcgtgtggttcatgcctgtaatcccagcactttgggaggctgagttgggaagaaattaatagcttgaggccaggagttcaagatcatcctgggcagccaagaggttcgagtgaccaaccttcatgtggagcggaagtaggagagaccttctcatattgttttatattgttttatactcagtacctgttttaagaaaaaaacaaggaagtgaaatcaaagacaggcagcccggcaccaggcctgaaaccagccctagggcctgcctggcctaaacctagtagttaaaaatcaacttgacgacttagaacctgatgttatccgtagattcgcaagcattgtataagaaaaattgtgaaactcctctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagatttaaggctgtagctcgccgatgtcccagctaataacatct

SEQ ID NO: 531817 - DNA, 360 bp, Homo sapiens
cgacgtcagctgtataacgacggcagcttatatccgaggtccagcgtaccgcgcggttccagtgtcaccggcgggtcagagtatcgaggtggtgcagcttaagtccgttggccaccttatatcgctgcacgttctcaaagtggcccaggtattatagcagattgggagagctgtgccccatgagttgctgtaatcgaagttgtggcagatgcgaagagatatagccaatcgacgggcacgaggaagtccacaccatatgcagatattggggctgtgggtctccgagcccttccactcctctcgtggcatatatctctggacctcatctgcattgcagagttcctcctcacggtgtcggga

SEQ ID NO: 531818 - DNA, 107 bp, Homo sapiens
gagagcggcggccggtcccgcgcggagcccggcgcccctccagcccgagccaggacgccgccggccccggtcccgctcctgggcacggggtgtgccagggatgtgag

SEQ ID NO: 531819 - DNA, 101 bp, Homo sapiens
tccatcttggtcttccaaactgctgggattacagatgtgagccattgaacccggcctagttttaagcatatatttttggttgtgtaccccggatccgggga

SEQ ID NO: 531820 - DNA, 216 bp, Homo sapiens
ctaacttttatttctttttgcctaacttttatttctttttgcctaacttttatttctttttgtctaacttttatttctttttgcctaacttttatttctttttgtctaacttttatttctttttgcctaagcttttatttctttttgcctaacttttatttctttttgtctaacttttatttctttttgcccttgggggaggaggccagcttctcc

SEQ ID NO: 531821 - DNA, 311 bp, Homo sapiens
gaaacctaataacggggtggaggaaagggagaaaaagagagtcaggaataaaccccaggtcttagaccttggtaagtggatgggtagtggtgccaccaatgactgaaatggtggagaaagaaagagggctaggcttgggggggaggtaacacatctttctcctttgttcgtggtaaaaaagttcacataaagaaaaatggataaaggagttcccatcgtggctcagtggttaacgaacccgactagcatccatgaggacgcgtgtttgatccctggtctcctcggtgggttagggatctggcgttgccatg

SEQ ID NO: 531822 - DNA, 338 bp, Homo sapiens
  misc_feature (5)..(5): n is a, c, g, or t
ggagncggaagagaaaagcctcgaaacgctgacccgcaccatcaccgaaaccagcgagcagcaggtcagttgggaaaccattccgctgatcgagcctatcagtttaagcctcggttacaaactggtggcgctggtggacaaagcacagggtaaccgctcacccagcggattcgcggcgtgcggcaggtgatttctgacggcaacggcgtgctgctgccggagatccgcattcgggaaaacttccgccttaagcccagtcagtacgccattttcatcaacggcataaaggctgatgaagcggatattccggcggataaactgatgccctgccctccagc

SEQ ID NO: 531823 - DNA, 657 bp, Homo sapiens
atgcctacttgatgttatatctataaaagactgacaggtaattatatttggacgacagttagatgcactaactttaaagaaattgaaaattcaggtggataaatagtcttaccaaagaccatgtgctttatgttatacctatagctttggtcccctctttaattgagaaacatttatctgtataaaacatatttttggataaatatatatatatatatttgtatcgctacacgaaaggcttcttaaaagcactttgaggaaaatatttggttccctctttctataatcactcccttaagatttcttatagctacactttggtttattcactcatatttacacgtatatatattgttcttttcacgtgttcacactcttgtgtccccactttctcaacttgtgtcaaccacgctgtgttgtgccactttttatgtgtaaaaagttgcagagcctattagagtctgcacgtttaagttgccactgctgctaggagaattgtcctttttctttctagctgttaacctacttcctggaaaaagtagtagctctctgtagcattatggagtttcagtggaacccaatttttgccattaaaaactggcattatactgaactatacattgagaaatccatccaaataaaaatttttactttcca

SEQ ID NO: 531824 - DNA, 144 bp, Homo sapiens
gaggctggttattaccctctctgagtctaggactatctacaaaatgatcatataaaatctactataatagaaagactatcaggataatatttggtctatgctagattcccctctacatgtttgttcacaattctgtttagattg

SEQ ID NO: 531825 - DNA, 148 bp, Homo sapiens
gttcagtgcacgatgcattccctggcaggtagattcacacacacacacacacacacacacacacacacacacacatattctctctactcgctgtcgtctcacactatacacgccacacatacacacaacaatttacaccagcaaatta

SEQ ID NO: 531826 - DNA, 714 bp, Homo sapiens
ctacatcctcgaagtgagaataggtgagctcaatgccgccggtcccatatataaaggaaatagagtttcctatgtgaaggcctttatgaagaaatctgaagaagaaatttccacagactatttgagggaccaggtctcctgtgtacatagctgtctgaatgctggatcaagaattgtctgcttggcatctataaatctggaattacaggataagtccccatgcctgctatccagcagtattaaactgtcattttagtaggaattgtctcgagtaccagtaaagagaacaatgaagttgtggtggaatacagtggctcatatctgtaatcagcactttggaaggctaagccagaaggattgcttgaggctaagagttggggacaggcctgggcaccatagcaagacaccttctctaaaaatgaaaaaaattagctggatgtggtgtcatgtacctgtagtcccagttgcttggaagactaaggcagaaggatcccttaagcctgggtgttcaagataggcctggtcaacacagcaagaccccttctctaaaaatgaaaataaaaaaattagctggttgtggtggcatgaacctgtggtcccagttgcttggaaggctaagacagaaggattgcttgagccaagggtttgaggctgcagtaagctatgactgctcccctgcaccccaggctgggtgacagtgagacccagtctcta

SEQ ID NO: 531827 - DNA, 845 bp, Homo sapiens
  misc_feature (14)..(14): n is a, c, g, or t
  misc_feature (52)..(52): n is a, c, g, or t
  misc_feature (75)..(75): n is a, c, g, or t
  misc_feature (98)..(98): n is a, c, g, or t
  misc_feature (166)..(166): n is a, c, g, or t
  misc_feature (171)..(171): n is a, c, g, or t
  misc_feature (180)..(180): n is a, c, g, or t
  misc_feature (245)..(245): n is a, c, g, or t
  misc_feature (249)..(249): n is a, c, g, or t
  misc_feature (264)..(264): n is a, c, g, or t
  misc_feature (271)..(271): n is a, c, g, or t
  misc_feature (378)..(378): n is a, c, g, or t
  misc_feature (509)..(509): n is a, c, g, or t
  misc_feature (602)..(602): n is a, c, g, or t
  misc_feature (606)..(606): n is a, c, g, or t
  misc_feature (632)..(632): n is a, c, g, or t
  misc_feature (641)..(641): n is a, c, g, or t
  misc_feature (649)..(650): n is a, c, g, or t
  misc_feature (674)..(674): n is a, c, g, or t
  misc_feature (678)..(678): n is a, c, g, or t
  misc_feature (690)..(690): n is a, c, g, or t
  misc_feature (696)..(696): n is a, c, g, or t
  misc_feature (698)..(698): n is a, c, g, or t
  misc_feature (713)..(713): n is a, c, g, or t
  misc_feature (739)..(739): n is a, c, g, or t
  misc_feature (742)..(742): n is a, c, g, or t
  misc_feature (747)..(747): n is a, c, g, or t
  misc_feature (749)..(749): n is a, c, g, or t
  misc_feature (751)..(753): n is a, c, g, or t
  misc_feature (758)..(758): n is a, c, g, or t
  misc_feature (761)..(761): n is a, c, g, or t
  misc_feature (775)..(775): n is a, c, g, or t
  misc_feature (777)..(777): n is a, c, g, or t
  misc_feature (828)..(828): n is a, c, g, or t
tactttgaatatanaggaaaccaaatccacaaaacaggaagctatgttctanggttatgccttttaacaaatgtnctgtatttacaaattgttttttnccctaagtaaaagcaccagctgaaaagttataggctgctaaaaccgttacaaatattacaaaccattnaaagncattatgcnaaacgtacttattaaaaaccttaacaaaacgaagagacaactgacaacgcaaccaaccaattganccancatgctgggctgggnggcagtnccaatttccttgcctgtgtttctgataaacggggctgggagtgcttatcccagggagaggatcctcgcccaccggcagggactacagggacagagctggggagaggnagctgtgtctcaaggaaacatggcagcctcacttcctgctgtaggtggcctcctggtcagaccccctcaacccacaggacaagggcagaggcatacaggagggtctggccagctttcggcttgttcatctntcaacagaatgcctttctgcgaccttgtcctcatccactgaagggtttggagtttttgttttttcctagacacttagctacaggacactgtgntgangggtcctcgagggacttgctgtctgncttccattntttttttnntttttgagacaaagtctcaccgtnaccnaggctggagtgnagtgtngngatcatgctcactgnagcctcaatctcctgggctcaagtgnttntcctntntnnncctcncanttttttgggactanangcatgcgccaccgtgtctggcctctattcttgcaattgaatgagatgctangaggcgctgagcgaccc

SEQ ID NO: 531828 - DNA, 276 bp, Homo sapiens
ggaaacctatgatgtatccctttggaaaatgcaccactgaaacgggcatgatggtgggtatgctcccaacatcctggagaagaaagacggcctggcgctgctgaagactgctattgggacaagctggctacactgataagtgtggtcatcggcatggacgtagcggcctccgacgtctacaggtcatggagaagtatgacctggacttcaatgtctccctgaattgaccccagcaaggtacatcatcgacttgaacaggatgactgaccttgatac

SEQ ID NO: 531829 - DNA, 250 bp, Homo sapiens
ggggggcccaacagggggccccccccaaaaaaaaaagggggccctggagtttttggcccccccgtgttagaacatgggcaaatccccaaactttttccaactgtttggcatgccccctctggggggccgggccctggaaggggggcttaaaaaggcccccgccccttgggcccccccccccatggtttcccttttatccccgtttttttggcccccccgcttttcccaaaaaggggttttttttccccca

SEQ ID NO: 531830 - DNA, 293 bp, Homo sapiens
  misc_feature (34)..(34): n is a, c, g, or t
atcacacaagtcattgccttcatatggacgtccnttgaacctgtggttgtgttggtcagctgtggccagaaagtgaaccataaacagtaaatcacaagaggcctgtaaggaaaggcccagataggtcatcttcacgtctggctggcacttaaacttggccttttcccataaaaactgttgagagaaaaatagcaatgttatgctagtagccctaaagcacgaaagatgtccaaatccatgccttgctactccacagttacctttatgaaaagtattttcttatagccaaatat

SEQ ID NO: 531831 - DNA, 489 bp, Homo sapiens
cgtacacagcaagactgaagagacagagtagtgcccacattctggaatcttatagagggttatgcccaattcttacatttatttatttgcttttaattttaaattcaagaggtatatgtgcaggtttattacatgggtataatacctgatgctaaagtttgagcttctaatgatcccataaaccaagtagtgaacatagtacccttgctccctctgtctctccctccttttggaatccccagtgtctatttttcccatctttgtgtccaagtgtacccaatgtttagctcccacttaaaagtaagaacatgtggtatttggttttgtttctgcattaatttacttaggataatggcctccagatgcatctacgttactgcaaagggcatgaatacattcttctctgtggctgcattgtgaacctggtggatattcaccacattttttttagtccagtctaccgctgatgggcacctaggttgattccat

SEQ ID NO: 531832 - DNA, 527 bp, Homo sapiens
  misc_feature (155)..(155): n is a, c, g, or t
tttctcaagggcgtgtttgttctccgggggtcaccccgcgggcccgaggacacacacccgcccttttttcgggtgtgtccgggggtgtgcgcccctcttcgtgtttttttccgcgcccctaagggaaaaaagggtttattttgggtggggttttnaaagggttagccctttcccccccccccccccccccgggggttttttttaggggcggccctgggttaaaccgggggggttcccccccccctagggtaaaaaaaaaaatttttttgggggcccccccctttttttttcccctggaggcccccccccctaggaccccccccccttttttttggcccccgcgggcgggggttttttttttcccccaattttggggggggtttttaggcccccccaaagggggtttgtttgccaaatcccccccttttttggcccggaatttttttttccccaaaagaggtttttccccccggggggtttgggggggctggcccaattttggggggggcctttgggccgggtaaacc

SEQ ID NO: 531833 - DNA, 394 bp, Homo sapiens
cattccatcccttcaaagatggagtttgatctacctcacccccccctgttccaagacaatggatgaggatattgtgattcagcaggccgatgagatccgcttaaaaattgtggggacccgtgtggacaaaaatgacatttttgctattggctccctgatggacgattacttggggcttgtaaactgagcctggtggcctcccacccttggtcctactctaggaagggtgattgtcccccttatcatgttgtccaaaggtccagtttggctgctgttgtggaggcaaggaaggcaactcatccccaaaggcatttggtgctttttgtagcttaactactgcccccccctttttcagtatgtgttttaagtataaaaagtccttggttttcatgga

SEQ ID NO: 531834 - DNA, 344 bp, Homo sapiens
aatgggcttccccccctggggtttcccccgctcccccgagaatgccccaggggccgggccctgggcagggttttttgtagaacccccgggggttcggccccgaccccagggtcttgccctgagcctaaagcagggagtcccgaacttttgccttccccggcccccccccccattgttataacccaaggccccctgttttgttttttccctttaatccacctgctattttgttttcccccccttttggctttagccccggggtgagccggggatccctgccgtcatgttcccgggctaggtacgttttttttttttcccctgaaaataaatgcctaagggtttga

SEQ ID NO: 531835 - DNA, 1478 bp, Homo sapiens
  misc_feature (749)..(749): n is a, c, g, or t
cttcagtatgatggtgccgctacgtagttttgctgcccccctcctcgcctcgtgctggttatgtgcctagcctactttggtgagtgttttctccagactcaggacaccaacgagtggccacccactgttggttttgccgccccaccactcaacgcatatcactacacagtgtgcttttggtgtgcgcggccccagttgtgtggggggcggcccagggagagggtccgtgtactcgcatcgtggccctcccctcctcttgggccctttgggggggggtttttcccccccccccccccgttggtaaggtggtttcccgcaacgttctggcgcccgcgggggggaaagaacaaactgtagggtgggtgggtttctccgccgcttgtggtcgcgcgtcttcctcacgaaagagggggccccaactatggtagataggaacattttgtgggggttgtggagcaccttctgtggatacgggaatcacccctctggttgccacacacgacgcgacagtgtgttgtatagatgcccacgtgccaccaacatcgtgtagaggtagtatcagacgatgtgagcatattgggcgaggaagaaaaaaaatgtttgttttgtgggggacccgccgccgttgtgtgtcccccccggatgagcgcgctttgaaccacaaaaaggttctcgccacggcccaacatgtgcttgggcttttatggggaaaagaagatccccactgcgaaaaagagggtttccacgcntgtagaggggagccgcttatcgctcctttgtcaaaccgtatgacacgccacaggtgcgtctcatagtgagacctcgcacatcacgccacatggggagagacactgtctgtgtcaacagacacacatgtgttgtgagagcctgtgagatcttggcccccacacttgtgtgtcacacctctcacattctacatctacgcccacaatattgagtgccacgatcaaatcgagagaggagagctctgagtgcgggcccctctcccctcgggagaccacagcccacagacactcacagagacacagtggggtgagagatgtcacacccgccacactctgagagccctcaccacttggcccaacagcacagagacccctcgggcttctggcacagcctgtgccgcacagaatagtctgggggcacagccctcggtgtgaagagaccacaccgagacacggggtgtttgtagaccacacacatagcacgggcacacctacacgggggcataacatttccgagagccacgaaggaacggctatccgcacaaaaacgagggctaacaatgcgccgccggtggctatcccccacgcaagcacagtttcaagacggcctatctgaggctttccaccttctgttttccccctgggccatccaaccttgaagtcctataaccacacctcagtcaataaaggtctgtttaaagattgtttctggttgattgcttgttgccacca

SEQ ID NO: 531836 - DNA, 311 bp, Homo sapiens
tttatgacataggcagactcataacactatctgttgattgcaaaatctacaaattccatgtaagtccaatgaaactactaccaggcttttacctggcacctgatggttgaataaacaatttatatggcagagtacaggcacaagacaagttcacgtgcttatggatggataagaagagcaggaagaattgagatacaaatggtgcaggcttatacaaaacatcagtgaatgaggcagtgtggcgccagcacagggatacacaaacagcatccgggaggcagactggagataccagtccacagcttaccttt

SEQ ID NO: 531837 - DNA, 890 bp, Homo sapiens
cgcggtggctcatgcctgtaatcccagcactttgggaggctgagacaggcggatcacttgaggtcaggagttcgagaccagcctggccaacatggtgaaaccctgtctctaccaaaaattacaaaaattagccgggtgtggtggtgcatgcctgtaatcctagctaccggggagctaaggtagaagaatcacctgaacccaggaggtggaggctgcagtgagctgagatcacaccactgcactccagcctggtgacagagaccctgtttcaacaaaaagaaatcctacagctggtacattattatcatcattcataatacagggccaatgttttccaatgtgtgttcctttgaacactgaacgagtactcaggcaggcaaatgggaggagactccctttcaacattcatccattcagtcagatttactgactgtctccggctctgttgccaggaacagggaatagcatgggtaatgtctttctttgtggaagttataacgcccatggacagagacagaaaagtgccccacacatagacaatttcagatcatagctggcgggaggacggtgatcctgatggtgctgtccatagatgggtgctccaacgacggcagccaagcttcaaagcctgagggaggcccacttcggagtgtgcgacgactggtggggtcgggtggagctctccggcgagagataggaggggactcacaggtggacctctcaggatcaaggctaaggcactttaaaccgccacgcacatgtcgcagagctgggcgaacgtcgaccctggtgcgcacgtggcgctagaacgacaggcgcagtcgcgcaacggcccaggggtggcccccccaggacacaaccgtggagcgcgacgagacgcgcgcagcacc

SEQ ID NO: 531838 - DNA, 260 bp, Homo sapiens
aagatacattcaacatgaaggggaaatagatatttttagacaaaagctgagagaatttttttcttgaatatttgcactaaaagataggttaaaattcttcaggctgaagagagcataccaggtggagatttggatctacaaaaaggaaggaagatttggaaatggatttggcaccattgactcaatttccagaacaagaaagcagggacagttttgggaagctcaagacacactgcccatgagcagcaatttggacctcc

SEQ ID NO: 531839 - DNA, 179 bp, Homo sapiens
ttacattatcgctaggatgaggatagactagtaatagggcaaggacacctcctagttcgttagggacggatcggagaattgtgtagagcgaatagcgaacatatcattcggcgcttagatgtggcgcgagggagtgtttacagggagttggctagcggtatacacttgtctgggctcgc

SEQ ID NO: 531840 - DNA, 1144 bp, Homo sapiens
caggcagctcgaggacccgcggacccgccccggctcggccgtggacagactagcagacggcagcgaggcctgtgaccggggtgggcatgttgcatgtaaccagtggaccagggtgatgtatacgtgtgtgacatgtgcacctgtgagggcgggccccgcagggtgaaccatgctgcatgtggctgtcgggcatcgggtctactccttcgggggttactgctctgtgtgaagactatgagacactgcgtcagatagatgtgcacattattcaatgcagtgtccttgacgtatggacaaagctgacccccggtgaagtctgccatccgtgggcaagctccatgtggtaccctacatgcgctatggacacatcaaccgatcctcatcgacgacacagatcctccatttggggcgggcggaatgacaccgaaggggcctgcaatgtgcatctatgccttagacgtcaatacgcacaagtggttcacaccccgagatgtccagggacagtatacctggggcccgggaatggacattcagcctgtgtcctaggaaagatcatgtacaatataaggcgggctacgagcagacagtgcggacatgtaagtaccaatgacatacacaagctagctcccagcaaccatgacacatggacctcttatctgtacacacgggcagcctgaccgctggagggacttcactacagaccacaatcctgggacaggtcaatggtatgtacaggaggacgtgccgaaccggaaggagccaatccactaacaacaatgagattactggcaccgaatccgagcactgaccaccgaactgcagatggcatggactggccccgaatcagatgctgactgaacggcagccgggaccccaccggaccatgaggctccccagcgggcaacaggacaacaagcaggggacacaaagtgacaggagtaacgagacatccctgaccccggggccatacacgggaggacaacggagaaacagtgaccaactgggtagggaaagacagacacgagacgacgacgattgcagcacaacctccgcctagtgacaccacaccgagaccagagaaacacctaaaactacacgaaaacgccacacccaaacgcaagccacatacaccagacaagcaaca

SEQ ID NO: 531841 - DNA, 336 bp, Homo sapiens
  misc_feature (150)..(150): n is a, c, g, or t
  misc_feature (186)..(186): n is a, c, g, or t
  misc_feature (247)..(247): n is a, c, g, or t
  misc_feature (275)..(275): n is a, c, g, or t
ttgtagttagtctattgtcttttaaatgcaggtacttctgaccttgtttttagaaaatggttgcgcttgtaaatctggcaatagttatcatcagtgggcacttccatctttcccatagtttatacttattttgtgtcctgcctagtaatntgtttcgtcttcctatagtaacctaaagaagtagcnttgcaaattttaagaatcttttacaagtgtgggttcttgtgcgtgtttctacatcttctgnggcaggtttttgcattttatacagccangaagcgtttctctttattgggagaaagcggaaaagagccaatagaacaaagtacaaaccgg

SEQ ID NO: 531842 - DNA, 771 bp, Homo sapiens
aataaaataggaacaaggagtaaacgaaattcgtcgagagaatcctgcgaggggaaggtcacatttacttacgccttccggcactgccccgtgcccttcggacgcagcgccttggcgtgcgtcgaggtcgtccgattcctatcggtccgtggtgtgaagcacgacctccctccggcgcgtgcgctgtccgtgagtaacgagctctagaatacgccagcggatgcgggccggcaactcaagcaagatctagcctacctgtgcgcccccaaccgtcacctggcagagcactcaccctactatgaggccatgacagaatgaaagacacagaggttctcttctgctttgagcagtttgatgagctcaccctgtgcaccttcgtgagtttgacaagaagaagctgatctctgtggagacggacatagtcgtggatcactacaaggaggagaaggtttgaggacaggtacccagcacgcgagtgcctatcatgagaaggagacggaggagctcatggcctggatgagaaatgtgctggggtcgccgtgtaccaagcgtagaaggttgaccctccgactggacacccaccctgaacatggtcaccgtgctggagatgggggctgccgacacttcctgcgcatgcagaagttgacaagaaccaggaggagctggcaagatctgaagaccacgctggagataaagccaggaagcggctcatcaagaagctgaatcagttgcgccaagcgaacctgacctgaatcagatgtgggatacaaa

SEQ ID NO: 531843 - DNA, 197 bp, Homo sapiens
cttttatgtattctgtaggcacatttgcaaaacagctcctctagtcacataggtaactgtttttgagacaagttctggctctgtcacgcaggctagagtgcagtggtgtgatatgagctcaccgtagcctcgacctcctgggctcaggcgatcctcccacctcggcttccccaactagctgtgactacaggcacgtg

SEQ ID NO: 531844 - DNA, 187 bp, Homo sapiens
gacattccggagtgccggcgtgtggccgcattatatgacattctggtgtgccggcgtgtggccgcgttatatgacattccacgttatgtgacattccggtgtgctggcgtgcggccacgttatatgacattccgcgttatatgacattccacgttatgtgacattccggtgtgctggcgtcggtcgc

SEQ ID NO: 531845 - DNA, 390 bp, Homo sapiens
tgagatggagtttcactcttgttgcccgggctggagtgcaatggcacatgcttggctcactgaaacctccgtctcctgggttcaagcgattttcctgcttcagcctccccagtagctgggattacaggtgtccgcttacacgcccagctagaactttattttcttaatctgttaggttttttcttcattatttccttagtagtgtacctaagttaagatagtgtttttagatctcactgttttacagcattctgactgcactggagtttcatttgagccattactattaatttattaacattcagtacgcgctatctgtattatacaatgtaagtgagttttatctaccagaagaatgtctcttaaccatctcccttctgtcgtcttctc

SEQ ID NO: 531846 - DNA, 580 bp, Homo sapiens
agaactttattccttttatggggctgaatgatatccattgggtggatgtgccacattttttttgtttgttttgttttgagatggagtcttgctcctgttgccaggctggagtgtagtggcatgatcttggctcactgcaacctctgccccctgggttcaagtgattctcctgcctcagcctcccaagtagctgggactacaggcatgcaccaccacacccaggtaatttttgtatttttagtagagacgggttttcaccatgttggccaggatggtctcgatctcttgaccttgtgatctgcccacctcggcctccggaagtgttgggattacaggcgtgagccaccgcacccagcctcactgtgattttgatctggatttccttaatgactaatgatgttgcccatcttttcttgtgcttgttggtcatttatagatcttcattgcagaaatgtctattcaagtcctttgaccattttaaaattgggttgtttatcttttggtgtcgagttttagagattccttctatattctggatatcaaattagatatgactcacagatttttctccatatatttt

SEQ ID NO: 531847 - DNA, 219 bp, Homo sapiens
tcgtgccgaattcggcacgagcagacactgaagcacccaggggctaggtaacaccgaaggcaacacatctgtcaagtgattgactgggagccagggtgggatggtgtgcctgcaaagtacttattgataactccctgatggcaaccaagggaaggctataaggattgtataacaggacgctatggggttggaaatgctcggcgagcctgtactagagca

SEQ ID NO: 531848 - DNA, 335 bp, Homo sapiens
gactctatgtaggatcccccccagaaagactactccagaggttttggcggcaagtttggcgtgcagtccgaccgacaagacaagagcgcccttggctgggactaccaggacaagacgcagatgcaccactcacaaagagattactccactggtttcggcggcaaatacggtatccacacggacaaacaggataaaaacgccgttgtcttcgagtatcaaggcaaaacggacaagctcgagtcccacaaagactatgtgaacggccttggcgtaaaatttgacgtgcagacagacagacacgacaaatgtgcccttgcttggaatcaccaggagaa

SEQ ID NO: 531849 - DNA, 304 bp, Homo sapiens
gtggcgcctgccatgcttgggctacccaaagctgggtggaccagacgctgcgtaatcccaaagagtgcagcggaggggacgtccagaacttcgggtagaacgccagcatgcctcagtgctgccctgctcctgtgacccctcaggacagtgtggctccagcccacagatgctgcaggtgttcagtctcaggggccgggtctcaaagtggtcacagcgagcaccaatgccaggtggctccagcagctggtcgatgccataggccaggccaccctcaaagggcaagtgccgctgcacaatgcgagcc

SEQ ID NO: 531850 - DNA, 266 bp, Homo sapiens
  misc_feature (230)..(230): n is a, c, g, or t
agcctgcacctattgggtgaaggagtgatagcttgggtcatgttcgctgatgtctccttggccaagtcagtgtgggttggggctaactaatggtatgaatactggggaggcatgaattattaggggccattagtgtagcattttatacctagaatgttcattaacggtaaactagtatttttctattttttctacctcacttttcagtttggaggagtttcagtctgacnatatcttcataggtcactatattctttcacttggcc

SEQ ID NO: 531851 - DNA, 479 bp, Homo sapiens
  misc_feature (343)..(343): n is a, c, g, or t
  misc_feature (393)..(393): n is a, c, g, or t
  misc_feature (406)..(406): n is a, c, g, or t
  misc_feature (439)..(439): n is a, c, g, or t
atgatagtgcatgctgtaatcccagtgcgtgggagattgaggcaggattgctgtaggttcaaggccagtcagggctgtgtatcaaaacatctccaaagaacaaaatattgagggtaagtaattccatggagttttacggggttttaaatgctgattgtaggaagggttacatcactttgtagcatcagggtcacatcaagctataaccttgaagcgttctatttccagcctttgcatacagtcacttatgctgtgtattttatagtatttaagataatagggatggcattggaaaggaaattactttcatgggcaatatttaaagttttgaaatatataaggntaaaaacaaacaaacaggatatccattttaaaagccgaagaattgaaccngatttataatgcnactttttaaaacttgaatgtgttgtttgttgcnagtggccgaagaaggggctggccttactcctctgcatatt

SEQ ID NO: 531852 - DNA, 404 bp, Homo sapiens
aacagtatgacaattcctcaacaaattaaacatggctggacatagtggctcacgcctgtagtcccagcactttgggagaccgagacgatggactgcttgagccaggagttcaaggccagcctgggcaacataaggagaccccatctctacaaaaaagaaaaaaaaaagtagccaggcgttgtggcacatgcctgtggtcccagctactcaggaggctgaagtgggtagatcacttgaggtcaggagttcgagaccagcctggccaaaatggtgaagccatgtctctattaaaaatacaaaaattagctaggtgtggtggcgcatgcctgtaatcccagctacttgggaggttgaggcataagaattgcttgaaccctggaggcgaaggttgcagtgagctgaga

SEQ ID NO: 531853 - DNA, 183 bp, Homo sapiens
aagggacccttgcctttgataacccttttttggggccgtttttcctcccctgggggggaaaccccggggccgtttttttgttaattaattttttttaggttgggccccgcccttttggggtttatttttggttgttggggtttttggcctttttttaaaaaaaaaaaaagggtccctttttta

SEQ ID NO: 531854 - DNA, 157 bp, Homo sapiens
agcacgtaagacttagattagctagtaggtagggtggctaggcaggcagcgagttacagacagagagcatcagagctgagcctaggaggagttggtaggcatagctgactagagtacagagtactacctactatggaggacagagaatcgaggtatt

SEQ ID NO: 531855 - DNA, 299 bp, Homo sapiens
  misc_feature (242)..(242): n is a, c, g, or t
tgtgaaggagcagtgtcgcagcgtctcaggagtcacagagctcgattggtctgtctccagcagcatgctctccagatgcagctgctgtcgctctccacatagggctggtgcagcacatggacaggtagctcatgggtgaggtcgggatccccggtgtgggcaagctccttgtgccaccgtgcgcttcaggagcagctccttcctgtacatctccaatgagcttatgctgaaaccctcatagnaaatgggttgtacggccacgctgtaggaacagtagcggggtctgtttaaactctcct

SEQ ID NO: 531856 - DNA, 431 bp, Homo sapiens
tatattattactttaaattttcattaactattattcttttatttttatcatatatacaaataacattcctaagattatttcttacataccaacattttttacatccctttccattatttataaatacttttataattcattaattatttaataatataattatctatctattacattttcatttattttattttttttaaaatctcattattatcttcacattaaatttttatttaaacttaataaacttttattatcttattaattattcctaacatttattccctttaacatataacttctttatccctttcctaaacctattctaactttttatcattggagggtggggggtccttttttaaaaatacaaccccctccactttctataaccttttgctttgaaaaattaaaaatcctctcccaaaatt

SEQ ID NO: 531857 - DNA, 537 bp, Homo sapiens
  misc_feature (49)..(49): n is a, c, g, or t
  misc_feature (62)..(62): n is a, c, g, or t
  misc_feature (65)..(65): n is a, c, g, or t
  misc_feature (101)..(101): n is a, c, g, or t
  misc_feature (116)..(116): n is a, c, g, or t
  misc_feature (136)..(137): n is a, c, g, or t
  misc_feature (142)..(142): n is a, c, g, or t
  misc_feature (145)..(145): n is a, c, g, or t
  misc_feature (158)..(158): n is a, c, g, or t
  misc_feature (202)..(202): n is a, c, g, or t
  misc_feature (205)..(206): n is a, c, g, or t
  misc_feature (208)..(208): n is a, c, g, or t
  misc_feature (225)..(225): n is a, c, g, or t
  misc_feature (249)..(249): n is a, c, g, or t
  misc_feature (266)..(266): n is a, c, g, or t
  misc_feature (268)..(269): n is a, c, g, or t
  misc_feature (273)..(273): n is a, c, g, or t
  misc_feature (314)..(314): n is a, c, g, or t
  misc_feature (317)..(317): n is a, c, g, or t
  misc_feature (328)..(328): n is a, c, g, or t
  misc_feature (334)..(335): n is a, c, g, or t
  misc_feature (337)..(337): n is a, c, g, or t
  misc_feature (341)..(342): n is a, c, g, or t
  misc_feature (344)..(344): n is a, c, g, or t
  misc_feature (349)..(349): n is a, c, g, or t
  misc_feature (361)..(362): n is a, c, g, or t
  misc_feature (371)..(371): n is a, c, g, or t
  misc_feature (390)..(390): n is a, c, g, or t
  misc_feature (394)..(394): n is a, c, g, or t
  misc_feature (396)..(396): n is a, c, g, or t
  misc_feature (405)..(405): n is a, c, g, or t
  misc_feature (417)..(417): n is a, c, g, or t
  misc_feature (422)..(422): n is a, c, g, or t
  misc_feature (457)..(458): n is a, c, g, or t
  misc_feature (486)..(486): n is a, c, g, or t
tttttaattcagtaaaagaaaccgggtcttagaagcggcggtggtctangcggcggcgggtntgngcattcattttttttgtttttgtttaaatatgtttnaattatcacactgcnggcactcctcatttgcatgnnattcngcnccatacttactanttgtggtaaagttaccccccaacccacgaaaaaaaacctactcnggnngnaaattttcactgaaatntaaccaaacttctttaagggggtnggggcagggttttaaangnnttgnaaaataacattttaaaattgggccatcaactttaagtaaanggnttgcctatacnaatttnngnaatnntnaaaanataatatattcnnccccctttngggccccggaattaaagcntaangntcagggggnaaaagggaaagnatgcnactgggttctagggcgggccatcttgccaggggtnnttaagggggggggggtatataagggaangggccgaatttcctagggccaacaagataacagtctatttttttcacttac

SEQ ID NO: 531858 - DNA, 121 bp, Homo sapiens
tgatctagaggatccgttaactgggttcgagttctggaatgtagaagtatgaggctgctggggagtctgcgaggaaattgatttctagcaaaatcttgtgtgataatttgggagatgtgat

SEQ ID NO: 531859 - DNA, 333 bp, Homo sapiens
ccaagggtcccgggttctcccccagaaatgaggggggattctgtaaaaaacccccggtttcccgatggggaggtttggaagaaaccccttccggctcaagaaaattagggggcccgccccccccccttttttttttttgaagggaaagggcttaaaatttttggggaatggttttccaaaaaggggtttaaaaaatccccccggccaagatgggttcgggtagaagtcatcccccccccgggaatcaggtagggaattattccttgttttttttagcaaaccaaggccggttttcccccttaacccttaaataaaaaattttttttttaaata

SEQ ID NO: 531860 - DNA, 562 bp, Homo sapiens
  misc_feature (79)..(79): n is a, c, g, or t
  misc_feature (81)..(81): n is a, c, g, or t
  misc_feature (86)..(86): n is a, c, g, or t
  misc_feature (93)..(93): n is a, c, g, or t
ctccctggacagtgttctcaaagtggtccttgaaccaacaccggtaagttccctggaacttatcaaaatgcaaggtctnangcccnacccccngaccctctgaatcagaaactctgagggtggagccaggaagctgtgtttgaacaagccctccaaaagacactgatgcatgctgaagttagctgctgctttagagaaactgttaatgagtttggggaaataagagatacatacatgaaatggctggaggagactcaagcattatgcatgacatttagtgaacgtaaaagacggagtctagacaactttatttccataatattaacaaaggacaatcctctcttaaaattcctggggtcagatgaatttctaaattcagattttgtttttcaatttagaaaggtaaaatgtgcatgtaccatatattacataatacctttggtaaggtctggggtgacactctaatatactaattttctgcaagggaaatcatgaatgacataagtgtatgcttggattatctactgcaatgtaataaatgttcccaaaataaaaaaaaaaa

SEQ ID NO: 531861 - DNA, 375 bp, Homo sapiens
tccttccgtggtcccagtgaccaaggctggggctgctccctcagccaggtccgccctctctctctgtagtgttgttttgttatagattaggggtcttgttatgttgcccaggctggtctcaaacccctggacttaagcaatcctcctgcctcagccttccaaaatgctgggattacagacgtcagccattgcacccagccttctctagcattttctttcacacagcagcggtgaccttgtgtcaggaggctttggggcacctgcgcctctcacttctgcatctcacactccctctgttgatctagtgtgtgtgtggccttgcgtctgtcacgcagatcagatccaagagtagtttgggtatggctgggaggggga

SEQ ID NO: 531862 - DNA, 565 bp, Homo sapiens
  misc_feature (2)..(2): n is a, c, g, or t
  misc_feature (158)..(158): n is a, c, g, or t
  misc_feature (535)..(535): n is a, c, g, or t
angggtagagcatgagagattatcaagagaagaaaaagggagctcggagctccgtaaggtagtgagacggagtcaccagggacaggacagccatgtaattagggtgaagacacagcgttgatatgaacactttgaaaactagcaggttcgaggcgggngggaagcgagttacagaagaggagccgtggtgagggcaggtgagggcgggcaacggcgaggcagggctgggactgggtccggaggttgagctgtctctgctccactgggctgcgggactgacgcctcctgaggctgcgaatggggcgggggaaggactcaaactccttctatttttctggacagggagagagtggcagcagcagatcaaaccccggagcccctgccctgggtgggtgccagcttccctgagacattccgtgcctgtgacattgctgtgtgcagagatgaacgagacgggaaaagccactgcaccctgaagaactacaatatggtgggggtggcagatgccaatcaatgacacagatacctatttaantaacaggtctaaggcgtttcattctacgca

SEQ ID NO: 531863 - DNA, 338 bp, Homo sapiens
  misc_feature (108)..(108): n is a, c, g, or t
  misc_feature (110)..(110): n is a, c, g, or t
  misc_feature (308)..(308): n is a, c, g, or t
gcccaggtgccgcgtgccgggacgacgagcgcgggcagcagagatggcccaggtggcaacagagatggcccaggtggcaacagagacggcccaggtggcaacagagangncccagggagagagtggcagcagcagatcaaaccccggagcccctgccctgggtgggtgccagcttccctgagacattccgtgcctgtgacattgctgtgtgcagagatgaacgagacgggaaaagccactgcaccctgaagaactacaatatggtgggggtggcagatgccaatcaatgacacagatacctatttaantaacaggtctaaggcgtttcattctacgca

SEQ ID NO: 531864 - DNA, 503 bp, Homo sapiens
tgcttccatatcttagctgttgtgaataatgctgcagtgaacgtggtggtacagatacctctttgacacactgacttcagttcctttagctatatgtccagaagtgggattgctggatcatatggtaattctatttttagttttctgtctccatgctgattttaatactggctgttttaatttacattcccaacgtcagtgcacaagtgttcccttttttctacaccctgtcaacacttttatcattttgataatagtaattctaacaggtgtaaggtgataccttgtgttaatttgcatttttctgattagtgatgatgagcatcttttcatatatttgtggccattgtgtcttttttaggaatatctgtttacatcctttgcccatgttttaattgagttcattttcttattagtggcttcagtaccttatgtatttggatattagccccttatcagatgtatgatttataaatatttcttcgaattcaaaaaaaaaaaca

SEQ ID NO: 531865 - DNA, 289 bp, Homo sapiens
ttaaatgggcacgaaatttcactttccttagctgcatacagagcttggcaatgtaatactcgtaattctgtaagtatcaaatatactttccataccagaatttctaagagtgtcttcaggttattagcgaaaagcttctatgttcatatctagacttattctaccagacgtagctactaaagtacagacagtatgtccctaccaggtctatatgtatccgaatatatctacttacctagtagtataactagagatacaaagaataccctactatttactatagtaagta

SEQ ID NO: 531866 - DNA, 382 bp, Homo sapiens
tggcgacctgagcctgcggagagacgtggactgtcagctcttccgagtaccatgtgtgcaagagtgaggagtgtgtgaacacgggcacgggctactcatgctattgaagcaacgggtactactaccacacgcagcggatgcagtgcatgagatatgacagagtgcgccgatgaggaaccgccctgttaaggcggccgctgcggcatcactgtagcctattatcactggacctgcgagagctcactgatgctggatggctcgaagagccgcatgcgatcttacgagagcacagagctctagatgaccctatggaagtgtgctgacctgatgtgtaggctgaccttttgtgcaggcacccattggtggaccgttaggtcttgcc

SEQ ID NO: 531867 - DNA, 245 bp, Homo sapiens
  misc_feature (8)..(8): n is a, c, g, or t
atccttangagctcgtcaatccacatcacagcagcgataacagctccagtgatcacagctccaaagagaaccaggccagcaatgatgcccacgatggggatggggggcggggaagacggctcccatctcagggtgaggggcttgggcaaaccctcatgctgcacatggcaggtgtatctctgctcctgtccagaaggcaccaccacagccgcccacttcgggaaggttccatccccggcaggccg

SEQ ID NO: 531868 - DNA, 1100 bp, Homo sapiens
agtgtttcggggtcgctgtcgtctgctggttgcctcttatgtgtttccttttcctctttgttgcctctgtctgggtttttccgtgtttcaccctgtgtcccgtgcttgctgttctctctctatcttttacattgctcgctttgtggtccctacatggcgcttcctgactccccggtctctgttcttattgtcttcatattgtctcttttgcattctcattgcttctttcaatcgatccttctgagtctgatgcgttgttgtgggtagattctttttcgacgctcgttatctgccttttgccgctgtctcccagtcataaacgcttatgttctctgtgtatatgtacgttagggtccttgtttgagtttattgggtatatactgtgaacaatcgttcgatatttagcatacgccttcgtatgcttgttgtgggcttgtgaatactgaagactgcttgaggttcggtcgattgcatgctgctctttggtcattcatcaaatgtaatgatcagtcaattggttatagttggtctcataaggatatcagtcttttgtcatgccttctatacttgatcatgccctgtatagtattctgtcatcctctcaagttagatggctgataacctcatgtatgctcttacttatgaggcttttttgtttttgttcctgatgctcctttgctacgattatactgaatgcctcaggttcagccaggccctactcaccatgtccaggtattctacccagtgaaaacatagaaatcacccttccacagtgatggcctttgggttcttgagagtttccttatgcatatgtgcactgagagaggaccttgtttccccccctaaggcaataatgtgacagttaatgagctatcaatggtgctctcgtggggttcttaaggcagtaacactagaagctgtgttaccagccagttcaatcctatactcgagctggtttttgtctttgtggtattagtggcatgtgtttttggtactgtgtttactgtgttttccccaatccaaaatgtgattcttggttacacggagttcagtatatggaaactaatttgttctactttttcataactcctggatctatt

SEQ ID NO: 531869 - DNA, 324 bp, Homo sapiens
ccgcttattggggcctttgctgaggaaccacccttcttcttcccacattggctacactactttacattctcaccagcggtgcatagggttctaattgctccacacccttgccaacactcgttttctgtttttttttttttttgggaaatacccatccgggggggtataaagggatttctaatggaggtttggattggaaaaagcaatattccggtggttttttggaggctcggggtcccacaggggcccacagggttggttgggcacagaacctgtgcctttaagtaaggccaacatttcccacccaagcaaagacccaaaagg

SEQ ID NO: 531870 - DNA, 927 bp, Homo sapiens
aggacatgcgtaagggggacgcggcccagatagggctgtgaacgatggtcataaggcggtcacctagtagattttgtgtacttagtttatgccgtccgcatagtataagggatctattcactgctcgggggcagatgcgatgccccgcggaataacatcgatgaggaaaggtgggggaggttcaatttgttgaggagcaactaagggatcatacgtcagcacggtcaggccaaagagtctcgaatagtaagtgcacgggggcgtgaatcagggctcacatgcatggctttgagcttgccaagtgctcagagactgcggttcaacaatggttgcccaagtcgcttgttctcaagactcgcgtgagccatcaaggtagaatccgccgatgaaatggggtactttcgaaaagtgctcgtggacaggtatgatgtgaggctcaccgtatctggaccggagaaggaccctgttatcggacgcgtaaaaaagaacttgcaaatgatatggtgctgcctttcaagggagtcgcgaaggagccctagaagagttggcacgcgagttaggctcccttatgcacgcgggtagattggacttgatgttgagattgcatttgcccagggcatgagacctagcttgaaacgaagctagatgttgcggacgcatcgatgctaatatgatacagtgcttgcgagatgggacacctcctggtgccggtaacaccatatggagaataacggcccacctgattctacagggcttaacgggagaatgagcggaacgctaccaagcaggaataagggcgggttgagacccactggggacgtgacaaacgtacagtatggtgttgaaagggggctaatgagggtgccccgggactaaggaagtgtgaaaaccgtactttaagctctgatgagcccggagacatggagg

SEQ ID NO: 531871 - DNA, 398 bp, Homo sapiens
gcaggcgaccttcaggccctggcggtgctcgatggtatgaacaaaatgactcgcttctaggagcgactcgtgggtcccagtatccagccaggcaaaaccacgctcttagcatttcgacggtcaacgacttgtcatccagataagcacggttgacgtcagtaatttccaactcgccgcgcggggatggcttgatgcttttggcaatgtccacaactcgattgtcgtagaaatacaagcctgttactgcgtagttggactttggcttcactggcttttcttcaatgctcagtgcgcggccggtggcgtcgaactcgacaacgccaaaacgctcaggatctgatacatggtagccaaagactgtcgctccggatgtctgggacatggccgagcgcaagttg

SEQ ID NO: 531872 - DNA, 479 bp, Homo sapiens
  misc_feature (462)..(462): n is a, c, g, or t
gggacatgtgagggctagtgcatgctgctgagcccagacccctcacacagcgctaccggcaacttgcttaacctagaggtggggggtgacgtccctgtcggccccgtcacctggggcccagcacctctccttggctttgcagacgatgttccacaggagcccgtgcccacgctgtggaacgagccggccgagctgccgtcgggagaaggccccgtggagagcaccagccccggccgggagcccgtggacaccggtcccccagcccccaccgtcgcgccaggacccgaggacagcaccgcgcaggagcggctggaccagggcggcgggtcgctggggcccggcgctatcgcggccatcgtgattcgccgccctgctggccaccttgcgtggtgctggcgctcgtggtcgtcgcgctgagaaagttttctgcctcctgaagcgaatataagtggtcgcccggcncggcgcgactcggctgc

SEQ ID NO: 531873 - DNA, 165 bp, Homo sapiens
  misc_feature (3)..(3): n is a, c, g, or t
ggntggtgtgggtagagggtactacagatgcaaatcacccttctgcagaaagctctttggcaccggtgcacttacaatttggtattacctgggagtgagaagaaatattacagcatgcctaagtgacttcttgaggtcagaatggcggcggtggagcatcgtcat

SEQ ID NO: 531874 - DNA, 366 bp, Homo sapiens
tccgaattgtgcttcactggacaagaatacggtggcaatgaatatacctcctatacttcataaactgctatactcaaacgggccagagtcggaagaaccacctattttgaacacaataggttcttcttcccagacaggattcacagcatttccttgggatgttttggtacttaaatgccttcctccttgtatccacaggcaaaccaaacatatctacttccacgtaagtcccaactttcttatcagaaagaaactgacctgaaataatcttaacagacaaagtgtttgccactatcccatctacgatgccttcagtaaatggatcaaaatgcttgtcaggcctcctcatgaactctggcttcaatc

SEQ ID NO: 531875 - DNA, 260 bp, Homo sapiens
ccgcctccccaggttcaagcgattctcctgcctcagcctcctgagtagctgggattacaggcatgcgccaccatgcctggctaattttgtacttttagtagagacgggggtttctccatgttggtcaggctggtctcgaactcccgacatcaagtgatccgcccgcctcagcctcccaaagtgctgggattacaggtgtgagctaccgcgccctgcctgttttgcttttttatcaaaacattttattgtggtaaaatata

SEQ ID NO: 531876 - DNA, 869 bp, Homo sapiens
  misc_feature (169)..(169): n is a, c, g, or t
gggccaggcagtgtttaagtgataagaattagtgatgaagatctaaagggatattttgcaccaaaatccaggtttctgcatctcttgaaaaatccaaagatttcgcaagttcacctaggctctcagaaagtcgcagttgtgggagttgggccggagccagaactcccanattactgtgtgtccgggccactcatcccatcatgtcctgaccaagcatgagtagccattcatcatggcttgcttaagtgttaggtgtactcttaaaacgtacacgcaaacgaagaacagggaagtattcttgaacccatgtctggtgtcacaaaaaggtccttgaattctttccctgtcttttagagtaccgcacccatacttatgctggtcttataagtatgtcgccatcaaagggccagcaggggggctagggccaggaacacctggggtgttagattttgtagcgccaggtggcataccggtaccccatctgttattccccaaggttctacacggaattcccttccagaattcaaggagtccattaaccaggttaccactaaattccctttttgtggggaagagtgcaagccactgggaaggcccttgccctgcgctcgtgtcagagacaacaacctggccaagggaagagacaggggcctgtgaccttctgtgggcttgtgtgccttcactgttcaccaactcaggcttggtgtttgcctaccagggaggcaagagcccgacttaatcactgaaaggaggacaaagttggacaacaacatggtcggtgcagtactgatgattatgaagctttaaggcaagcgacgagattagcctagtttggagggcacggccatacaaggctggtggacgactgc

SEQ ID NO: 531877 - DNA, 831 bp, Homo sapiens
  misc_feature (42)..(42): n is a, c, g, or t
acacttcggaccccctccaccccttgaccgccgtcgcaagcncccgcgccatgtgccgacacccgcaaaggcggccattatggccaggcaccacagaagctaaccccgattttactcacgcaccaacacggaagcaaactaaccggaggacatcaccacacccgatcaaaagcagacatcagacaacgcaacagaagacgagcaaaccaaacccaggcacacagaaccggaaccgaataccgaaaaaccgaactacaaggcaacgacagcagaaaccaccgagcacgcagaccgagccaatcgcaaccaaacgatggacagcacgctaaaaacaaccgccaacgtacaacgtgacgcaaactccagcaccagaacccccatacagatccgccacctgaaacacgctgccacgactaacacccgtacccacacacacccacccaacccaaggaggccatgcccccggaaccgcccgcccgcccacaaggcccacaacacacgacctcacaccaaacaagagccccagcacccccgcgatcacaggccaccacaaacccacggtaacccacagcgctacctaccccgcacaccagacgccctaagcccgcgacacccggaacacagcaaaccacacccgcccgccgaacaaccccgaccccaaccccccacacgcctcgggcaagcccccacgccaaccaacccccccccaccaagcagccgacaccaaggcccccgcacccacgggacaacagcgcgccgcccacacagggcaccccggccgcaccaagccaaggtcccacccaactaccccgccgaccccccgcggtcagc

SEQ ID NO: 531878 - DNA, 346 bp, Homo sapiens
acatgcacacgcacacacatgctctcatcagtcacactagcacacagcacacacacaaagacacagcacacacatgcacacacagcacaggacacgcgaacacagcacacacgaacacagcacacacagcacgcacacaaacacagcacacacatgcacacagcacatgcacacacagcacacacataaacacagcacacagcacacacatgcacacagcacacacgcatgcacagcgcacatgaacacagcacacacaaacacacagcacacacatgcacacacagcacacacactcatgcgcagcccatacataaacacagctcacagcacacaaacacgcagc

SEQ ID NO: 531879 - DNA, 143 bp, Homo sapiens
  misc_feature (135)..(135): n is a, c, g, or t
gatcccccttctttcagccttcccaaaggtgctgggattatgggcattagccactaaacctggctacttttaatcttattagtatcttttgatgagcagaagttttaaattttgatgaagtctagtttatttgtnttataatt

SEQ ID NO: 531880 - DNA, 819 bp, Homo sapiens
agaacaccaactgctgaggctgcctgggaagaggatgatcctaaacaaagctctgcgtgctgggggccctcgctctgaccaccatgatgagccctgtggaggtgaaggcatgtgggatccacctctggctccctgctcctttatagagatggacaggggttgtaaaacaaaagttgaaaagtcagatagttaaaaggggaagtgaactggaaggtaccttaaactttcacaactttattaaccgtggctgctcccattatgatttgttcggcagtggaagtttcacctgcttctccagagcacttggcgtcttgttccaaatttcctttcttcaacctcacaccagagtgccctggtcaggctggctcattcattaggcacaatgtgggcagtgcaggggaccctccatactgtaaagccacatgagaaggttttaactcgttttaaaattagaaaaataatggaatattagagcccaagaaaatgttttaacttttaattcagcctagattatatggtctttataccaattcagtcataaaatataattgtccatattttgtggaggaagaggcccatacaagcaagaatgctcagggctcacatgtcagaatgcagccttggtcatgactgatcctggccttcgtatggttctgctacctgtgtgcctgcccgtcttccccaaaatctatgtggtcctcgaatatagcaactgtcattcaatacacatgtttgagcaccacagtgagctaagttttaaggattcaacgatgaaaagtcatgctgtcttccctgcagagggtgctcagattagtgatg

SEQ ID NO: 531881 - DNA, 396 bp, Homo sapiens
tgtacatcacttacaagacagataggagaagagttatatggtaatacttaacaggccaggcacagtgactcgcgcctgtaatcccagacactttgggaggccaatacaggcagatcacgtgatgtcgggagttcaataccagcctgagcaacatggagaaagcccatctctactaaaaatacaaaactatctgggcgtggttgcacatgcctgtaatcccagctaccctggagtctgaggcaggagaatcacttgaacccgggaggcagaggtttgtggtgagccgagatcgtgccgttgtacttcagcatcaacaagagcgaaaccgtctcacaaaaccaaattagtcgggcacaatggtatgcatctgtggtcacagctctttgggagactgag

SEQ ID NO: 531882 - DNA, 341 bp, Homo sapiens
cccccatgattcttagaaccaggcgacttggatttccttggggttgacaatcgagtagtattcccgattgaggcccccattggtataataattacatcacaagaggttttgcattcatgggctgtccccacattaggtttaaaaacagatgcaattccgggaggtttaaaccaaaccattttccccgttacaggacggggggtatattagggtcaatgttttgaaatttgtggagcaaaccccagttttatgcccttggtcttagaattaattcccctaaaattttttgaaatggggccggtttttaccctatagccccccttttaccccttttagagcca

SEQ ID NO: 531883 - DNA, 187 bp, Homo sapiens
ccccccccgggggggtttttttttcccccaggggaaaaaaagggggggggggggccccctttttgggggcgttttttttttcccccccccccccccccccggttttttttttttttttccccgcccccggggggggggccggcccccttttttttttttccggggggattttgcccccccgggggga

SEQ ID NO: 531884 - DNA, 289 bp, Homo sapiens
gctcaaatatcttagacgtctcactctgtcacccaggctgatgtgcaatagcacgatcttggttactgtaactccacctccggggtaccggcacattctcctacctcagactcccaagtaggtgagattacaggtgcccaccaacaatcccggctaattttaagtactataagtagagacaagatatcaccatgtacgccaggttggtctccacctcttgacctgacctctggagatccacccaccttggacttcccgtgtgctgggattccaggcgtgaacaatctcg

SEQ ID NO: 531885 - DNA, 439 bp, Homo sapiens
gggacctcctgcgacttcccgacgttgcgactgcgtgtacttctctttgttttggagcggctcgagacctctgccatgagatagtgtggcaagctggttcagcgaactggcccattatcgtcggccctcatgacatcacggcatatccgcgccacgtctctcaagcaacgttgcgatgcaacctgtggtggggcaccatgtgccacaggaatccaaggagggaggccgattgagggacccccaatagatggctccacctcatatggacggcaaaatacaagaggccgcccgccattgcgttcccatgcaggatcaaagccgacccgtcgcctgagcaacgtttcgcccctgttagcctacacacgtcgaacttggtcatttcggctgttcgacaacgggcccctctcttaggacccactttcgagcacaattcgcgctg

SEQ ID NO: 531886 - DNA, 1199 bp, Homo sapiens
gcggagtgcaaccaccagccaccggaagtgctcggacgacgccccccagcacgcaacaaaccagactcaccgtagtacaccaccgcactcagacccccccgcggaccgcacgcacgtcatgcgtcagcgccgctccaggggccgagaacacatctcctggtgtgtcctgcagcggcgtactgctgccggttaagacgccagcgctcatcgggcagaacaaactcgcctgggtgcacagcgcacttgttgccgaaaataattctactcccaccctggccggcagaacatacacgctcgcatcagcacgcccgcgcgtcagtaaatgaaggcgccgcgtagccagtctcagagccgcccgtctcatcagtttggctcgttgacgaaatccgcgctgcacaaacccttcgcgcgtcgtgccaccgcacaagccgggttcataaatacacaggagtctctgttctatgttgtggagccacacaccttgctactctacatgaatatgataataattgtgttttgatcagcagagagaacgacacacacgaccgacgcacagcacacagtacccaccgcgctgtgcgggcggagctcgttacggcggaccccatgcaagtccagagagtgcgtgccacactcgcggggcgacagcgtcctctcactgagcagtcccacttcgcggcagggcactcaggggggggttctatctcctgtgggaggaggctgtcgtcgcaccgaggcacgccgccccctacgctcgatctcttttctgaggggcgcactcctcaggaggggttcatcactcccctttctctctttcttgatggcgaccaccgggcagagaagatatctcccctgaggccccccgctgccccacactcagcatcgttgggtttggagcttcactcacacacaatagcagggggccgccctcaacaaaggagggccctcccttcccacgacaaatatcgcctgccctcggcacgacggcccacaccttcgaaaagagggctcgcacccccgacgggaggagaggcgaatgccaccccacacgggggggccgaaaacctggggggcccggctaagcgagcccttctgtggggggcgggggacactgccagacttttttttgtttttgggggagaaaaaatgggtttttttttttaaaaaaaaaaagtttaaaaaaaagttgtccgagccca

SEQ ID NO: 531887 - DNA, 859 bp, Homo sapiens
ccgtttaaaacacactattgcccccacccctcttgctcctcccccccggggtaaccgttggcattcccaacctggtaagagcttcctttccgcactgtacacctttctaaacacagaagttgtgtacccgcccaaccacatatggcctcccccttccaatatataggcgaccccccaccaactggcgaaaaattatgccccccagttgtgcaaatccacttaacacaacttcttcgggaaacaaccccaaataatggtacccgttgtcgccaacgcccgcttggtgccactaatcttcacccacacaagtcacacgttggtcctaattcttagcaccaacggatttctgggaaatccccccccgccattcggcgtagtaaaacaaacaccccaaaagaagtgttgttttcccccccacaaagcgtcctaaattctcattattgggcgcacaacattttctcccttacatatgagtcttgtaactacacatgggttctcctctctccgcaaaagaaaattaactctggggtgtacacgacaccacatgtagcttaaatagttcaagattaaatctaacaaattcttcaaagagcatttaaaccccttccccctgaaaacaagtgtttgtaacagtcctcattctactagaagtgttttatataaaaacattctttcgccccaagtaattgtcatcaccccccctccccaaaaattgttattattcttcctttctgagtcaagactacttgtttttccccgcccgcctccaagaagttccctctctaatctgtcccaaggaatcaataaccggcgtgtgttggttttttaaaaaacaaaaaaatgaaacaacccacaaaac

SEQ ID NO: 531888 - DNA, 265 bp, Homo sapiens
cagagtcatggagcctactaataacatgaaacgggcagacctttgttggagcccatgacgaaggtgactgtcccactgcacaatctctggaccccagaatctctggaccaggatatttagtaaggccttgctgggaaacacacatacacctctatgtgcgctgtcatcaaatgaggtgacgcctatattacatctagcccagtgctgcagcatattaggtggtccataatgcacagtatgccagctgaccggctaccgagctcga

SEQ ID NO: 531889 - DNA, 81 bp, Homo sapiens
cagcaggaggactcggccgtgtatctctgtgccagcagctttccagcgggggagacagctagcacagatacgcagtatttt

SEQ ID NO: 531890 - DNA, 220 bp, Homo sapiens
gtaatatgcgattagtatcttaaaagaaaataaaattgaagcaaaaatagcctaagatattgagacaagagagactagaactaggcccaagagcgcagcactaggagtacatgctcctagaacacacatttattctatacgtaatattcagaagagaacacgaaagagggttaggtctaccgcctactactaccctaacatagttgaggaaaccaagcgc

SEQ ID NO: 531891 - DNA, 155 bp, Homo sapiens
tatcagccggtaccctataggcttggagcaggtggtcccagcactagagtttaaaactcttataataggagttataatagtaacagaaacctgcttactgctcccttatttgctacctgtacttcttcaaatgataaaaagcttcatcagctacc

SEQ ID NO: 531892 - DNA, 177 bp, Homo sapiens
taagtgctgtctatgtgacagatccatattattcatgtcctggcattcttgctcacgacgtgtcatccccctgcactccggcctgtgctctagggcacgagtccgtctcaaaaaaccatgaatattctaggctcaaatggtattacacataagtctaccatacattcaagccgtcta

SEQ ID NO: 531893 - DNA, 150 bp, Homo sapiens
gagaaccagtcggcgacgcagtcgtaggccacgcccttctggaggacctcggagccatgtacccgtgggtgcccaccgctggcatggggcttctgctaggagaagtcacaggccaggcccaggtccgagatccgcacggggccatgcgcg

SEQ ID NO: 531894 - DNA, 254 bp, Homo sapiens
  misc_feature (40)..(40): n is a, c, g, or t
tacatatacaatcgagctggtaccctcggatagggccaancactgaggcacacgtcgtggtgtagagtgggttctcatggcacgcgtacctcaccagggctccaattagtaaaatttaaaaaaaaaaaaaaaaaaaagcttggcaggagcggccagttgtttggggctgggccccaggtgggggattctctgccttattttgtggcgcccccgagggccccggtttcccacctcatcctttggcccttatcgag

SEQ ID NO: 531895 - DNA, 617 bp, Homo sapiens
tcctggcttaagtccagggcatagcacagcaaaatctaccctttggacgttcataaagaacatgcatagttctggcctcgtggcggtcgcagctctcccagggccctgctcttctctgagtgaccactgccctctggtctggtggacgcctgggcatctgtttctatgaaacaacctgtttgtttctgtgtttcaaatatttgtgtttattatggaagagacattattttttcatggaattctgaagactgtcatttttgaaggataagcaggttttggacaatttgcaattcttacaactgtctgtaaatttacattactgttataaatgagaagacccttctgatattcagacaccttgttaaatactggctcgtcattgatgcgtgcagcccagtgtgggctttgtgggggtttgaagtgtgtgtggtttgtagcacacggacattcccctcccaacgcagaggcatctttggcacgagcttcaaccgtaaatccagaaacaagcttgctggctttggacttcatgggccggttaagtaaccccccatagctgaggactgatttaaatgtacttttaattttgtccaacaataaaaaaaaaaataaagcaaaaa

SEQ ID NO: 531896 - DNA, 103 bp, Homo sapiens
gtgccatccctgtcgtctaaatctgcaattggacattaaaaactaaaagtaagaggatctccctgtgttgcccaggctggtctcaaactcctgggctcaaggg

SEQ ID NO: 531897 - DNA, 622 bp, Homo sapiens
  misc_feature (525)..(525): n is a, c, g, or t
  misc_feature (539)..(539): n is a, c, g, or t
  misc_feature (622)..(622): n is a, c, g, or t
ccggacgtgtcgacagaagacgacagaagggagagtatgacactaggattcagattggtgaaagtttatagtaccaagaaaacagggatgaggctcttggattaaaaggtaactctgttcactgattagctatgacatgagggttcatgcctctaaaataattgtaaaactttttatctgggcccttagtacccacctaaaaccatctttaaaatgcaagtggctgatatgggagagggggatgctaaccacagggcctgagaagtcttgctatatgggctcaagaatgccatgcgctgccagaacatgtgcacaaagtaaaatctacacaggacttctagggggggtctctcctccaggacgctgtatagtgagaccattacaatgcagcaccccacagtgggtgccttcagaaatatagtccaagctttctctgtggaaaaagacaaaactcattagtagacatgtttccctatagctttcataggcaccagtcagaataaagaatcataattcacacaaaanaaaaaagaattggnaaattgtaaaaaaggaacaataaaattattaaaaaaaaaaagggctgggacccaattcgcctatgtgagtcgaatacaatccn

SEQ ID NO: 531898 - DNA, 383 bp, Homo sapiens
  misc_feature (75)..(75): n is a, c, g, or t
atggtggccatgccgttaatcccagtactttcagaggcaaggggggaggatcacctgaggtcaggagttcgagancagcctggccaagatggtgaacaccccatctctactaaaaatacaaaaattagctgggtgtggtggtgcacacctgtaatcccagctactcgggaggctgaggtgggaggatcgcttgaagccaaggagtatctgggctgtaagtgcgctatgccgatcggggtgtccgcaactaatgttcggcatcaatattggtgacctccctgtgagcggggtgacccaccatggttgcctaaaggaggggtgaacctggcccagtgtctggcaaacgtgagcaggtacaaaactccctgtgcttgtcggtgcta

SEQ ID NO: 531899 - DNA, 419 bp, Homo sapiens
  misc_feature (133)..(133): n is a, c, g, or t
  misc_feature (141)..(141): n is a, c, g, or t
  misc_feature (159)..(159): n is a, c, g, or t
gtgtgggtgtccctcttgctctcccttcaggtcttggtttgttctgaagggacgttttatagtcactatccacatgccagtgtaaatgggcatctatacgtggtcagggtgtccattcctaatcatggggggngggggggnccccaaagaatgccaccnaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgtttttttttggcagagataatcgtgtcttaaaagttgtttttaaatgacaataaaacaagccagaatgtcaaaaaa

SEQ ID NO: 531900 - DNA, 830 bp, Homo sapiens
  misc_feature (1)..(1): n is a, c, g, or t
  misc_feature (683)..(683): n is a, c, g, or t
  misc_feature (701)..(701): n is a, c, g, or t
  misc_feature (709)..(709): n is a, c, g, or t
  misc_feature (718)..(718): n is a, c, g, or t
  misc_feature (759)..(759): n is a, c, g, or t
  misc_feature (767)..(767): n is a, c, g, or t
  misc_feature (777)..(777): n is a, c, g, or t
ngaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgaggcagcacgctggccgagctgaatgggggtcggggtcatgcgtcacggcgaccagaccgacaggcatatgagcccccgccacctcctgcctaccgcactgggctccctgaagccaaatccagcctcgccgctcccagcgtcttccatatgggggccccacatccagccatcttacactaccgccagcaccccggctggcccagccttccccgtgcaagtgaaggtggcacagccagtgaggggctgcggcccaaccaggcggggagcctctcaggcctctgggcccctcccgggcccccantttcctctcccaggccangtgaagtntgggggccnggtataggagcagagagagcagggcaggggcaaagaggaantgctgggnctctggcctnagaagaggagaggagcgagcacgggcccaggtgccctgagcagcctcagagga

SEQ ID NO: 531901 - DNA, 527 bp, Homo sapiens
aggcttcttagctgccatttggagatttaggtcagggcaactctgactacaccctttgatatttcttacagtttccagttggagcttccttcttttgctggtagagatttaggttaggcaagtgcattctgtttttttctgaagttccagtagggctttagcagggaagtaaaactattcagtaagtaattgcaaacaactgtatgtggaatccaacatgttgcccttaagagttaggtaattggctgggtatggtggctcatgcctgtagtcctagcactttgggaggctgaggcgggtggaacacctgacgtcaggagttcgagaccagcctagccggcgtggtgaactaccatctctactaaaaatagaaacaaatttagccaggcatggtggtgcacgcctgtagtcccagctacttgggaggctgaggcaggagaattgcttgaacccaggagacatgggttgcagtgagccgagatgtcaccactgccctccagcctgggtgacagagcgagactccattt

SEQ ID NO: 531902 - DNA, 716 bp, Homo sapiens
ggctcgccatccatatttatttggaaaaggtcaaaaggagcatctatgaaacaagggaggggtgcagggcggaagcagcgcctcaacagccaggaactatgtaggcaacacaagcaggcacagcgcggccaccacgtgctccacacgcctcacacaagccaggcccgcagggccttcggagagctagcgaggttacatttcaggcagagtggccctcttcccacccaaacccacagaaccccaaacaaggcatcaccaggaaagacacgggaaagccaaactcacagttgtgacccagggacagaaaaacccttgggccccacgtgatgtgctcccaagccaccagcagcgtgctctccaaaactccctagtgctatccacagggggaatttacattcattttaaaaagccgtgatatatcccaggctctctaactcttccattattaaaacggccttggtttggctgcttggtccacactgagaaggcccaggaaagcggggagggcccctgatcagggcaggaggccacctcagaaagcccaggcccaccagggcccaagcacttgtcggggctcagaacagggcctcaaccaagagggttgatggcctccagtcaagaaacgggggctcatgccagagagctctctcctcctccagaaggcgccatgcaggggcgggctaaagaccccagtgttcaactcattagcgagagag

SEQ ID NO: 531903 - DNA, 196 bp, Homo sapiens
  misc_feature (130)..(130): n is a, c, g, or t
cccctgtatacctacacgcgtgcggatgtggtgcaggagggcggctgcttccctacttaccacttgggcttctcttgagagaacagcccagctgcattcccggctgcttcttctctccagcgtgtgtttnatctgtggatttgcaggcctgtggtgtagcctaatgcgggagctactgtgagctgtcgtgggtcca

SEQ ID NO: 531904 - DNA, 193 bp, Homo sapiens
gtgtgctgtgttcatgtgtgtgctgtgtgtgcatgtgctgtgtgcatgtgtgtgctgtgtttgtgtgtgtgctgtgtgtgctgtgttcgcgtgtgctgtgttcgcgtgtgtgtgctgtgtgtgcatgtgtgtgctgtgttcatgtgtgctgtgcatgcgtgtgtgctgcgtgcatgtgtgtgctgtgtgctgt

SEQ ID NO: 531905 - DNA, 742 bp, Homo sapiens
gggcgactacgcagatggccctgagtaaccagcagaaggcggtgcttgatgagcgacgcgggtgatgggcaccgagcaccccaagcaccatccaggaatacatgcacctggtcctgtactgcttcgccagcagccagctgtccaccgtcctgagcctgctgtaccgagcccgctacctcatgctgctggtgttctggggaagaccaccccgagatggcgctgctggacaacaaacatcgggctggtgcttgcacggggtgatggagtacgaactgtctgctgcgcttcctggagaactgcgcttgggcgtcatgcacgcaagtacctacgggcccaatggccctcaatggtggtcctcagtccaccaccttgtctgtccgagtctacgagagcaaacgctgagttccggtcggccctgcagcacgagaatggagggttacaccattctatcaagaccgcatgctggtgcgaggacccatgatgacctgacctctggcacagctccgagttaccgtcacagtagccctgacaccatgcatcgcctgtggcccatgcatgctgcacacattgaacggagagtcttacctggcaacgggatccacgcggccaacattcgccgcgccttcaaaggttcaccggtcacaccaggcactggcccagtaagtacattagggagcgagagtggaacctgtcatcaaaccagggcactcctacttcatttcttctcaggcaaacaacaccg

SEQ ID NO: 531906 - DNA, 978 bp, Homo sapiens
gcgcgtggctggcgggggtgcgctatctgcgggtgccgtcctgcccggacgccgtcgcgtgccgtggagactgacagccgaggtcagagggtgatgctgttgctcgggcccgggactggacagcgatccagagctgtccccgagaggagtggaggtgtcctggcagagaggaacgtctgagaacagaggaacggcatgacagaggacaggcagcagtctgcagggagttgcgggcgcaattgttggtcccacgaaacctcgcactgaccatggctgcctcggcgtggccgtgactggactccgtggactacctctgcttattgggccccaatagcacaatgaactggtcgtttcacgaacacgatggagacagtgtgctcctgcgtgcacatgtaatgtagcagtcgagcatatggtctccgcgatgagacagcttctccatcctgactaggcctacctcgtgatggagtgcttgcgaagtgcgtcggccggagatcgttgacggtggcacgaaaggggaatgcccgtgatagcagggagctggatgaggagggctctgatcccccccttgtcggggagggccagcgcattcgacaggtgctgcagtgctctcctagtgggttcagcgcggggcgggcgtgccagtgcaggctgctcagacaacaggtgagctcctccggtcggtggggggcgggttcaccagcaggcaggggtgagcaaggctttcagctcctcggtggtgggggcgggatcacagcaccagagctccgcagggccgttcctactcagaccttctgggcggtgacggtgtcacgtgtgcggtcattgcctcaccgcgaggtggtgtctggaatccggccctggctgggggctcagccagattggtgggcgcgtctcccctccgcaattaacgagggcggtgggccgcggggagctggcggccgggccgtttccgcccggccaggggggggtttcccc

SEQ ID NO: 531907 - DNA, 176 bp, Homo sapiens
ccacgcgtccgcggacgcgtgggtccagaaattcaagacccgcctgggcatcataatgagaccccatctctacaacaaaatttaataaattagctgggcacagtgttcacacctgtagtcccggccactcggggctgaggcaggaggatcactggaacctgggaggttgccactgc

SEQ ID NO: 531908 - DNA, 785 bp, Homo sapiens
  misc_feature (502)..(502): n is a, c, g, or t
  misc_feature (612)..(612): n is a, c, g, or t
  misc_feature (648)..(648): n is a, c, g, or t
  misc_feature (659)..(659): n is a, c, g, or t
  misc_feature (690)..(690): n is a, c, g, or t
  misc_feature (701)..(701): n is a, c, g, or t
  misc_feature (735)..(735): n is a, c, g, or t
  misc_feature (759)..(759): n is a, c, g, or t
ccgcgctgcaggaattcggcacgaggagagagagagagagagagagagagagagagagagagagagagagagagagagagagagagagagagagagagagcgacagtgctacagggactgccacctgtggggagacattagaccacaatgaagctgccgactgacgcgagtcccatctatccagcttgctgcttcttgctcatcccattctacctatccccagactctgttgagtgcatctcttcttcacctatgtaccgcagctgcacgtgcggatcttccttcctctaccccagttgcccaacctagttcattccagcatcaaccagcttcaactgactctggactatgcaggtcacgctgcccaaccacggactacttctgtacacgatagtcagtaattgaatactatgatcatgagtcgcttatcgacctcatgcccctcttgctagactatagtactactatctcatcggcaaggcttgccctgactacagatcanggctgactagccaccatcactgcagactcagacgtatgttctataccagtctgctcgcagcatgttgtacatctcgattgagcgtcctgctctaatttccatcctcccgngtagtctatcttgctcccgacttagcggactatgtntcagatggctntcttcaggcgagccgaatctcatctgatcangcttgcagtcngactgtccatttatgacttgagcttgactatgangagtctcattatgaactgatctantcggtctgttctgcatgtcacgcctg

SEQ ID NO: 531909 - DNA, 209 bp, Homo sapiens
  misc_feature (124)..(124): n is a, c, g, or t
ccagtacagcgctctcgtcacatgtgtatgccgatactgaagaaggcaagacaattcagacgtgatacgtatccaattatgactgattgattattatgtgatgctagtattattaaaattatgncacaccctggctaagctcgcgggaaggatcttttgtatgcaaacctactgctttagggaatgggaagtgggttcttttttggctg

SEQ ID NO: 531910 - DNA, 777 bp, Homo sapiens
ggatctctggacgagggtgcacgaacatgagcccaggccacagtaccgctattcacgctctgtgcttgtgccaagggggcaatggcggcttcctgtgttctacatgcacactgggcagaagatgcctctgatttggtctgggtacctggaagagtgacgcctggctcacggtaaaacgcagctgttaagtatgcccttagcagtaggctaccgccaacattgattgtgctgctatctacggcaatgagcctgagatcggggaggccctgaacgacgcacgtgggcaccaggcaaggccggtgcctcgggaggagctgctcgtgacatccaacgcctgtggaacaaccaagcaacaccccgaggatgtgcgagcctgcctccggaagactcttggctgacctccagctggacgtatctggacctgtacctagatgcactggcccttacatgccttctgagcggggagaaaacacccttggccccaagacatgctgatggggcctaataatgctacgaaacacagccactacaaaggagaacttggaaggtcctgcaaggcacatgcctgggataacgggggcctggtgcaaggagcctggggacctgtacaaacttccaacagatcggcaggatcggatgaccatcactcagtagcgggataccgagactcaactgacttgcctttgtattgccacccaaccttggcctcaacatgaactcatcgcccctgccacgacagtacctagagtactgtcacacactagggatcctgaacgg

SEQ ID NO: 531911 - DNA, 263 bp, Homo sapiens
caaagcactccttccctgataccgagaatctaagaagatcgatcgtcacatgtatcacagcctgtacctgaaggtgaaggtgaatgtgttcaaaaacaagcggattctcatggtacacatccacaagctgaaggcagacaaggcccgcatgaagctcctggctgaccaggctgaggcccgcagttctaagaccaaggaagcagtgttacccgagctttgaatttcggaaatcatggttcatttggctggtttcccttgtatat

SEQ ID NO: 531912 - DNA, 371 bp, Homo sapiens
ggagagagtcttcagagcctacagcagtgtgttcgtagtgcaatatccgtcctgtcagcacaggtcaagttgctgaatctgttacatctcggcttcctactcgtcgcagtctcggggctcctcccttgcaatgaaagatgcttttcagtattaggttggtttcagtctctttcacctcactttccaaccttcctcgcacctgctttgcatatgcacaccccgtcagctagcctgagtgtcagaatcgtagtacaggccaccgttccctttccatcggcccctcagcccatctaggggcctcctctaggcccctctgtgtccactcctcgtgcctccctcacacctcaaacacctagcgcgaatgccagctc

SEQ ID NO: 531913 - DNA, 314 bp, Homo sapiens
gcacgagccaaagagcagctccatattaaaaatgatttttgagggatagctcacacctgtaatcacagcattgtggaagccaaaacaggaggattgcttgaggccaggagtttgaaaccggcctgggcaacatagtgagactccatctttgcaaaaaataaaaaattagccaggtatggtgtcgtgtacctgtggtcccggctgctcggaaggctgaggtgagagaatcgcttgagcccaagaggtcaaggctgcagtgacctgtgatcgtgccactccattccagcctgggtgacagaatgagaccctgtctc

SEQ ID NO: 531914 - DNA, 265 bp, Homo sapiens
tcgatacgacttttcttttctttctttcctttttctctttctttctttctctatctccttccttcctctttcttttctttctctctctccttccttcctttccttcctttctcttcctttctctttctttcccttccttcctttctctctttcttttccttcccttccttctttctttctttctctttctctttctttctctctccttcctttcctttctttctctctttctttctctttctttccttccttccttctccctctt

SEQ ID NO: 531915 - DNA, 235 bp, Homo sapiens
gaggcccacagttggtagctcctctctgtaggcaggtcatctgtccagtgctcagttctcagtggagaggaggccctggaaagggtggcttctctctgctggcaggttgtctctgcagctctcagtggagaaggtagctcttctctgcagccagccatcccattgtctccagctaccagcagagagtactcctctctgcagctggtcatcccaacacctctctggcctctttgtc

SEQ ID NO: 531916 - DNA, 127 bp, Homo sapiens
ctctagacgatccccgagtgtcttcaagaaagaatataaaagaaaatgaacagtgtataaatctataaaacggaagttcattacattcacacagattcaagatggagaagaagacacaatgatattc

SEQ ID NO: 531917 - DNA, 474 bp, Homo sapiens
cttctgaaccaccgcggattgaattgccatcgagatgctagcttttaaagacagtcaattcgtttgaattccatccagtgtgtacaaagcaacgcgataatctacatcatgacacacttgttacttgctatccctcattggtgtagtggccgctattattttatcctgcttatatctattacctgtgttaaattattatccactacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgtattggaatttgccttcttgaacttcctgagtcacacagaaagcaactgtacacagtagaattctgtggcgcagaccatgctgtattaacacatcacttgctgtttcctactgagtgtac

SEQ ID NO: 531918 - DNA, 148 bp, Homo sapiens
gaaatgtatcccacatatgggccattaatgtgaaagaagattgcacaaggatgttcactgcagctatctatttgttaaaatgatcacctagaacagatagtgaaatctgctttaaaaaatatctgtcagttgattgggttgacgtcag

SEQ ID NO: 531919 - DNA, 430 bp, Homo sapiens
tggtgactcacgcctgtaatcccagctactagggaggctgaggcaggagaatcgtttaaactcaggaggcggaggggcggaggttgcagtgagctgagaccgccccattgcactccagcctgggcaacaagagcaaaactccgtctcaaaaaaggaaaaaaggataacatggctgagtgcagtggctcagccgaggcgtgaagagtgcttgagttcaggagtttgagaccaggctgagcaacatagcaagacctcgtctctactaaaaatcaaataaatgagctgggcgtggtggcgcgtgcctgtggtcacagctattccggaggctgaggtgggaagatcgcttgagcctgagaggtccaggctgcagtgggctgtggtcttgctactgcaatcctgcctgggcaacagggagacacccagtttccac

SEQ ID NO: 531920 - DNA, 115 bp, Homo sapiens
  misc_feature (8)..(8): n is a, c, g, or t
  misc_feature (68)..(68): n is a, c, g, or t
aatccctngtttacattattaagcttcctactaatataaaaataatggaaatctttttttgataaaantcattaacgactcggacggatttttaaaaccctttgtaacagtattg

SEQ ID NO: 531921 - DNA, 184 bp, Homo sapiens
atgccgtctccaagtggatctcgcatggattgcagtgtactccgtgcagtgtggtgacctggtttctgattgattgcagtgaatcgccatgcagcgtggcccaatggatctcgattgaatgcactgtattccatgcagcgtgtatgaatgcagtgtattccatgcagcgtgaagaaatggaacc

SEQ ID NO: 531922 - DNA, 160 bp, Homo sapiens
cctcagaagaatatgtcagcagctgctggacacatctgagccagcaatccccatagcaaccccaaatgtctgctttcttcaaagctggagagtcatccacaccgtcaccagtcacagccacgatagcaccctgtcgtttggcagctcttccacatatgat

SEQ ID NO: 531923 - DNA, 847 bp, Homo sapiens
ttaggctaggtacgaggctgggtggtgtttaacttggacacttcctccaaacaccccaggttcctttgcccaacctcctcgaatacagcctctctgggagtttccctctccccgactcagccgcgctggtccctgccttttcagcgctacctgccctccgtctgggacctggctcctttcctctcgccggtgtttcctctgccacccgctggaggggagtggctggaccccagcctccttgcctgcctgcccctgcctccccgcctcccctgcctggccctggctctgggcctgctgcaggctgcacctatgtgctgctggtcctggaggcctgagggcgaccacaagcagcctccgcctcctgctgctcctggactattctgctgctgggctagtcaggctgtgtgacccgtgacttgcgccctgtgcaagtggcttcgctgtgtgcgacgctgtctgccattgtggctctcgcttgtagcatgcgaagaggagagtgccagccgctgcatggggcccgggctcgggcctgggctgggggcctcctgaaaaaagccgagaggcgggactggaggcagtcagctgcccagcgggcaggacacggggtcccggcgcggaggatatacgggcgccagcatgggcttggatgcatagctggaaccaacatacgactgacaaggcagtacagacacagggcctggtctgaaaccaccatggaggtccccaatccaaaaactcgggagcccaaggcctacgatatccaacttgggacatcgcgctgtcgtgcatagtgggggccaacgatacatgactagaaaacgtcaagggcctggcacaaaaggccggc

SEQ ID NO: 531924 - DNA, 300 bp, Homo sapiens
  misc_feature (35)..(35): n is a, c, g, or t
  misc_feature (86)..(86): n is a, c, g, or t
  misc_feature (91)..(91): n is a, c, g, or t
  misc_feature (94)..(94): n is a, c, g, or t
  misc_feature (108)..(108): n is a, c, g, or t
  misc_feature (166)..(166): n is a, c, g, or t
  misc_feature (169)..(169): n is a, c, g, or t
  misc_feature (189)..(189): n is a, c, g, or t
  misc_feature (193)..(193): n is a, c, g, or t
  misc_feature (199)..(199): n is a, c, g, or t
  misc_feature (208)..(208): n is a, c, g, or t
  misc_feature (214)..(214): n is a, c, g, or t
  misc_feature (277)..(278): n is a, c, g, or t
  misc_feature (295)..(295): n is a, c, g, or t
tctgcagcaaaccagagacccagcaccagcgaggnaccagtcccttgctcgctgttccagtgacctcccctgcagagaccccagcntcacnggngtgctcagtcagcnccacaatgcgggaaaagtggggagccacactcaagggagcgcagggtttctgattggngcngtagttggtcccagggggcntggnggggcnccaacagcngtggcnctcatcaactcttctgggagacacggtgcaggctttgggccaggatgtctgtctcctcgtggnnttcacagctttggtgcnagctc

SEQ ID NO: 531925 - DNA, 254 bp, Homo sapiens
gagagagagagagagagagagagacttcaataacttttttttgcattcacaacttagctgtttggagcaagaatctagctttcagcctgtctaggctttttcacagcccctttctccctaacgttaatcatttctacgcttttgatttaaagtcgaaaatatcgcgactgtcccttccagatgatacttagaggcattgtaaggtattaattccgttattccaagattctttgtcttaaggatagggaacccaa

SEQ ID NO: 531926 - DNA, 206 bp, Homo sapiens
acattaagtcacaaatacagtcctcgatttatatagcccatacacataagtatttgtctaaaacatagtcttctattgtaacatctaggccctatccaccactagtgctatggtctgagttcacacaatctagtatgtaacctagtagtcttaccctagtcactatactactggctactacctactcctagctaaaggctttgtta

SEQ ID NO: 531927 - DNA, 267 bp, Homo sapiens
ccggggggggggttttaaaaaaaaaggggccccctgggggggtccccctttttggaattgggcccgggaccccccccccgcccccaaatgggggttttttaaaaaacccggggtgggggggccccttaaaggcccctttaaaaaaggaaggaaattaacccggcccccccccggggggttttaaagccccctgggtttaaacaagggtttggggaaaaaccccccccgaattttttttttgggccccaaaaaaagggggggccccca

SEQ ID NO: 531928 - DNA, 898 bp, Homo sapiens
  misc_feature (49)..(49): n is a, c, g, or t
  misc_feature (135)..(135): n is a, c, g, or t
  misc_feature (157)..(157): n is a, c, g, or t
  misc_feature (162)..(162): n is a, c, g, or t
  misc_feature (171)..(171): n is a, c, g, or t
  misc_feature (187)..(187): n is a, c, g, or t
  misc_feature (214)..(214): n is a, c, g, or t
  misc_feature (224)..(224): n is a, c, g, or t
  misc_feature (301)..(301): n is a, c, g, or t
  misc_feature (394)..(394): n is a, c, g, or t
  misc_feature (396)..(396): n is a, c, g, or t
  misc_feature (398)..(398): n is a, c, g, or t
  misc_feature (417)..(417): n is a, c, g, or t
  misc_feature (429)..(429): n is a, c, g, or t
  misc_feature (435)..(435): n is a, c, g, or t
  misc_feature (512)..(512): n is a, c, g, or t
  misc_feature (534)..(534): n is a, c, g, or t
  misc_feature (671)..(671): n is a, c, g, or t
  misc_feature (681)..(682): n is a, c, g, or t
  misc_feature (748)..(748): n is a, c, g, or t
  misc_feature (770)..(770): n is a, c, g, or t
  misc_feature (777)..(777): n is a, c, g, or t
  misc_feature (793)..(793): n is a, c, g, or t
  misc_feature (796)..(796): n is a, c, g, or t
  misc_feature (813)..(813): n is a, c, g, or t
  misc_feature (818)..(818): n is a, c, g, or t
  misc_feature (835)..(835): n is a, c, g, or t
  misc_feature (887)..(887): n is a, c, g, or t
ggggtaggaaggtcaccagaagcatgggggctgagtcagtcagcaaatncgtaaggcctaggcacagaggagcaggttagggcacattcaccttctcaggattctgtggctccctcattggagaagggaaagagnatcttgggggcgcaattccaanagcancgagggcanaggttagagatggctnagagcccctaacctgaggcggcaccanaataggcagnaacaactgtgtggaaagctggatgaactggtcagtagcggaaaatgggagggggcactgggttggcctcttggggangggtccaacacttggcttggatgaactcatgaaaatacccagatgttcccaagcagaggggggcagagcccaaagcccctttctctacaagcntncntaaggaaaaaaaggcactnagaaaaaaaggnattcanggaaccccctggaaaggggtgccagaatatagtccttaaggcacagctgaggcggacaaggcaccaaggcacaactngtggggggaaggcaagggcagnctccaagcacaaatgccagggtcacaagaggatgcaggaccgcccacgcttgatcggcgtggggttgagcacagcccggacagcctcggcgaacacttccttgacaccatcctgttgcagggctgagcattcgaggnagcgcacagnngggatctgcttggccagtacctggccctgctgcggtgtgatgggcgctggccctgctccttgaggngcgtagagtgtcaggctgggcnctcaggnccttcttggtgcccancancaggatgggcacatcanggcantggtggcacactctggnatgccacttgtggccgcacgttctcataggacgggggatggcaatggagaanagatgacgaaa

SEQ ID NO: 531929 - DNA, 169 bp, Homo sapiens
  misc_feature (18)..(18): n is a, c, g, or t
  misc_feature (31)..(31): n is a, c, g, or t
  misc_feature (33)..(34): n is a, c, g, or t
  misc_feature (37)..(37): n is a, c, g, or t
  misc_feature (39)..(39): n is a, c, g, or t
tctagagatccccagtcnccactccacctantnnccncncctctttttttttaagaagggccggatcatggctatctcagccacatgtgggcaatttaatttatttacttccttttttttttttttttttttttttttttttttttttttttttttttttttttttatt

SEQ ID NO: 531930 - DNA, 492 bp, Homo sapiens
taagaaatgggctttggagtgcctcgaatttggcctccacttttcttttctactgtcttacctggcttaggcaggtcggtgaccatctggagtcggagtttctctcatttgtaaagcgggggtgatatttttctcacagggctgcttcaagggttaacaaagttaatgtctaggaaggacatagcatagcaccttcacctggttgcaagcccctggagtcacatggcaacagctgtggaaccaggtaaatgacttgacttacatgttacacgctcttagttgttcgatttgtaaatgggaagagtgtgtgacccaaattagtcgtttccagatatttcctggtaaatggttgttgaatcataaaactagaaagatgggaaagaaagggaggaaccccccttacttcgaagaagtgttgttgatgtgaaggacaggactttttagacactctcatcctaagaaacagctgatatctactaggaaaaaacatga

SEQ ID NO: 531931 - DNA, 124 bp, Homo sapiens
  misc_feature (29)..(29): n is a, c, g, or t
ggtccgtccccctgcctctgcctggcggnccctcctcccctctccttgcacccatacctctttgtaccgcacccccttgggtcctttgcgcttttcccctcccccctgaccgcatggaccgttt

SEQ ID NO: 531932 - DNA, 120 bp, Homo sapiens
gggcacgcttggttctaagattgagagcagaacttagcattctaggaggcacggggttgtccacttggtttcggatacggtttaaccggttggtcagggtgtttggttgttggtccccat

SEQ ID NO: 531933 - DNA, 938 bp, Homo sapiens
cggactccctgagctgcctgcatcccacgtgacctgcgcctggccacccacagctccacctgctgagccctgctcgccatggcccatcttcaggggcccatcttcctagctgctgctggaagtgctgcacatgcagtgttcccagtgctgcaagatcctgcgtcacctccaatggcgctggagctggtgaacgcaggaggtgtgctgcgctttctggagcaagagctggagactatcaccatatccggacctgcaggggcaaagaagtgccacttctactacaacatctctgagtgtgaaggtcacagagctgcaacgtgacatcttccgagctcgatattaccagccacagcaggagctgatgcttacaaatcaccaagtgcctccttggggcaatgcgcttccggagacagcttgctctactggttcttctatgatgggggctacatcaacagcctcagcatgaggtgtgatccatccagcactggtctggagctctccctgggatcccgataggacgtgatgaatagtgtcacaatgtactcctgacaggcacactgatcacacaaaattgcaagcggacacatatcagaggaaaacctttcagagaaggggtgtaatgactagtaaatcatacaagatcccaattccgacgtcaatgggacatgcgccgttccctcatcaaaaccagacaagaactctgtgaccatggatcacatgtaaaccaacgtgcagggggaacggcgataacatgtaattgaacagtgcaccatacctgacaacaacacgaatgaccagggtttcagacgagaattcattgcatggaacgaaagcatgaaggggcgattgactagaaatcgacacaaataaagaggaagtgcatgaagacaattcacaagcacacgcacagcatagaaaatatggaacatatatggtac

SEQ ID NO: 531934 - DNA, 140 bp, Homo sapiens
gaaaagccatctttgcattgttcctcatccgcctccttgctcgccgcagccggcttcgccggggggcttcttcggcggcggggacttccgcagctttatcggcagaattccttaactctttggttttttttaatatccct

SEQ ID NO: 531935 - DNA, 825 bp, Homo sapiens
gtgccattccaatcaaggcagaagaaaaatggcaataattggaatgaactgtatggttaaagaaatccactgcgttgtcatagagcacaagacgctgggctgagatatgatggtgcaccattaagagtgtaaatgccgtacgatagcgatatagggggattgtagccgttgatgtgttgtatgaatgatgaagtgggcttgagatgagcgaacaggatcagaatgcaggaaagactatgtctgtgatgaagaaagtgtggtgaataaagccagagtagttttatacagagaaagagagaaagtgtcaggcctttgtagtaggatctgagtgaagcttctgatggcatacggaattgggaaagtgagatgttatgaagaccgatggccccgatttgtatcttcctcattcagtaattgtgccaggatcatagctgaaattactctaatcccaggtaagtcaagcctatagatgccctagaggaagagtaaaaccagaaattcatgctggttaaataatctatagcgagctttccatggactatctaccatcctaatggttggattaacagaacttaagaatgtgactgaacctctgtccacaaaacaagttcctgcgaggatgagacccacaaaaaatttgtcaaagcactgcaggcaacgggccccaggcgagtgtaagactcgcagacatcttctgctgcgactccgacaagaaaggcgggggcccaccagaagaagccggcgaccgacttgaaaaaccaggcgccagcacggactaacggctgccaaatccccgggagccccggcggagacaccccaggcggc

SEQ ID NO: 531936 - DNA, 181 bp, Homo sapiens
ggcgcgaccccctggcgttctgcctcgtggatttcgactggtgattgtgccctgccttgggcgtgagtagatctggaaagagcagaatgctttccttttcatatttggctggtcatggcaggtgcaggtgtacaagttggggtgggtcttggtacacgtgtttcggtgcaggtctacgtgc

SEQ ID NO: 531937 - DNA, 258 bp, Homo sapiens
  misc_feature (20)..(20): n is a, c, g, or t
  misc_feature (55)..(55): n is a, c, g, or t
  misc_feature (76)..(76): n is a, c, g, or t
  misc_feature (92)..(92): n is a, c, g, or t
  misc_feature (201)..(201): n is a, c, g, or t
  misc_feature (205)..(205): n is a, c, g, or t
cctgcagaggccctggtgtntgttgttcccctccatgtacccacgtgtttgtccngatggtctcctaccccccgtncccctgagaggccctngtgtgtgttgttcccctccatgtactcacgtgtttgtcctgatggtctcctaccccccgtccccctgagaggccctggtgtgtgttgttcccctccatgtacccacgtntttntgtgtgctgtgttcgagtgtgtgtgctgtgtgtgcatgtgtgtgcgtgtgctg

SEQ ID NO: 531938 - DNA, 833 bp, Homo sapiens
gctttccctgccgccgtcgattcgcgcggagtgcggaggcttgggtgcgttcaagtattcaacttcgagctccgtaaccctaccgtccatggccgatggaacggcattagctgcgtggagcgtgtaatgcgacgttatatactcgcttcacacagaggttctgaaggactgccctcatccatgagtggcctatcacgtggaatgctgcgaagctggctaaagccttagacaagcgcccaagtgcccatcttagtgtgcttgcattcgcagctgtgatgagtcctatgtatgtctatagtatggtcggagggcctttgtgctgaacacacgtatcaacctaagtcgaggctgctgacacccgatgaaactatggagaatgggtaggcctttgtacactccgacagagatgagggaaaccccgtacgtagtgagtccggttgccttatgtgtacgttgttgcggactatgtgcatggtcgtctcaggccgcggatgtcagccgaagagctatttctaacatgcacctaactaagtacgtacggcgatggtcgcatcatgatagttacccgacatactccttagtactattcgttcatcactctgaaaaattcacttgcatgacgttaacttgccgaaatatgaagggccgtctgaaattcctttctgacgctgacttgctggcaggaaggttgtgtgcccatgtgtgataaagttgacgcatgttccgtccgggggttcacctggagtccactctgtgtcaaaatgaccgtgacggggtgagtctcgcggttaaaacatacccggtggtgtgcccgaatttttgaagggaatctt

SEQ ID NO: 531939 - DNA, 1009 bp, Homo sapiens
gatccgacatccctgttggaggacctcgacttctacacgttcatctgcatgggcagcagagtcttcggagtgcatctgttgctccggtcaccctgtctccgaaaagacgccttcctgtgttagcccggtgtgatgaaggcatctgcggcgatctcgcatcacttggtagcagggcccttcattctgcgtaactggatctctgtgtcgtgggtgtcttccaaccagtattctccttcgggttgcagatgctgtgtgcttgcatttctttgcagttcgtgagtcgcccacacttgtacacacactatgctatcaacactcccgaacgaaggactgttagtgcctatcggtgcgatccgtggggaagctcagcctgaggcgatcctcgattggaggggagccaaagtaccggagaaaactgtgtgccagggatcgcgtaagttagattagctggggagttgtgaggttgaccgctctgacaaataagcgagcgtgtgcatcacaggcgctccggtgggccagtagacattagatactgcccactagaatacagaaagcagacttatctcgcaaacacaaatcaaacttagcaaaaccaagatgccaggatcatatctaccatatcgttaacatcgcggcccttcactccaaagcgccaggagggatggcatcggacttcgcgagcgctaggtacgcgagggaacagatcctggtgtgcacccctaggacttgcttacccgcacgagacaagatccggggtgttgggggggccggcgctctgcggaagccatggaaacggccggcgccctttccattcgcagtcgccgctgcgcaatggagaggcagctcggcaccaccaaggaaatcaagacagttagaacacttccgtagggatacagaattgcgcaatgggtgggagtaccttagtacaatggttgaacggcgacccatcgaaggaccaacgcatccgagcacagggaacaaagggcgccaccggaaggatgcacccaca

SEQ ID NO: 531940 - DNA, 174 bp, Homo sapiens
cccttgggcagctgaaaccccgcccttttgcatgagctgatcagcctgtgccccccttcgctctttaggagctcaacggtttggcagggcaacaggaggctttttgggctttggactccccggatgggtgggcaaaggaatgtgggctatgtagtcataataaattaggcccca

SEQ ID NO: 531941 - DNA, 334 bp, Homo sapiens
cactgctgtgatgtgtctctcacagcttgaaaagcctgacacagcatgtcttgtgagggactgagatgcagagatttacttcattcctcccctttgtgatttcaagagcctctgacatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttatgtgcactgagccacaacttctaaggttaag

SEQ ID NO: 531942 - DNA, 210 bp, Homo sapiens
gtgtaggagttctttttgtattccttatactagtcccttatcagatatatgctttgcagatattttctcccagggtgggttgtcttcacttcccttgggtaggtgtccttttaattacacaaaggttttaaaatttttaattgaaggcaaaatgtatctacaattttcctttgggttgctcaagcttttgggtgttgcaatctaagatcc

SEQ ID NO: 531943 - DNA, 513 bp, Homo sapiens
gatctccagtgctactccaaaaacaggaatgcggttgcagggtgagtgtgctaacaatactcctgggattttcacgtccttggagacatccatctttaaatagtgcaaaaaggaccggattaattctcatttatttgctattttaattgaacaattgcaggcaatatgccttaatatggcaggaaggtctccattgtcctttctccttcattcttgattagcgtctgagctcagatggcatgcatcagtatgtttgtggcattacagaggtgctgggagcgagggagagtgcaggggtagggaagcattacatgcctgtaatcccagctatttgggatgctgaggcatgagaatcgcttgaactcaagagggagaggttgcagtgagccaagatcatgccactgcaccccagcctgggccacagagcgagactctgtcccaaaaataaagaaaagtcagcttctgtgctcctgcccagaaccactgaatcagatgctgggtgtcagctctgga

SEQ ID NO: 531944 - DNA, 315 bp, Homo sapiens
taccggatctttatcgccaaactttggaaccaaggtgtaggatcactgaggccaggcatttgagaccagcctgggcaacataggagaccctatccctacaaaaatttttttttaaattagctaggcatggtggtgcgcacatatggtcccagctactcaggaggctgagatgtaaggattgcttgaacccaagaagttgaggttggactgagccatgattgtgccactgcgctccagcctgggagacaaagtgagatcctgtcaaaaaaaaataaaaagttttaaaaaaggaacatctactatgtgctaattgtg

SEQ ID NO: 531945 - DNA, 414 bp, Homo sapiens
tcagatcaccttctctttctttctttctttctttctctctctctctctctctctctttctttctttcttttagagatagagtctcactctgtcatccaggctggagtgcagtggcatgatctcagctcactgcagcctccgcatcctgggttcaagcgattttcgtgcctcggccttctgagtagctgggattacaggcgtgcgccaccacgcctggctaatttgtgtatatatagtacagacgaggtttcaccatgttgaccaggctggtcttgaactcctgatcttaagtgatctgcccgccttggactcccaaagtgcagggataacgggtgggaatcaacatgcccagggtctatccatcttttctttaccttctctggtcttcatactaacaaccaagcaagggaggag

SEQ ID NO: 531946 - DNA, 106 bp, Homo sapiens
ggatgccggctccgccagtgaaatagaaagaaaaggctgattggtagcaataatagatggtcctaagtcattccacgtctatatcctgtaggagatgcatcatact

SEQ ID NO: 531947 - DNA, 120 bp, Homo sapiens
aggaacttttatatatttggcagtgtaggaaattgtctattcctgatataattactgtaggactcttgcttaaggcaagagtttcagatttacagttgaaataaacccccctcttcatga

SEQ ID NO: 531948 - DNA, 605 bp, Homo sapiens
gcacgaggttattttttttttcaggcaatttatgttaatagtatggtgacttggtctttatttcttgggtgttttatggccgtttgtgtttttaatgaggggaaatgttaaagccaattaatcttggggggcttgtcgtacagattggtgtggatcttttggagaaatatgggattaatgttgactttgaaggggggtctcagatccaattattctctttactgaggagaatgaaattacactggcgagatgttttttaacgtttagactgggaaatctatagtaggtcttctaaatttgccattataagacgatacattgagtattggttatagactctaccaattttaatggtgtcgttggacattttcattccaatgcccttctgaaagctttagaagacttacctgatgtctgtactttttgaatgtttacattcttggaaagtcatcatgggtacagttattctggaaattttgcaaattgtaaaatgtttaataaaaatgatattatagtttatagtatggataatcttttctaagtgttctttactttatagagttcctaaattaactttgagtatgttcttaaatcctttttattta

SEQ ID NO: 531949 - DNA, 878 bp, Homo sapiens
gaacagacggtaacgcgtgctcgtgagctagccagccaccacgaggaataatggctgaaaaagcggggtctacattttcacaccttctggttcctattcttctcctgattggctggattgtgggctgcatcatacactcgatttatgttgtcttctcttagaaaggcgagaagatctcagattgacatcatttagaacgaattaagaaaacctatgaagcatgactgatttgattaaaccgtctcatgtttaacacaatgcaatgttcgacatcactttgagcaaacttggatcataagactggcactttggtagtgcagtagagaatttcttcagcgacaataagaaattatgagtgaatttctctatattctgagtgagacaaatgtttagctgtgatgaaccatgcatgtcattaaaaccagtttgataaatttactcacattacaaaaaattatccccccttccctctggaaaaaactatagagaccgtgggctgaggctgtcgcaaggtggctcatgcctgtaatcccagcactttgtgaggaatcctttgagcccagaacatgccgaccttcctaggcgaccggatgaggagacgccccatctctgatgtaacaacacatgaatcttaaacaacacacaacttgttccggcgcatgggggcctcgagaaaaactttgagacctttttttggcagagggcgccgaacttgtaagcttggtcaccttcggccgcaaaaatctcgccttggaaagggcggttccccactccaaaacccggtggcccagtctcgaacagcccatggttccaggcctcgggtcacagggtcaggagcttataccaccggggggtgaagttttcctatcgaatcatgc

SEQ ID NO: 531950 - DNA, 342 bp, Homo sapiens
  misc_feature (10)..(10): n is a, c, g, or t
  misc_feature (19)..(19): n is a, c, g, or t
  misc_feature (26)..(26): n is a, c, g, or t
  misc_feature (82)..(82): n is a, c, g, or t
  misc_feature (98)..(99): n is a, c, g, or t
  misc_feature (103)..(103): n is a, c, g, or t
  misc_feature (164)..(164): n is a, c, g, or t
  misc_feature (184)..(184): n is a, c, g, or t
  misc_feature (224)..(224): n is a, c, g, or t
tgagcctggnaccagcganggcgtgncggcagccgggaagcgagaagtctctggcttctctgcgtccaggtcggcgcgcganacccggaagccgcttnngctncccggaagcgcgccctctagcgttctcgagtcgcatgaggcggctgctgccctcgcggtgnggaagggcgagctgcgcgtnggcctgggctccttccgaatggtggcgcctctgagccagntttcgaggaggagtcggaggaggagcctgaatgtttggagatagacttcaagtcccggaccttatccgtgcgccgcttcggtttgcaggtgacctttgcgtgcgggcgcccctttctg

SEQ ID NO: 531951 - DNA, 115 bp, Homo sapiens
ttgattgggaggatcgcttgagccaggagttctgggctgtagtgcgctatgctgatcgggtgtctgcactaatgttcggcatcaatatggtgacctcccgggagctgggggacca

SEQ ID NO: 531952 - DNA, 857 bp, Homo sapiens
  misc_feature (857)..(857): n is a, c, g, or t
aatctcagcacttagggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaagggcggggcaagtatttataaaagagaattgttgttaaaagggaattagcgtggtataaaggcgtgtaatcctctaagcttgaagaggggagacgaaaatccattggttaaatatccacatctcagggagggagaacccgggctgtgtgggttggtcgccaattcctacaccggaatgtgtggggtatcgacaaggatgatacgcgtgttttcaaatagggtccttggcagtatggatgagcaggacaagatgatgcgagggtacatgaatgggaaccatgcttgggggccagggacagcggcacggattaccgttaggaacaacgacgagagcgaacaaaacaatgtggcggcggcccacaaaacggttcacacccatcgggggccgggccagtgagataaactggcgctacgtgcaaagacacggatgaggggggctcccaaaaacggggggacaggtcggcaaacaggagtgaggacaggcaaaggccgagcaaacacacaaggaagggacacgagccaaagagtggacagcacgagtaacaaggtgcgtcccgcacgcgctcttctcgcgctgcagcaccagacan

SEQ ID NO: 531953 - DNA, 971 bp, Homo sapiens
gtgacagcccattgagcggacgtggctacccatgaacacttcttctgtgcacagctgtggagccttctattggtcccagaagggattccacacagaaggacggaaggcctactgtcgcaaggactacttacgacatgttctgcaccacaacgtgtgtgcgtgactgcgcccgggccatcctgagagaactatatctcagaccctcaacacgctgtggcatcctgagtgcttatgtgtgccaggcgaatgcttcacgccattcgatgaacggcagccttacttcgagcacgacgggcagaccctactgtgaggtgccaataccaagcagcggcgcggatcgctgtgtatcacggctgccagaagcccatcaccggacgcagcactcaccgaccaatggcccaacaagatacacaacccagagacactaacgtcaagagaccatacagccatcaaagcagccacaaccacgggacacactatacaccggacgcccagcacacgaccaagaccattacctgtcacgaaccttgcttacctcaacgactccttcatagctcacagtggcacctgcccccgtgtcctactgcaccaccatatcacccagacacagacattcccctcaaccttggccgatcattgtgaacccttaaacgcacttctcaccaccagcagaggcataaaatgagataacacccggtccttgccaaactagtcacacaccatcgtccccacagtatactgtgtcccgacgcgcaccaataaagatgtccttcgaatgagcatccaccacgtcaataggccatcacgcacaggtacaacacccatcggaacacccatcacacacgcacaagaaaaaaataagaaagacctggcaccacacacagcgccccacaacagacattcaagaccgacagctaccgcaccacaacaaactacgcatcaactcccagaagccgcccccccccatatcg

SEQ ID NO: 531954 - DNA, 145 bp, Homo sapiens
atgggcacaggagagcggccgagaccgttcgcagcccctccgacatcatgcgcaccgccctgatcgtctacctcgatgccgcaagctaacatcacctcacatgcacgcgctacaaggaagtcatgcaggcgacagcatgaatcac

SEQ ID NO: 531955 - DNA, 935 bp, Homo sapiens
tgggccgaacgggactttcccactctgccgtggttccacctggagtccctactggacctgggttctgggcaaccagataccgcggtttcttggaagatctccggtgtcgaccctgcggatttcgcgccgcaatggcgccaatccttacccgaggtacccatcccttggtcgtttttttccacagccttctggctttgtggtaacgtggtgaaatcccggataccccgccccttggttacaaccactaatccatgtccctgcggcggggggacacatggaataattatgtttgcgccccacaaatttggtgtccactggacgcttttggaaatccggccacaattcgattctttctcccggactgatcatccaacccccccctgttgaggaacctgttttcccccgctgtgtttaaataccgtttggcaaatgccatttatgtaaagtatttaagcgccccgcggatgtgtaacaatcatttgcgctccgccgaaagtattaaattttcctgagttctcccggccaggacgccaaaaaccattgtgacaccacgaagtaatttttaaagtttacacccgcgagttttgtataaaaaattgttcccctaatcccctgggtccgtcaagagaaccctctataaaggctacttttccaccttaggccacgcaataagggttcacatcctcttttacccctcttaaaaaaattgttaaaattctagttgtacacaaacctttttctcgtaaattttccacccgttgaactaacccactcgtccaaccaagctctttcgaacctttgaaagtaccccacctccacaaccacacagtgtggagcccaaatgatcacttctcaacccccgatgcacttgggcccaacccaccaaaagaaggggggtccaaaaacccttaaaattttttcccccaaaaaaaaaa

SEQ ID NO: 531956 - DNA, 121 bp, Homo sapiens
ttcagtcggtaccaattgcagccatgatcgcgtgcactgcgaggaggagacgttttcggacccagttacgcgacgacatcccagccgcccgcgccgacctcgtcgacaagcttaaaggcct

SEQ ID NO: 531957 - DNA, 475 bp, Homo sapiens
  misc_feature (83)..(83): n is a, c, g, or t
  misc_feature (385)..(385): n is a, c, g, or t
gggtgggttgtgggtagccctctctttgagctgaagcgtgatagtattctttggtaagaatttggagggatggagatgactgncttgggaacagagataggcataattgcattaaacgctggacagaagctggtgtggtggctggtagccatgtgaggtaggttcataaactttctaaaatatcccccaaggatgtgcctgcctaatccccaaagcttgtatatgtgacgagctattatatgccttccgttcactttaggaagagggagattatcctggattagtcaggtaataatggtatgagtccttaaaagcagacagctttccctgaccggtggcagaagccaaagtcagagggatctgaagccctagtcagatttgctgncccactgttggctgggagatggagagggctcctgtgatgagggatgtgggaagcttttagaggatgagagggtggcagccagcaaggaaa

SEQ ID NO: 531958 - DNA, 122 bp, Homo sapiens
gcgaggagggaccctgcggaatcgtggtctatataccccgatacatatacatgcctcactggtctaccttgatactcctgacacacctggtatgtacagcaccctaccatcactatctccct

SEQ ID NO: 531959 - DNA, 379 bp, Homo sapiens
  misc_feature (234)..(234): n is a, c, g, or t
aaagaattttcaaaaccaaattccagaatgattttccggagatatcccaggaaaattaaggctttttttaacccctaaaaaggcaggtaattgcttgttagcaaaagggatatgacccatttttgaaccttttttcattatgggtggggctgaccagtcaaaaaacctggtggtctttttgattttggcaaataacccggacccccttgggcaggtcccccaccctgtcccagngagggacattgaggggcccttcatgtacacccagggggggggggcttaaaaggtaattatttttgtaaaaaaacccctagtaatttaaaattttgtttttaaacgggaaaaaaaaaattgtaaagggcatgttttttaaagttta

SEQ ID NO: 531960 - DNA, 338 bp, Homo sapiens
aaaagtgtccagagctcggataggagactggacaaaagatatactggtgtcttctgatctcacagtgggtcagtgctacgttcttgatctggaagcgaatcatctccgagcggaggatgccttgagtcgctctgtcgagaatgtcattccacccagcagtgccacaatgggtcaggtgtaccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaa

SEQ ID NO: 531961 - DNA, 2000 bp, Homo sapiens
  misc_feature (192)..(192): n is a, c, g, or t
  misc_feature (194)..(194): n is a, c, g, or t
  misc_feature (197)..(197): n is a, c, g, or t
  misc_feature (201)..(201): n is a, c, g, or t
  misc_feature (204)..(205): n is a, c, g, or t
  misc_feature (207)..(207): n is a, c, g, or t
ataaccatcattttgtgaaggaagaagctctgatttgtagtgtattttcatgatataaatactctgatcatggcctatcaatgggatgctactgaataggaggtagggaagaaatgtcacacttggctctcttgagctggtaggagccagctccagcttaccactgattaaacacttaaaaccatatttgangnccnggcnagnngntatacataaaatgtaaagtataggtgtttattcattttgaaatgccttggtatttcaggtgctaaaatgatgtattttctggacaagtcaaggcaggagaaagcaattgctatagccactagactagatgaaactataaaagataaagatgtaaagacattaataaaggtttctgaagcactgcttgatggcagctttgggaactgtagttcccaatatgaagaatataggatggcctgtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccaggttgcattttaatatacgtatgaaatgaaatatttggttaggatttttaaatggcatattctgtaagcttattttgttctttacccgacctgccaatttacataaccatctgttaaaattacctgtttattcttacacagttttgtggtagctccgatcgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatcgtattttctggttgaataagggtgctctagttttatgtagatgatttcagaatgtgaaggctggtttgcctgtcagtcatggaaattcactggtaaaattgttgcatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacagttgcttaaaaaaa

SEQ ID NO: 531962 - DNA, 1836 bp, Homo sapiens
ggacactttgatttttagtgatcacagttttttttaatgtgccttttttgaggtgattgcttactgtgtagattgtaaggcattattttagactgaggcagctttctcaatttaacacattgcatcttttgattaaagtggttattaactgcgagcttattatttttaaataatttgtgttttccttttgtttcactagacattaataaaggtttctgaagcactgcttgatggcagctttgggaactgtagttcccaatatgaagaatataggatggcctgtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccaggttgcattttaatatacgtatgaaatgaaatatttggttaggatttttaaatggcatattctgtaagcttattttgttctttacccgacctgccaatttacataaccatctgttaaaattacctgtttattcttacacagttttgtggtagctccgatcgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatcgtattttctggttgaataagggtgctctagttttatgtagatgatttcagaatgtgaaggctggtttgcctgtcagtcatggaaattcactggtaaaattgttgcatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacagttgcttaaaaaaa

SEQ ID NO: 531963 - DNA, 414 bp, Homo sapiens
cgaggtgactctagacgatccctttgcctcatccagtggaacaagaagactaccttgacctgtgcttccaggtaacagaacgcaaggcaggtatcaatgagatggaaacaggaatgctcttaatgcagtgcaatttacaaaagaactgttctttgctgaccactagtaagagaccatccaacaggctcctttttgaagccacatcccgaaaagatcccctcctgatgtctctagaaacatgcaaaaataaaattgcaacgtcagaaccataaaaggatcatagcagattgacggtagaagctatagatttgtgtgtccagaatgtttccccaggtgcctccttttgcaaaattggacctcattttaccattagggaacggggcctctcagactccgtggagaagcagagaatta

SEQ ID NO: 531964 - DNA, 213 bp, Homo sapiens
tacgccatcatgtccctggccgctgtttacaaaaacatcacctctagcatcaccagtattagaggcttggcttggcaaccacacggagggaggcgagcaggcgtatgtagcgtagacggatcctacgaccatgcatgccatgtgtgccaatggccacaagggaaacgcgagtggtatggtaaaacatccgtgcaggtcgggccaattatgttg

SEQ ID NO: 531965 - DNA, 360 bp, Homo sapiens
  misc_feature (14)..(15): n is a, c, g, or t
  misc_feature (67)..(67): n is a, c, g, or t
  misc_feature (78)..(78): n is a, c, g, or t
  misc_feature (86)..(86): n is a, c, g, or t
  misc_feature (118)..(118): n is a, c, g, or t
  misc_feature (122)..(122): n is a, c, g, or t
  misc_feature (126)..(126): n is a, c, g, or t
  misc_feature (156)..(156): n is a, c, g, or t
  misc_feature (161)..(161): n is a, c, g, or t
  misc_feature (202)..(202): n is a, c, g, or t
  misc_feature (214)..(214): n is a, c, g, or t
  misc_feature (219)..(221): n is a, c, g, or t
  misc_feature (259)..(259): n is a, c, g, or t
  misc_feature (275)..(275): n is a, c, g, or t
  misc_feature (277)..(278): n is a, c, g, or t
  misc_feature (325)..(325): n is a, c, g, or t
  misc_feature (328)..(329): n is a, c, g, or t
  misc_feature (359)..(360): n is a, c, g, or t
gttaactgtccccnnggtataacgtgtcaggctgagtgtctgggattctctagagctggcaagaccngttgtttggcntgcgggtntgtcagggtggaaagtccaagccgtaggaccnagtntccnttctaagctgatgtctttgccaagaacacngtggnctgttacttgctttgagttgaaaggggtttgcatttacgcntgtaaatgtatncatcnnnaatttatgtaaggttttttttgtacgcaattctcgatnctttgaagagatgacnannaattttggttttctactgttatgtgagaacattaggccccagcaacncgnnattgtgtaaggaaaaataaaagtgctcggnn

SEQ ID NO: 531966 - DNA, 205 bp, Homo sapiens
gggcttcctatgatacctctgctccaaatgcaaaacgtaagtatctggatgaaggagagacagatgaagacaaaatggaagaatataagggatgaactagaaatgcaacagggatgaagaaatttaccatatgaaggaggaggattaccaaaggatatctagtacctttttcttaagggaccacagagccttaaactccccataa

SEQ ID NO: 531967 - DNA, 458 bp, Homo sapiens
  misc_feature (191)..(191): n is a, c, g, or t
acgccagcacatatttaaccccccacacggagcaacgtccagtttaacccgcacagcagcaacccagcctccagctctgtctcaccaagcacgtgtcaacaattctcttcctaggtgattccagcagcacagcctggcagctcctgagcccttgggaagttctgcagctcggcttacccagggctgccctngccaaagccccagccactctcctttactgcagagagcgggaccgtgtcccccttcatccccctagaacggtagggctgggagctgcgtcagacctgcctccacgtgcctgtgggaagagacgtcggagtctgatcgcagacacaagaagatcagtcacccaaaaagataaaatatactcgaacttccgacccttcatcttcctttcagaacacactcacattttctataggaaaacagcctcataataataaaaactcaatttagcg

SEQ ID NO: 531968 - DNA, 135 bp, Homo sapiens
  misc_feature (33)..(35): n is a, c, g, or t
  misc_feature (37)..(37): n is a, c, g, or t
aactaaggcacattgccctttttgacctttctnnngnactattgaaatcaagcttattgattaggtgatatttttataacaattgaaagggcaatatcaaataatgacatatgagaattttttattacatattaa

SEQ ID NO: 531969 - DNA, 361 bp, Homo sapiens
ggtcgacgctctggctagcacttctattaatagtactacgttgaataagagtgatgaaagtgggcatccttatcctgttccagttcttaaaggaaagacttttagcttttccccactaagtatgatgttagctgtgggtatatcatatacgaccttcattatgttgagctacgttccttctattcataattcgttgagagtttttaatcatgaagtggtgttaaattttatcaagtgctttttctgcatctattgagatgatcatatggcttttgtccttcatcctgttaatatgatgtataacatttattgacttgtgtatgttgaagcacccttgcatccctgggataagtcgacgcgg

SEQ ID NO: 531970 - DNA, 237 bp, Homo sapiens
ctgaaattaaactctatttcttaaatgggagtctgtaagtcgactctgcatggatacagagggttcaaggagtgtgaccatttttgcgatccatcccaccagcataaccttgcccctttctgtgcactggtaaactcctccctgctgacctcagactgcagcgtagtcgctgttcctgattcctcaagtctcgtggcctgtacatgccagtgcagctggtctgccctaccattgccg

SEQ ID NO: 531971 - DNA, 223 bp, Homo sapiens
caatcactaccactatcttagcatagttctatcaggtgcataaacccttacattcatctagtagctgttcccccgaacaggtttattttagtacacaaaaaacaccacaaaacaaaaacaaaagatttttatcaaatgttatgatgcccaaaaacagaaaaagaaaaaacaaacaaagcaacaaaacaaacctccaatttttcggggttttgccaccaaagcc

SEQ ID NO: 531972 - DNA, 170 bp, Homo sapiens
gtcaggagctgtgtggcctctcctctgtggccaatctcatgcagtcatgttggcggtgtctccccgctttctgggggccgataacacaaccctagtggtccaccaatctcagcagcagtacccaccatagagctgcagggcattgtcccggagttctgaaggagatcgta

SEQ ID NO: 531973 - DNA, 155 bp, Homo sapiens
ccaccagactggtagaaaggcactttgaaccagcagaaggcagagcgcgggagaggagggtgaggatgtacaagtgagcatctgcaggcgagggaaacaatggccaggactaactgtggcgggaacttgactttgtctccacacactcgcaatcc

SEQ ID NO: 531974 - DNA, 420 bp, Homo sapiens
ctacctgacggtttgagtccatttatattcaactctaaagaatgcaaactatagtgaccaacagcagatcagtgatttcctggggatggtcggcctgggagagaggtagaaggacggattgcataggaggagacttttcgggtgatgaaaaatgcatttagttgattgtggtgatggttacaagggtgtatggagatgtcaaaacttatcacattaggtacacttgaaatatgtgcagtttatcataagtcaagtatacctcaataaagctgttaaaaaataactgattgcttttgtaaggcagaaatatgagactaaggatattgtattacatcatgcattgtcatatttcattactgtgtggccctgcttaattattcatatactagttagaaaattttgtgatgtacagattatggg

SEQ ID NO: 531975 - DNA, 367 bp, Homo sapiens
actggcagataccaccattaccctcccttttcaggggaagaaatcaaggcacatgaggtgtaagtgactttcccaagcttgcactgctagcaggcaatggagtggaatatgagacccagcaacttgcctgtatcatctgttagcctttcttcatgagaagggcaggctcatatgagagctctctgcattggtttggggttagtaacccttttctttttggcttagttctaggggaactattaggagtaggaggagagtttgagacaagataggcctggactgctgtgtaggaagaccacagctgcccagactcctgaatgtcatcatgactatagtcatgcagtttgcattttattataaaaaaaaa

SEQ ID NO: 531976 - DNA, 1244 bp, Homo sapiens
  misc_feature (1089)..(1089): n is a, c, g, or t
gcgtggctgtccccgccggccgcctgattcccctgcggaagccccgttggctaggtgtctagcgcgcaccccctggctgctgcaagaatggatggacatgcatggggaaggagtgaacatccatgaggaaatcgctggaggctatcgtggtggggccacggcaccggtggcaacccgtgtgccaccacggagccacgcataatcaccgttatatgcccgaggaacactgtgacaaatggcagactgggttcgttcgtccaagcgcgcagctacggacatcacgcattggcccacgaattcggaagacgcgacaacgaccacgctaggcaggacacccaccagagtggaaaaatgggctctgtgaaccaccctccatcgcgtaggtcatcgatccactatctgaatcacaggcgagaatccactagtggacacggaggtccgaaaacaaccgtttaggaccaaaatgttgcacgacaccgcagcacaagaccactaacgccccagggagtagacaacaaacacgcaaatttgaccgtggcactatactacaataaccacttaggcggaacaatcacagtgcgtgtagcgagcaaaccaaaatatttgcgccaaccgttgagaaagcgcaccacgagctaagcccgcctcctttaccacaaggtgaggaaatgacttaagaacaccggaaagtagtcccaccccgagttataaaaacaccccgctgtgaacatggatacaccccaaaaccagcatgaaactaggcccaccgttagaaaaccgagaacgcccccgtcggaaggaaacatcacaccaagagtggcaaagacgaggagcaccaaccgagcaccagagtgagggcttaccaagataaggaacacaggtagcccccgcaaaagtatagtggggcaacaaagtcaaacgggcgagcccaccgggacatatctaccgacggacaacgcatgccaccgcacaagcagcggatcgacaccacgggcagaggaacgaacaggacagacattaaggagtaggagatcgcggagataccaagcgagacgaccaacggcgaccccgagcaggagagccacacanacaaagggaccacaacacacaaacaacacccagcagagggggacaaccacaaagcggtgacagaccaccaagaaagaatatagaaaaagaccccgagagaacgacgtacacaccacagagagaacgggccacacaacgggagtacaaggagaccc

SEQ ID NO: 531977 - DNA, 372 bp, Homo sapiens
tctgccaacacaaacttctaagaaactttgtcagctccctcccctgcactgcacacctgcctgaggcacacctccccctgtagttcaggccccaagttcttgcctggacaatcccctcagctaccttgaacacaacaggtctaaagtaaatcaggctgggcgtggtgggtcacccctgggaatctccagcattttgttaaggctgaggtgggcggctcaccgaggacaggagttccaggccagcctgtgccatgtagtgaaaccccaggtctactaacactacaaaacttaactaggccatgtgttggggcataaatcacggggaccccgcagcttcgacttcggaaatccaatggtcattagcttgttcct

SEQ ID NO: 531978 - DNA, 166 bp, Homo sapiens
aggtccccccgtccgatggcccatgaaggctgtcagtgcgtcatcgggctgcagatggcccaactatatgcgccagccagtcgggcatgactgcgtacggcacgagaaggcatctctcttaccccatcgaaccatatcctgccccccatgggccaaagggacgggg

SEQ ID NO: 531979 - DNA, 882 bp, Homo sapiens
agcggcttttccgcccactcccccctccccccgagcgccgttccgcgctgcaccacgctcgctccgagtttcaggctcgatgctaatgctagacgcgcgtacgtgctgctctcccttcaggtctgccatcatgattgatctaccgggacctcatcagtccacgatgagatgttctccgagcatctacgaaggatcctgcggatgatcgcgtgacggtgttgtgcctgtgacggttggaggggaagatggtcagttagtgaccagaacggtgacattgactcgacgtcgctccattggtgggagaatgcctccgacgtgaagggccccgatggggcgatacggtatccgacaatgctatcagatagaatcactggtgctctgactattgtcatgtaggagccatcatcatggcacggaagacaagtttcacggaaagaagccttacgatgaatgtacagtcaatagacttacagtgaagagtcatactcaaaggggaagacgttgacacgaaacaggagaccctagatacatgcatgtaaacacctcttgttagtgacaggcggcttgcagaacaaagtcataggcacatcctttgctagattttgcacaaacacgtactcagttctcttacttgggtgagaaatccttgaatccaggatggtcacttggtttgctctatttggactacccgtgaggatggtgtgaagcccattattattgatttttccttttaacggcatgggttccagaaccttgtgacaaagatgttccaacaaaatagttggcaaattatcctccggacatctaaacaacccttgtccatccataacctggccttccttgcttggtcatcccaacactacaccaggaacttaggaacaa

SEQ ID NO: 531980 - DNA, 918 bp, Homo sapiens
ccgcgatagagtggtgcctgtccacggacaagagtggcagaagcagggggtgcgggatgtaggccgacaagaggtgcgaaagttgcccgacagcgagacctgtcgcataaaggacggcgggccaagactcttcgtgccgaagaagacagagggggggggcccacgagcgctagcccccgggggagagcacccgcgtcgctgaggagggggaaggcttcccaccgcggaggagaattcttcccgcgccgggggacgtgcgacagcaagagcggggtggagcagcggggcgctgggcttgtcgcagacagaatcctcgcgcgccggaggtgatgtataggtgtgtaagccaacggctgggtttccctgcccggtgaggttccgagcggtgcgtcgatcgagatcgtcttccgccgcagcgaggggtcccctccccccaatttgacaattcttcgttcatcggcgcccggtcagttggtgataggactgcatcctaaggagaggggccgcgccgcgccgcgcttctctctgcgagagattctctcactaggagtggcgtccgtccctcgcgcgtcctctccaccgcttgtttgtcttcggcaccgcctcatgtcgctcctgggctccaacgagggaacacactactgtcgaggagagagaggcacatttgcggcgcagcccacccggtgtcctcaaagagagcaattctgggacatcggcgacagatttctctcctcttcgtagaacctcttccgagccccgctctgtctgcatcaggagaacactctggcgaagtaatcaccctctggggagaatctgtaggaagatcagtggagcactttttctgatgagccttcatacatcagaacgccgccgtgtatcgcgcagcgtggctgaaaaccacttttccccgcgacatca

SEQ ID NO: 531981 - DNA, 871 bp, Homo sapiens
  misc_feature (64)..(64): n is a, c, g, or t
  misc_feature (71)..(71): n is a, c, g, or t
  misc_feature (80)..(80): n is a, c, g, or t
  misc_feature (82)..(82): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (124)..(124): n is a, c, g, or t
  misc_feature (127)..(127): n is a, c, g, or t
  misc_feature (130)..(130): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (189)..(189): n is a, c, g, or t
  misc_feature (192)..(192): n is a, c, g, or t
  misc_feature (202)..(202): n is a, c, g, or t
  misc_feature (218)..(218): n is a, c, g, or t
  misc_feature (225)..(225): n is a, c, g, or t
  misc_feature (239)..(239): n is a, c, g, or t
  misc_feature (273)..(273): n is a, c, g, or t
  misc_feature (276)..(276): n is a, c, g, or t
  misc_feature (285)..(285): n is a, c, g, or t
  misc_feature (296)..(296): n is a, c, g, or t
  misc_feature (300)..(300): n is a, c, g, or t
  misc_feature (303)..(304): n is a, c, g, or t
  misc_feature (323)..(323): n is a, c, g, or t
  misc_feature (328)..(328): n is a, c, g, or t
  misc_feature (342)..(342): n is a, c, g, or t
  misc_feature (346)..(346): n is a, c, g, or t
  misc_feature (349)..(349): n is a, c, g, or t
  misc_feature (364)..(364): n is a, c, g, or t
  misc_feature (375)..(375): n is a, c, g, or t
  misc_feature (379)..(379): n is a, c, g, or t
  misc_feature (383)..(383): n is a, c, g, or t
  misc_feature (385)..(385): n is a, c, g, or t
  misc_feature (394)..(394): n is a, c, g, or t
  misc_feature (400)..(400): n is a, c, g, or t
  misc_feature (403)..(403): n is a, c, g, or t
  misc_feature (412)..(412): n is a, c, g, or t
  misc_feature (422)..(422): n is a, c, g, or t
  misc_feature (424)..(424): n is a, c, g, or t
  misc_feature (437)..(437): n is a, c, g, or t
  misc_feature (439)..(439): n is a, c, g, or t
  misc_feature (444)..(444): n is a, c, g, or t
  misc_feature (450)..(450): n is a, c, g, or t
  misc_feature (459)..(459): n is a, c, g, or t
  misc_feature (461)..(461): n is a, c, g, or t
  misc_feature (739)..(739): n is a, c, g, or t
  misc_feature (829)..(829): n is a, c, g, or t
agctccgggcactcagacatcatgagttggtccttgcacccccggaatttaattctctacttcnatgctcntttatttcncncntcnacntgtgtagcatatgttgctaccagagaccactgcngcntcntagatgaaagattcggtagttattgtccnacnacctgtggcattgcngatttcccgtcnacntatcaaaccnaagtagacaaggatcnacagtcnttggaagacctccnacctccagttgaaaaccaaacctccgaagtccanccnccgataacngccatcccccncccntannatcccgatgaatcctcccnacccnatatgatagacgcngccnccntgaagtccaggaaantgttagaaganattntgananatgaagccncgcttntcncccctgacncccgtattcncnatttgccggacananatccntccccncatcccccncntgtcaccccgccagagaaggtagcccacgcctgccgcaccgtgccaggcaccctgcccagacacggtgcccatccctgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaaganggatttggacatctgtctcctactggcacaacagaattttggctgggaaatgagaagattcatttgataagcacacagtctgccatcccntatgcattaagagtggaactggaagactggaatggcagaacc

SEQ ID NO: 531982 - DNA, 136 bp, Homo sapiens
ttccgtacagctaactacagtaggcaagacagccaatagcaatgtgtgggcaggatgcagagtgattggaacctcattcattgccagtgagtaagtgtgaaatggtgtggctgctctggacccaggttcaacagtt

SEQ ID NO: 531983 - DNA, 118 bp, Homo sapiens
aacaggttcacaccccaacgctgtaggtgcgcgagtcgcgagtcaccttaaaggtgctcgtaggaaaggctgggagcaggtatagaaagctgtagacggagctgctcactctgatcag

SEQ ID NO: 531984 - DNA, 111 bp, Homo sapiens
  misc_feature (108)..(108): n is a, c, g, or t
tttcaaacaccgtcccggctgccttcgctcttgtcctcccacagtctgttttctacacagtaaccccatactgattttttgaaaatcctgatcagtccgaatcgcatngtt

SEQ ID NO: 531985 - DNA, 222 bp, Homo sapiens
aaaaaaaaaaggggaaccccccccccccttttcccttttttttttggggggggggggggggcaatttttttaaaaaaaatttttttcccccccggggggttaatgggggcccaaaaaagggggggggggcccccctttttttttttttggggggggagggggtgggggtttccccccccttttttttgggccaaaaaaccccccccccttttgtggggggca

SEQ ID NO: 531986 - DNA, 180 bp, Homo sapiens
tctgactgggcagctgaatagaagtctggaacgcctgaagggcataaaaggcccttgaggatagaccccaagccacctgtctggctttctctacttgtcactatccttctacatcctactctgcaacaaccaaattagattactcaccattccccacactgccttgtgatatactttctt

SEQ ID NO: 531987 - DNA, 1751 bp, Homo sapiens
  misc_feature (310)..(310): n is a, c, g, or t
  misc_feature (878)..(878): n is a, c, g, or t
  misc_feature (1742)..(1742): n is a, c, g, or t
taaacaaacccgggttctggggggggggggggtataatactaagtggaaatgatatcatttaggggggaaggcgcttgggtgaagttaggccttatttctcgtgggtcctttcgtacgaggggaggaaattgtgaagtagaatagaaacaccgaccgtggattactccggctcgtgacacctcgagaactcacgtagggactttaactcgtgtgaaacaaagcgaaccttttaatataggcggtggtgcacccatgtgtgtggatgtgtctccgtgattcacaacatctcggaggtctcgtataaacccncatatgtggggtgtgatatatgttggacttcataagaaataatacgggatatgtggcggccgtgtgtatatctccccctataggggggatacacgtgtgtgttctcgcgagtgggggtctcaaacgtgtataagtgtggggatctccaaacgtgtgagagtatatatatgtgatagattctgcgcgctttgagagagcgtggtgtgcagagtctcttatagcccatgtgtgtaccgtgggctctgcgacgagaagaggtgtggtggggggctcatctgtgaggtcatcgcgagaaggggtgctgccggccccccaaaagccgcgagaaaaaattttctcttataacatgtcgcgcgaagcgtgtgttgtgggtgataaggagtctatgaggaggacacccggtgggtgggcgcgttctgggtgctacgagcggtatacccgtgggtgtgggggcctctcctacacctcagacatttataaagaggagcctccccaaaatgaggggggtcatatacgtgcggaatccagagggccgtggggtggttataagtgcacccgcgaacacctnctttctcacagcgggggcccgagtggtgtccacaacttcttccaccgttgtgtgctctacacacgagttctacagggaagaaaaccaagtcttgtaaacccccctcttcgtggtggggaagccccaatttccccatactaagcagggggtccccccatctttttttagacgggggacaaccaaggcgtgcaatttatttggcataaccctttgtggcaccgcgggcatataaggggatcacccgggggggcccggtttacacaccatttggtgtctcactggggggcaggggcggggggcctcttaaaatactggggaaaggcacacgagagggtgacaggtcgttgggggcaaacccaggcgggcgggggtatcaaaaagatttgggcgaaggataacccactatacacatctgtcgtatacacgcgtcttccttatattagatcaatgcccgtggttatgaggctttacacacgggagagggggaaaaaaacgacccacgaccgcgacgaaaacggggcaaaatacggggggcacgaacaacaagcggacaacacaaggggttataaaattcagaacgagcggaccataccagctggagaaaaagatctacgcgtggaatcatctaaccaacgcaagagacttcgtacaagagggaagaaacggttcacacacgcgcgggagtggaagcaaaccacatagttgcgatgacaagaaaaggggccgaagaacagacacaatgagtagtgaggaggccacagcagagtaaatactcctacgagtagttaacgacgccagtgatctatcgacgcccgaactgtcgacacgccgcccccccccccccccgtaccacaccactatggnaggaagaga

SEQ ID NO: 531988 - DNA, 269 bp, Homo sapiens
gagctgttcctgatgtatcactcgtaatctcggtcaaggcctcatctacacggtgaacaccgtggggctgaagaaatcctcctgcctcagcctcttgagtacgctgggaccacagggaaatgccaacacacctggctacattttaaatttcttgtagaggcaggctctccctatgtttcccaggctggtcttgaactcctgggctcaagttatcctcccaccttgagctccacaaagtgctggctgagcattagcaggcattgaaccca

SEQ ID NO: 531989 - DNA, 486 bp, Homo sapiens
  misc_feature (462)..(462): n is a, c, g, or t
gacgtcatcgggaagtaaggctcacttgtttcatagaaacgcatcattgtaaccaggtgctcggtacacggctccgtaaataacgcgacgaatgtacattcttgtacgggtgtaattatcacgagctaagtatcagagaaccccgcagacggtacaacaaacccaccttaagacgaacacccgaggtgattcatatgcgaggactcagaatggccatcctaccccggaaaagaatgtggccccttgggaacggcaggaagtaccgatcgcacgtaccaggagcggaacaaccgcatcatagtccggaaagggtagcacctatgtggatacggaaaacttatcaccaccccagaggttgcgataccctaagactcacggacccgatacgtcccccccggggcctaagcatgcgcaacgacacaaacgcctccgattgtctattggcggccgaagacacacccnaaaggctaatcttatgatctagcc

SEQ ID NO: 531990 - DNA, 962 bp, Homo sapiens
gagatgccgaaaaactgtgagtctgcttgctttgtcagtggggaagctggtggtctgggacaagttctcagccctggtcactggttgccctgaaatagactcggtgctgttgtagggcacagtgggaatgacaccagcctttagggctgcaggctgcatgggagcagggtgaggcccatgaccgctgactttcccccacttgctggcaaactgtatggttcagcagaagcagccataatccccctgggaatataactccattggaccagacaccacacccccatcccccacagcagtcacagcaagccacacccaaggagaggctgagctcagccatgcctatccctgcccctaccgggtggtctttctctacacaccctggtagacaaagaccaaggtcataatctcttgggagttctatggccctgcccaccgcctgagaaatctgaatacttaaccagctgtccctagggaaagttggcatcctctctgcaggaccacaactgatgcactcttgaaatcaccacctcctagctggaggccaaccaacacaaaactagcgcactaaaccaaaatacaaccaaggacccttacagagtccacttcactcccctgctacctccactggctgcaaaacctgaagatggatcacatcacaggactcttgcagacactccccagtaccagccggagccagtagctccactgggtggtagaccagaagagcaaaaacatcatgacactttggcctcaggagccggattataggggaggggggacccacatcagggcccctggacaaagattgaacgggtctggaatcagatttcctggatagtaccatggaaagggaaaattcgggttcgccaaaatttttccccgaatggttccaggcataggttgtccaaaagggtttctaagggggggtaaaaggggatggggcctaaaaaaagcgagtgagg

SEQ ID NO: 531991 - DNA, 1292 bp, Homo sapiens
  misc_feature (333)..(333): n is a, c, g, or t
  misc_feature (407)..(407): n is a, c, g, or t
  misc_feature (931)..(931): n is a, c, g, or t
gggagtctgacaatgagctgggactctgatcatagagagtgaggacggggaagatgactgtgacgcttgtgaggaactgtgtaggagtgggggagacacatgcgattcgtcttggactttggggaggaacgaggtcaacgcttcatggttgacctctcgagtgcaccctgcgaggactgggacggtttccttcaggcgtatgtgaggatgtgcgtgccgccatcccttgcatgctagggacctgaacggcatgccttgcagcagggggcgtggagtcgatgcaaacggtcgaagctgacgcatggtgcctctgccagactggcgtgcatcaantaaaacaaagcctgagtgctaatgagaagggccgcgggaggagcttctcctgcctgtgtccggcctgtggggcncaccggagtgccgtcacgaggtgcagcgatgactgctgaagcgtcgagctgggagagcagagttgcagactggagcatagcaaaggtctactagtgcccacgtcacaatggggacacacacgacagcaagggaagcagtgccatgccatcgtgagggagctagagagggggcggcagtgagagccatggtagtgctgggcagctcgcgtcccggcttgctcgagctcactagcctgagtgtgaccttttcgctagcggattggcagctctaggagttgtggcaattctattgctagagaggccactttcctaggacccgagcggacggtccccttggatgctcggcggtgggtaaatgggcctactacagggtgcagagcgagtcggtcggtggcagagaccgccccccgtgtggtttgcggtgcccgggggcggcgctccatggaaaggccctccacattgcggcgtcccaaagcgttgttcccttattctcttggggcgatgccggtctggggtggctcttntccaagggcgttcgtcatgcgagcccttcgcaacgttggtggcgttaggtatcactaccaaacacggtgtcagtggcgttacaaatggaacgtgtaggcgttggtcatagatgaccccactccttcgagaatgaacacgatcttggcttgcgaaacaagaaattgggcgcgcgtaccccaaaggatgacgtaacgccagtaccagagggggcctcgccaccggacaccatacacattgcccaggggattttctcaccaataagggtaatcggagaagaggggaactcttaattctggcacaccggggggtataccacattggatagcctacgaggtgaaaaaacctccttaaggctacaga

SEQ ID NO: 531992 - DNA, 140 bp, Homo sapiens
gctcaccttctacgacatcgccatgaccccggggtggttggttctagctattgccatggtacgttttgatatggcaaaggacacacagaggtttatatacaagtattcagaggacacttcaatttttccagacatttgcc

SEQ ID NO: 531993 - DNA, 943 bp, Homo sapiens
agcggtgagcacatccggtgttacaagcgctggtacgccttgtgacaggcgggttaggaagagtggagactgctgcacggaactactgcgaacccctgaacatcatttcgatcggaaagaatctaacctctggtattgcgcgttgtgacaacactctttctcgatatcacatcccctggtccacgctcgcccgcccctcgaagacggtcctccatgcgcagttttggcctcttggtgatgcttctggtgggcgcgttgccagcggcgctcattagtgctcccatgatggttcgactcatcttcgatatctgagctggcgctgctgctctgccattgcgcgcctccgcatgtagtcatttgatggattgtggctgtaggttggctgaccacctctactagcctatggacagtcgtaccttgaagacatgacgtggggattctcgtggctcgcgatctgtagctattttgccatctcacagggcagcttcgtgcgctgggcccctcggccctcgcgatggtatattctagctaaatctagctttgtcgaacctcccttagttatgtcccgttgccctaactggccatttcgattggggtgctagctgggctacattgagtcgcttcacacctgtcttcgaccacgcttgcagtgtctcgtatctgagttcgccacgcgactgacgcgtgagcctcatcgctacttttgctgggggaagcgtatctttggaatgctctaggaccatgagactgcgtctgcctttgtgtcctatccctggtgcgcacatgtcttgctttgtagagatccagtgtggctttcccgcaggccgaaccgatagtaactgtggcgactgggtgggtgcatgtgtcggccttccgctccggtccctgattactccaacgttccaatttattgagcaaacggccggacgcatgggagattcag

SEQ ID NO: 531994 - DNA, 948 bp, Homo sapiens
tggaaaaggagtctcgccctggggcccaggctggagtgcaggggtgtggtctcggctcacgtgcaacctccgactcccgggttcatgccattctccgttgcctcagcctcctgagtggctgggactgtaggcaccgtgccaccacgcccagctgattttttggtattttagtagggacggggttccaccggtgtcggccaggatggtctcgatctccgtgacctcggtgatccgcccgcctcggcctcccaaagtgctgggattgcaggcgtgagcccaccacacccagccttaacacgggtctattaactctcaaaatggtccagtcgtgtaggataaattaactctctgacaatttcaactacgataccgtgccaacattaccttcgcaaaagaggcattctccgtaccacttataactcagtgcgtgcagactcaggaacgactttgtggggctcgtttgcgaacaattacgaaactctctctcacgatctactgcaaataacacttttagcggaagttattttctgcaaaggccaagcgcacaaagtggtagtgcgcgttattctctcatcaaaactttgcgaccccgcactgctcacaagcgcaagaatccaccacgcccaaaaagggaccttttctttcactgcggcccggaatactttacagctcgaacttagtggctcctcaagggcttagtcacccaatacaagtgtcgtgaacacccccccacaggaaacttcctgaagaaccagagcccagggtgtggacacgtggacaagagactgtgccaaaccacaaccgtgcaccgtgctcagggcgtcgggcaccaattgccagcgggcaaacacagcacaggcgaagcagcacccgcacagcgctcgcagcaactgcccaccgcactcgaagcaccaaacccttcgaagaacaacgggagactacaccaca

SEQ ID NO: 531995 - DNA, 594 bp, Homo sapiens
  misc_feature (461)..(461): n is a, c, g, or t
  misc_feature (499)..(499): n is a, c, g, or t
gggaacctgtatctccgtcattattatctgtagctcggattattgcaggggtgtgttctgctgagatgcacacaaaagtgaggctgctcatcgggtaaaagatgtgggtgaagaaaacaacagcggcttggtgtaggatggcttcgctcagtatcgtcaacctagctcatttgtagatcatgtacagtctacgaatgaagccactgaattcgcggatacacgtgttgctgatgagcaagctcataatggtgacaactcactatataccctcattggagacatataatgcacagatgtgactcttcgtgaagccgatggagggctgactgatggacgctcatgatcctgagagcaaggaatgcttctatgaacacatagatgacgaaccataccttccacgcatgagagaccatacgatgatgtgatgagcactgctattcatgacaatcgaaagacagttnaccaagaaagacattgtatgaacatgtcggaagacatncttacttttatggcacagaactgcgtctattcgtgaatggctggtgatgtacagaatgggccaagctgagattccagagactcaggagcgtcgcc

SEQ ID NO: 531996 - DNA, 479 bp, Homo sapiens
  misc_feature (7)..(7): n is a, c, g, or t
  misc_feature (65)..(66): n is a, c, g, or t
  misc_feature (68)..(69): n is a, c, g, or t
  misc_feature (85)..(85): n is a, c, g, or t
  misc_feature (91)..(92): n is a, c, g, or t
  misc_feature (94)..(94): n is a, c, g, or t
  misc_feature (97)..(97): n is a, c, g, or t
  misc_feature (101)..(103): n is a, c, g, or t
  misc_feature (113)..(113): n is a, c, g, or t
  misc_feature (118)..(118): n is a, c, g, or t
  misc_feature (120)..(120): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (138)..(138): n is a, c, g, or t
  misc_feature (149)..(149): n is a, c, g, or t
  misc_feature (160)..(160): n is a, c, g, or t
  misc_feature (176)..(176): n is a, c, g, or t
  misc_feature (186)..(186): n is a, c, g, or t
  misc_feature (189)..(189): n is a, c, g, or t
  misc_feature (191)..(191): n is a, c, g, or t
  misc_feature (201)..(201): n is a, c, g, or t
  misc_feature (208)..(208): n is a, c, g, or t
  misc_feature (213)..(214): n is a, c, g, or t
  misc_feature (226)..(228): n is a, c, g, or t
  misc_feature (235)..(235): n is a, c, g, or t
  misc_feature (239)..(239): n is a, c, g, or t
  misc_feature (241)..(241): n is a, c, g, or t
  misc_feature (243)..(243): n is a, c, g, or t
  misc_feature (249)..(249): n is a, c, g, or t
  misc_feature (256)..(256): n is a, c, g, or t
  misc_feature (265)..(265): n is a, c, g, or t
  misc_feature (273)..(273): n is a, c, g, or t
  misc_feature (316)..(316): n is a, c, g, or t
  misc_feature (325)..(325): n is a, c, g, or t
aaaccgncgcacacaccacttgtatctcctatgcccgtgtcaagcagcagcagggcggtgggaanngnngcacctgcactgtggnagcgannangantgcnnnacgtaaaggngtagnanttttnangngtgtgggtnggggggtcganccatgaccccntcccttgctcctttcntggggcggcngantngagctaaggntcatgancattnncaagatggtggnnnatgatcntctnantncatttntagggcngcccctgcncccttgcngtggtggacctcggtggggacgtctgggtggctttttagagcnggtcgtagnacgtagtccaggccctggcccagctcccagatagagaccccaacgcccagctcccgggccagctccagccgcacctgcagggacttcagggttgggtagaagacgacgtgcctcccactgcggctcttcttgtactcgaagaagtgctctgaga

SEQ ID NO: 531997 - DNA, 143 bp, Homo sapiens
gtgcactttctacacagatcactggcatccttagtgcttctcttaacactacagtaaattaatagaattcggcgggtcatcaattctatgacttgcctggctacgggccactttcctgtgtctcaacagaggaaattgaagtc

SEQ ID NO: 531998 - DNA, 237 bp, Homo sapiens
gtccgagacaaattagttgtggctataaaaatgattaaggatacgagtataagagatcaggttcgtccatttaatgttgtgtctggctatcatctgtctggaggttagttggatgagtcgtggctgggtggtgcctggcgagaccgctgacgagatatctggaggtggggatcaatagagggggaaatagaatgatcagtactgcggcgggtaggcctaatttctctcggaccaatg

SEQ ID NO: 531999 - DNA, 1131 bp, Homo sapiens
acccacgcgtccgcactgtggaagtttaagtggaaggagggaaggaataatgtcaacacgcatgcttcaggtctcattctgcccttactgccctgcagatggatatcacttggcatactagtggacgtataagctggaaggagggaatttgaaaatgggacgtgagtggtgcgtagagtttgtgttcataagggcttcggatgggtagacatgagggaatacaacattactggtagcatcggtgaggagcagttattcgctatcacagatggtttaaattgatgctatttcgagtatacctggttaacatggaccggcgcattatgaaattgggcatatagttgtcccctagtccatgtcacactcagcatataatctgtaagatctccgttagtgcattagatgctaatggatcatctatctaccagaatagaagcagctaggctgcacaggacacatgtttcctctggggctgttgctggcactaattggatgctccaatcagcagtattcaataagtccacaggtgtgcaacagccgcgaattggcctcgctaatggtctagatgaggccattcgttgcatctgggcattggttactcttctctgatggttccttgacccaacggaatctcaatgtgctcccctgatttttagaccccaccatacacgtatgccaggtctatgtgctagtgcttccggcatcgttgcatgggtgcatttggtattgaccgtattctgttgacacaggcaaccacatcgttgttacctggtaccaattgatggtgcgcaagcacgtaaagacccatagtccgagttgtaaaggaatctcccagctgcgcatgtaaccaatccagcgccgggaggttattgtaccctggccccggtgcaaaagtcctcagctgggagcgcaatgacaacggcgggtcagtagccccccggggcccttaaggatcactcccgggaacttcagaacccgcgcgacgtcacagggggaaagcccagcagccggggaacctccacgcagggatgcctgtacaaatatgcccagccctgttaatacgccacccatatgatggaccagctgccggagcgaacaaccccaggtcgcttcacccgcgattcatcaacg

SEQ ID NO: 532000 - DNA, 725 bp, Homo sapiens
  misc_feature (63)..(63): n is a, c, g, or t
  misc_feature (68)..(68): n is a, c, g, or t
accgtctccaacaatcccgccctcagtctccgaggaggatctcaaggtcctgttttccagcantgggngcgtgtcaaaggattcaagtcttccagaaggaccgcaagatggcactgatccagatgggctccgtggaggaggcggtccaggccctcattgacctgcacaacctacgtacctcggggagaaccaccaacggtgcggggtctccttcctccaagtctcaccaatctaggggcacaggccccacacggcccgggcaccctggcgacaacttccatcattccagagaaaagccacgtttagaaaacaggctgaagtgaccattagcagaccagagatttgacttgtcactaaagagaaatcaggtttaccatgttctcgtaaagaaaacttgaatctagttcaccgttgctcagccctgcggtgacagggacagcatcaggctcattggtagactcgtgcacaatcgcggagttcccggccctccacaaccactggggccagaacctcggggccatgccttggtggagactgtgtcgggcgtggaggcctagcaggtgggcagcacccagaccacgacttggcttccttgtgcattaagaaacctgccttcctgcagccacactacccacccggggtgtcctggggaaccaagggatggggaggtcacacaagagagaggcagggggcctggccaggctcctgcaggatatgcagctggg

SEQ ID NO: 532001 - DNA, 170 bp, Homo sapiens
ggctcggtaccttagagcttggcgggtgcgtggctgcgtggtcagtcggtgagctcctggcggtgcagggcaggcggtgggacagcttgtcccatcctcgtgcacctcgactacgaccagtctgtcgcaggtgctcaagcacttccccgagcgccagcgcaacgaagtga

SEQ ID NO: 532002 - DNA, 415 bp, Homo sapiens
  misc_feature (389)..(389): n is a, c, g, or t
acttaatcaacaatacatttaagtggtatgttatctcagctgatggaggatggaagtttcaaagtcatacaacttaccagtcacctcactgttcactacagctctcttctgagttgtggtagaaaagcatggctttgaagctgttgctacaagtgtttcctaaacactgatatgttcttccattcgatgatagtgggagcatgaacaatgacgaacacatgtgacataggcgaggggaacaactacacgctggggcctgtggaagaccggggtgagggagcgagagcaatcaggataaatagctaatgccttcgggggctaatacctaggtgaatgggcttgacaggtgaagcataaccaccatggcacatcaggtataatacccccgngcgggcgtggttttaccaagattcct

SEQ ID NO: 532003 - DNA, 330 bp, Homo sapiens
tcccgctatcacattatcggacaggcagcctgacccagatgagaacaaaccaaatggaagataaagtaaaggaaaaagctaagagctgaacatagagacaagcttggcagaactgagatgacactatcccacctgcctactgacttctcctgtcttgataatggtacatgacaagccagtgcagtcacctcacctacaaatcagtcgattgattcgaagactgctgatgatcaacgagcaccctagatgttctctctacgagagatacttggacaggtggtccctcccctacagaaacctcacagaacacagcaaaggataatgtgataa

SEQ ID NO: 532004 - DNA, 517 bp, Homo sapiens
agtcagtgcatctaattgagaaagaggggacagggaactaggaataggtgatatcggctgggacccagatgaaactgacgaatcctgacactgcccacgtcccttcagccacccttatcaggggaagtagcttgccctcgggtgttcgagaaagctagccttgctgggcttaaaatcatgtgctaccttcagtggaggcagatgtctgggagagggctcctcattctcttcaagagccagcatagaccccctcatggtcattagacccacaaggggggtaaaatctcagcatgtgccaggggcacagatccacagtgtgacccatgacgaaatagtttacagaccagaatgtaatcacgatagtgttcaatattctaggggagtgtattaacagagcatgtgtgggtatgcattatggggatgtttgaccaggaggatggaatagccaagtaaaaggggttaaattcatggatatgagtgacatttgttaaagattccagattcatgatgtgtcttg

SEQ ID NO: 532005 - DNA, 104 bp, Homo sapiens
cctgcatcaccttcgccacgaagctcttgtcggtggctttggggaaccaccactcctcgtccagcatggccagaatgcccgggggggctgctggcttctcaata

SEQ ID NO: 532006 - DNA, 167 bp, Homo sapiens
aggctgagtgactctaccccgcttattttttgtccctaaatccacacctgatgtatgtctctgagcagagctgcaggtcccggagggagcacttcagactcatgcatggtgaggtcagagaacaggataactgaaattctcctccacccgctacaatgaggccatgt

SEQ ID NO: 532007 - DNA, 214 bp, Homo sapiens
  misc_feature (8)..(8): n is a, c, g, or t
  misc_feature (21)..(21): n is a, c, g, or t
  misc_feature (32)..(32): n is a, c, g, or t
  misc_feature (51)..(51): n is a, c, g, or t
  misc_feature (53)..(53): n is a, c, g, or t
  misc_feature (88)..(88): n is a, c, g, or t
  misc_feature (113)..(113): n is a, c, g, or t
  misc_feature (123)..(123): n is a, c, g, or t
  misc_feature (127)..(127): n is a, c, g, or t
  misc_feature (136)..(137): n is a, c, g, or t
  misc_feature (139)..(139): n is a, c, g, or t
gaataccnaggttcctcagtnactcatctttnggtcccacgctggtttctntnccttcagaatggtcacaagcccggattggaaaggntctgcttacaaacctgtcccctgtnctccaacccnaaanggctttttnncngtcttaatatccagaaaatctaaatgcatcctaaaatcaatgtgaacctttaacaagatagttttacttattatc

SEQ ID NO: 532008 - DNA, 101 bp, Homo sapiens
  misc_feature (20)..(20): n is a, c, g, or t
  misc_feature (27)..(27): n is a, c, g, or t
  misc_feature (30)..(30): n is a, c, g, or t
  misc_feature (40)..(41): n is a, c, g, or t
  misc_feature (71)..(71): n is a, c, g, or t
  misc_feature (92)..(92): n is a, c, g, or t
ggcacgaggtaaacaatgtngtaaagnctntcagatgttnncacctccatttcaaattcatgaaagaattnattacttggaggagaaggccntattaaatt

SEQ ID NO: 532009 - DNA, 262 bp, Homo sapiens
aactttctgtactgtttttcttatagtctaataagtaaaaagtgtccttcaaattatgataattgcctattaaggcatgtgccttgccctaacaactcactgcagtctcttcatagacacatcttgcagcatttttcttaaggctatcctacagtttttctttgtaagccatcacaagccatagtggtaggtttgccctttggtacagaaggtgagttaaagctggtggaaaaggcttattgcattgaacaacggtctctca

SEQ ID NO: 532010 - DNA, 392 bp, Homo sapiens
  misc_feature (263)..(263): n is a, c, g, or t
  misc_feature (287)..(287): n is a, c, g, or t
  misc_feature (357)..(357): n is a, c, g, or t
tttcctctagaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttgggggtgtcctgttgattgaggggtgacagcatgctngcagtcctcacagccctcactcgnttcggtcactctcggcaactcctcttgcctgggggtcccacttttggcagcattttaggagccccttcanctctgtatctaggctactctgatggggtcccttgg

SEQ ID NO: 532011 - DNA, 784 bp, Homo sapiens
  misc_feature (28)..(28): n is a, c, g, or t
  misc_feature (65)..(65): n is a, c, g, or t
  misc_feature (69)..(69): n is a, c, g, or t
  misc_feature (71)..(72): n is a, c, g, or t
  misc_feature (74)..(74): n is a, c, g, or t
  misc_feature (76)..(78): n is a, c, g, or t
  misc_feature (80)..(81): n is a, c, g, or t
  misc_feature (97)..(97): n is a, c, g, or t
  misc_feature (116)..(116): n is a, c, g, or t
  misc_feature (121)..(121): n is a, c, g, or t
  misc_feature (157)..(157): n is a, c, g, or t
  misc_feature (221)..(221): n is a, c, g, or t
  misc_feature (261)..(261): n is a, c, g, or t
  misc_feature (264)..(265): n is a, c, g, or t
  misc_feature (270)..(270): n is a, c, g, or t
  misc_feature (281)..(281): n is a, c, g, or t
  misc_feature (288)..(288): n is a, c, g, or t
  misc_feature (299)..(299): n is a, c, g, or t
  misc_feature (306)..(306): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (348)..(348): n is a, c, g, or t
  misc_feature (355)..(355): n is a, c, g, or t
  misc_feature (372)..(372): n is a, c, g, or t
  misc_feature (378)..(378): n is a, c, g, or t
  misc_feature (403)..(403): n is a, c, g, or t
  misc_feature (414)..(414): n is a, c, g, or t
  misc_feature (425)..(425): n is a, c, g, or t
  misc_feature (569)..(569): n is a, c, g, or t
  misc_feature (597)..(597): n is a, c, g, or t
  misc_feature (608)..(608): n is a, c, g, or t
  misc_feature (635)..(635): n is a, c, g, or t
  misc_feature (667)..(667): n is a, c, g, or t
  misc_feature (669)..(669): n is a, c, g, or t
  misc_feature (681)..(681): n is a, c, g, or t
  misc_feature (703)..(703): n is a, c, g, or t
  misc_feature (741)..(741): n is a, c, g, or t
aacgcaaacgcgccctgaaaatgaaccntccagggccaggagaggcacatgagggaggggtcggnacanannantnnnanncgggcacctagaagcnacaactaccctctacaganacggnactgcaccatgcgcaggaatgtatcgacacttgtcnatgatccttcctgaagcagtaagagcagacccgtagttactatgagcagtgcgtaaaggttgtntgagtatgtgttaaacttgctgtaggtctgcttgaggatntgnncagtncggcggctgcngtcttcnagcatccccanaagcgtntggatagccttcntntangtcntttaggaggtgatagtaatngctgttngaggtgtaataaaccangttgtnggggaacataatcatgaggaaccgnaagggctcaanaaacgaatgangagcagaagggagatgcggagagctctagattgagattaatgttgcgtttactccatgttgagagggtgttggaatagagatatgagagaagaaggaggtatgggagttatgcaggaatgaatacttctggtcctttgggatanaggtttcttcaaactcctggtaggtgtnaatggccagcnggtgcgcgcgaagggcttggagcatancgtgagtcaaaaagcctggataacggaaggtntnggacggcaccancctcttgcaagccagggcaggnagagcagggcaaaagccaggagcagggacgtccgggancctgccgccattgccactaggtgagccgtccacaggaccctga

SEQ ID NO: 532012 - DNA, 483 bp, Homo sapiens
  misc_feature (56)..(56): n is a, c, g, or t
agatgaggcagacatcgcttgaacccaggaggcaaaggctgaagtgaggcgagatngcaccattgcactccagcctgggtgacagagcaagacttgtctcaaatttaaaaaaaaaaaaaaaagaaaaagaaaggccaagaaggaaatctaacttatcatggagacgtaggggcttcacctcctctcatgaagaggcgtggctgcaggcgggtgaggtcacccgaccgtctgactccagtgaggccaccaaagtgcagccatccacacagccgagggggccacagcagaggcgctacccagcaggggttgacgggggggtccggtgaacaccccagcagcgagcagaggtcagggatgtgagcagggagggggcacaggtcccccgtagagtgacgcagacagggctgctccacagctcaacagactctcaggaacttgggcttatcagatcaaacacagaccacaggagctggaagctcgtca

SEQ ID NO: 532013 - DNA, 858 bp, Homo sapiens
  misc_feature (70)..(70): n is a, c, g, or t
  misc_feature (72)..(72): n is a, c, g, or t
  misc_feature (76)..(76): n is a, c, g, or t
tacatacacaccacgttgcgagccacccaccctcccactttgaaacattttaggggctgacgcttagcananttcntcaggcgaagaccaccatttaaacataagttggaaatctacattttttaaggaacccactcaacacaagaagacatcaataagcagataaatgacaaagagcgagtggcagctgcaaaggaaaaccccaacttacgggaaattgtggaacagtgtgtccttgaacctgactgatagctgttttaagagccactggcctgtatttgtttgatatatttgtttaaactctttgtataatgtcagagactcatgcttaatacataggagattcgtacctcagaccattatttaaaggattctttccaagccagatatatttataaggtagtacctatattgatcaatgtataacattctcaggatttgtatcacttaaatgatcagacagattaagttccctctagttatcatgtgtaacatgagctgctattcctctagatacccaatctgatacaactatctttccgtgtcaaatgtctactgcgcctcaatgttctcgattaaaagcatcactcctcgaaaagaaacaaacctctcatccttttattgacaaactcccatctcgctggcctattctgacctcactagtaggatccattctcgtcaattcccctttaaaggaagtgtcctctaagaatacacagccaataaacttaatgtacctaccgctattcgcttccatacttccccgttgaccctaattcttataggcgaaaatggatttatcatcataacttggtgattactccaaatcgacctcgctgatcactggatattaaagac

SEQ ID NO: 532014 - DNA, 475 bp, Homo sapiens
agagaagtgaaatgtataaaacgaagtaattctggggaaggaaaatgtcacaatttttcttcagtgttgtcaggcacactaacccgggaagccgtctctgggcctgaactatgcaaattagtgtccgaggaagtgtgacaaatgcaagcccttccaagtttgaccctgattcttaaaggtggccaaaagccgactttagaaactgcggtggcagcggcgtgattctgggagggccattcaacttttaaacaagtcctggggctttgaaccggtttgcttgggcaatggcaaaaggcattacaatattggcgaagaaacaagccgctgatcaaagcttttcctggccaggggttaaaagtcccatcaactttggaaccttattgaagcccgggccctgttaagaagtgaaaaaatggttcttcgccggggccccggcccgtgaaaccgcctctcccaaaaaaacaccgggggattt

SEQ ID NO: 532015 - DNA, 838 bp, Homo sapiens
gtaagctgtaataatttaaagacatactgaaaacactcaagcaacactaaaaaaataaaaaaaaatatatatatataataaggcagtttaggatactaaatgaattaaaaaaacaaacaaacaaacaaacaaagagttaatccaagatttggcaggaaaagagaaaagatgggatagagaacaaatggaatagagaagaaatagcaagatggtaaacttaaactcaaccacataaataattacattaagtgtaaagaagctgagtaatccatttaaaagacacattttgtagatggaaaaagaaagacccaacaatatgctgtctacaggaaatgcccttttttttatttttttttgagacagaatctttctgttgcccaggtggagtgcagtggtgcaattatggtcactgagcgtcaactcttaggctcaagtgatcttctcacctcagctcctgagtaccggagaccagggcaagtgcacaaactggtaatttttaaattttgtagtgatgagattgtaccatgtggtccaggatggtcttgaatcctgggtcaaagtggtcctctgtgctttggctcctcaagtcgggatttacaggtgttagccactgggcgggagaatgcgtttactatacggtattgatcaacgtcaacgcgaccatgtttctggtccatatgggaagggtgggataactaaaaggaccgggaggggaacctccaaaggatcctagtgaagggtgcccaactaaaccacgttgcaacgacatggcggaaaattctttggggcccttaaacacacgggggtataacgcttataaccccaacacccgcgccca

SEQ ID NO: 532016 - DNA, 925 bp, Homo sapiens
  misc_feature (260)..(260): n is a, c, g, or t
ctgtcgcagtctgctggtgttgcggcgtcttcgtgggcctgtcttgtcgtttgctgtgtcgtgctgtctgggcgtgagttggtgcgtgccggtggggagacgcggccccgcgtgggtgcggccgccgtggtgtttctctccgtcctattggaggggctgctgcccacacgtgcgagtcggtgtcgtcacttcttggtggggaactcgtcccagtgtttgtggtgccaacactgttcgagggttcctttgtcggcgcgcgnacatagctcggggttttgcccctttagcgcggcgttgccagattgtttcctattcaaccgcccttgggtaggggttgtcatccctacgcccgtgcgcgcggtgttgtaggtgggtcggggtcttgtacccccaacgggcgatttgaacccctttggtgctgagataccggggataatcccccttggtgtggagcagatttatgttggtagctagaataagagcgccatgtgctggtatcgtggttatgttcgctgcgccctgacgcgctagtggtttctgccccctgctacagagtacggctcattcggccccgtatgtccggtccccccgggcgccgccctcggagggcagagcgccgcgcctggactccgggttttggcccccatcggcctatctgggtcatctcgcgaatactagtcgtttcgtgtcccctccacttgtagccggactactacgcacttcagatacctagttatgatccaacgtgcataatgtttaactctcccgcccaggttactgttagcgcccctactggtacaacggctataaatcaatcccatgtgtgtacaaacacacggagcccccccaattgctttcgcccacctcgtctttccccttcccctcttcttccttctttcccctttaaaataaaatctcgcccaca

SEQ ID NO: 532017 - DNA, 219 bp, Homo sapiens
attggcaatgagcgcttcgctgtcctgagacactctaccagcctccttcattggtatggatctgctggcatccatgaaacaccttacactagcatcatgagtgtgacattgatatccgcaagacctgtatgccaccactgtctcatctggaggcacactatgtacctggtatgctgatcgatgcagaggaatcatgctctggctcctagaccatgagat

SEQ ID NO: 532018 - DNA, 178 bp, Homo sapiens
tcaggtggtcatagaactcagtccaagtagctgaggacgatgtgaaatggacctgcagtctacaaattttggatgtgtcgtttgtatttaatttgttttatggtatttattttttttttttttttttttttttttttttttttttttttttttttttttttttttttatttttttttt

SEQ ID NO: 532019 - DNA, 1021 bp, Homo sapiens
  misc_feature (231)..(231): n is a, c, g, or t
gagaagcgtgattgcctcctctgtccgcgcatggagagtgtgcgctccatggatatcgcgatgtgactcgcgaaaaggggtgagtcgtctgggtaaaaatgtctgtttgcctgtgtgtatacactgctcctatacggaccaagtagtagtagtgaagcttatgtgacagtcacgaacttgacgcttaaagacaaattgagcatgccctatgcgtgtcagtgaattagcgangcgctcatcacacgtatgggctgaggtcgttgaggagtagctggaaggcagctggggaatcgtagtcccgagacgtcgaaggtgggtggtactccagcgatctggcgcagggctgcttgtaggacaacgactgcgtcggtggatcgtgcgaattggttcgctacccaaaccaaatacgctgggagccggttagggcactctgtgagacgtgaactactcacacggaatgtactgatacgctcagtctggtactggcgccaggttgccctgcatgccctgacgctaggcagatgtggtctagtgtctcaaagcgtcggtcgtggtgtgatgcgaccgttcgtgccacgttcctctgtgtgagccagtgggaaggataaaatgcttgaagggcttgcacgcaatgaaccactggaagagctgatgtgctcccttggggaacacttgtgggcgtgcaatgtctatcgaatagggtcgatgacgtatgagcgaatggagagactgttgatgggtgaaacatgagaaatcgtccgacgatatgaagggcagggggcctgaggtgcaatctgatgaatgaggcggacggtatcagggcaaggactatgagaaggaagccggcagagtatggttgaaagtaagacaacgcttagaatgttgattgtggccctgtggaaatattgtggaggttgttgtgaagagaggaggagtgccgacgaaaattatagaagtttgggggagtgcggtgagaagagtctagaaaagaaaattttcgggacaagataaaaaagtgtgg

SEQ ID NO: 532020 - DNA, 423 bp, Homo sapiens
  misc_feature (415)..(415): n is a, c, g, or t
aaattcccaagacaaaaattaaaaatttccaagaggaccacccagagaacattaaaccccaagtgctgaaaccttgtgagcaaaggtgctgtattaagtacactggtcacacaccccatgagcccaggcttgctaaatggttgttcaagactatcccacaggctgggtgaggtggctcatgcctgtaatctcagcactttgggaggctgaggcaggaggattgcttgaggccaggattttgaggcaagactggagaacatagtgagaccccatttctataaaaaatttttacgaatcagctgggtgtggtggtacacacctgtagtcccagctacttggaaggctgaggtgagaggattacttgaggccgggagtttgaggctatggtgagttatgatcatattctagcttgggnaacagagc

SEQ ID NO: 532021 - DNA, 498 bp, Homo sapiens
ggaaaggagggcccagtttagcctccacgaccctcggcttcctcctcaccagctccccctccctccaagtccagtatgaagttgggccaccctggaaggcattgaccgggttgcttgtctggagatggctccactacatgcggacctgggcgcctggagtcgggcatgaaagaaaatagcgcctcatcgctcttatctaagcccacaggcagacttctcttgaaaagatcgagaatggatgaggggatcggcactcacttgcagacatcaaccgtctccagaaaatttggttcaatttcttcaccaccgaccctccaaccaaggagctggcaaatcccactaaccaaccatgagaacacagacccggtttgtcttttgaccaccgagtggaactgacggggcctgcgcctgccctgcgggtcccctaccttggctgataagatatccccttaaaccttggacagccttggcgacttacttgaaaaatattcctttact

SEQ ID NO: 532022 - DNA, 408 bp, Homo sapiens
atagagtgatcccctagtgcgcttgttgtggccggggaggggactccctgtgagatgaagtggatgccccagtgatacactgagctctggctgccaaggcatggtgtggggtcttccaatgcactgaaacagatctgtgctctggatcagctctacccccaccaaacagatggagagacagacagtgcagtgcagcatatctgaacccagtggaggggaaaaccacacgtgaggactgcgcatcttcgctgcccgcatctattattacgaccccctatataagtgagtgcgctgcaaatgcttgcgtggatgctgggtgcccaagtctccatcatgaactacgaagaatataagcactgctgggacacctttgtggaccaccagtggatgtcccaacaaagcgcctgg

SEQ ID NO: 532023 - DNA, 619 bp, Homo sapiens
actaatatttctggcgcagtgttgctgagcttacaattcagataaatgagggaagcagcttctcccacctctttactttggtcaccactgtggcaccaaggtggtctggccagacggcccacatcctccttgtgtttccccccctctcctctgtatccttccctctgcctttattaataccatcccttgtgcctaccaccctccactcttcctaagatttcttattgccttctaaaccataccctcttcctttcccaatgcttttcttttcttttctttcttttcttaggtagggtctcactctgttgcccatgctggaatgcaatggtgtgatcatggctcagtgcagcctcaacctcctgggctcagatgatcctcccacctcagcctcctaagtaactaggactgcagactcctaagtagctggaccaagcccaactaatttttgtattttttagtagagacggggcttcaccatgttggccaggctggtctcaaactcttgacctcaggtgatccgcccatctcagcatcccaaagtgctgggattacagatgtgagccactgcacccggccaagctacagtttacttctgaaaatcaatgagagttcaaatatt

SEQ ID NO: 532024 - DNA, 385 bp, Homo sapiens
gttcccataatccccatatgtcatgggaagcacccatgaatataattcaggtaactgaattatggggggtggttacccatgctgctgttctcatgatagtgagtactcatgagacctgatggttttataatggggcattttccccgtctttgtcttggcacattctcttcctactgccatgtgaagaaggatgtgtttgctgcttcttccaccatgattgtaagtttcctgaggcttgccagccatgctgaactgtgagtcaattaaacctctttcctttataagttacccagtctcaggtacttcttcatagcagtgtgagaacagactaatacagtaaattggtagcagtagagtggggtgttgctgtaagataccagaaaat

SEQ ID NO: 532025 - DNA, 938 bp, Homo sapiens
gagacccctcgtgtcttgctatgctcgaggtctcacccgtgaagcgtcatgaggatggagatccgcagctggaccatgtcaagcagttcagccaactcgtggtggttcgacaccgggcgacttcccatggaccaatcgacgagtacaagaccccaggatgcataccaacactaaccgcgctggctccctctgtagtactctgcgagcggtctacgccttatcgaggatagcccccgcattgaacccacgaagcggtggtgtggagcgaggcagattgctctatggtcggagagctgggcgtggtctcaagatggaccagattaatcaatcgctatttaggtactaacatcttattagttgttgtctcggagcagaaatactaagattaaagattccaggcgctcgagtatcctagcgatacatgctagatcgacacaggcctcttccctttgatacaatatgcagaatggtgtccatgagccaggctcgtgtcattcgacgctcctatcatagggacatgctgggcatcgagtcaaagggaccgagattgtctttgttaacgactgctgtcacctcgtgggacggaaattcgaggcttggaaaaagcgacgctttgatggagacagcacggggtccactgtgcatatgactgtttcctcttctccttccgcccaggctgtaggccttgttgcccgtggccggctgtgatccttcatctcccccatttgttccggggcgccttcttggcttggcttgctggcaatatctgccgggaacattctattaggcccctgtgatacctgtggtaccgtgttctcgtcgcacttcgcccaaagttggctccaacctttgtcttggggctcttcggccggggggttatccggcggcgctcctccccctcccggcgggggttcgccccctgctgtccgccctttaac

SEQ ID NO: 532026 - DNA, 132 bp, Homo sapiens
acgcaaagccgatcatacacctgaaatctgagatcatagtagctacagttatcaatttgttgaaagaccccaggatggccagggcacggtggctcaagcctgtaatcctagcactttgagaggccaaggtgg

SEQ ID NO: 532027 - DNA, 959 bp, Homo sapiens
  misc_feature (135)..(135): n is a, c, g, or t
  misc_feature (187)..(187): n is a, c, g, or t
  misc_feature (217)..(217): n is a, c, g, or t
  misc_feature (219)..(219): n is a, c, g, or t
  misc_feature (224)..(224): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (269)..(269): n is a, c, g, or t
  misc_feature (295)..(295): n is a, c, g, or t
  misc_feature (302)..(302): n is a, c, g, or t
  misc_feature (311)..(312): n is a, c, g, or t
  misc_feature (327)..(327): n is a, c, g, or t
  misc_feature (331)..(331): n is a, c, g, or t
  misc_feature (344)..(344): n is a, c, g, or t
  misc_feature (347)..(348): n is a, c, g, or t
  misc_feature (350)..(350): n is a, c, g, or t
  misc_feature (353)..(354): n is a, c, g, or t
  misc_feature (358)..(358): n is a, c, g, or t
  misc_feature (360)..(360): n is a, c, g, or t
  misc_feature (389)..(389): n is a, c, g, or t
  misc_feature (395)..(395): n is a, c, g, or t
  misc_feature (401)..(401): n is a, c, g, or t
  misc_feature (421)..(421): n is a, c, g, or t
  misc_feature (466)..(467): n is a, c, g, or t
  misc_feature (490)..(490): n is a, c, g, or t
  misc_feature (494)..(494): n is a, c, g, or t
  misc_feature (496)..(496): n is a, c, g, or t
  misc_feature (498)..(498): n is a, c, g, or t
  misc_feature (500)..(500): n is a, c, g, or t
  misc_feature (889)..(889): n is a, c, g, or t
  misc_feature (953)..(953): n is a, c, g, or t
gcccgatccgcgcccgcgatgctggcgctgcgctgcggctcccgctggctcggcctgctctccgtcccgcgctccgtgccctgcgcctccccgcggccgcgcctgcagcaagggctccggcgaccgtcctcttcntcctcctcgggaacccgctcgtgtacctggacgtggacgccaacgggaagcngctcggccgcgtggtgctggagcagaaggnanaagtngtcccaaaaaaagcaganaanttnananccctgtgcactggtganaagggcttcggctaaaaaagctccancttccanagggtgatnncttccttcatgtgcnaggngggcgaattcacnaannanaanngcanangcgggaagtccatctacggaagccgcttncctgangacaantttacactgaagcacgtggngccaggtgtcctgtccatggctaatgctggtcctaacaccaacgnntcccagttcttcatctgcaccanaaanananantggttggatggaaagaatgtagtgttcggtcaagtaaaaaagggaatggacgtcgtgaagaaaatacaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaancattgcctgtgattgcccagcccagattcatctgtgccttggacatggtgatggtgatgggtgncatcaa

SEQ ID NO: 532028 - DNA, 1013 bp, Homo sapiens
  misc_feature (135)..(135): n is a, c, g, or t
  misc_feature (443)..(443): n is a, c, g, or t
  misc_feature (449)..(449): n is a, c, g, or t
  misc_feature (455)..(455): n is a, c, g, or t
  misc_feature (475)..(475): n is a, c, g, or t
  misc_feature (520)..(521): n is a, c, g, or t
  misc_feature (544)..(544): n is a, c, g, or t
  misc_feature (548)..(548): n is a, c, g, or t
  misc_feature (550)..(550): n is a, c, g, or t
  misc_feature (552)..(552): n is a, c, g, or t
  misc_feature (554)..(554): n is a, c, g, or t
  misc_feature (943)..(943): n is a, c, g, or t
  misc_feature (1007)..(1007): n is a, c, g, or t
gcccgatccgcgcccgcgatgctggcgctgcgctgcggctcccgctggctcggcctgctctccgtcccgcgctccgtgccctgcgcctccccgcggccgcgcctgcagcaagggctccggcgaccgtcctcttcntcctcctcgggaacccgctcgtgtacctggacgtggacgccaacggggaaagcccggctacggcccgccgttgggtgcttggaagcctgaatggcagattgttcgtccccaaaagaacaagctgaagaaactttcagaagcccctgtgccactgggcttgacgaaggggctttcggctaccaaccggcctccatcctttccacacggggttgactcccctttcctttcattgtgccaagtgcggcgcgactatcaccaaaccaccacatggccaccaggcggggaagtccatctacggaagccgcttncctgangacaantttacactgaagcacgtggngccaggtgtcctgtccatggctaatgctggtcctaacaccaacgnntcccagttcttcatctgcaccanaaanananantggttggatggaaagaatgtagtgttcggtcaagtaaaaaagggaatggacgtcgtgaagaaaatacaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaancattgcctgtgattgcccagcccagattcatctgtgccttggacatggtgatggtgatgggtgncatcaa

SEQ ID NO: 532029 - DNA, 884 bp, Homo sapiens
ggagtacctgtggcaccatcagagccatcagcgtgacatcgtgcgctgtggtcttgataagtgatgcgatggcggtgtcagcttcccagtggctggccccagatgaccggctttctaggagggttcgagaaactcctaaggggtcttccagagttgggtcattgcgccggtgacaagagtgcagcgccatcactataccgcttctctctagtgcccatctcagtcgagcttaaccgaagacttccctgagccgagcatggtgctgggtgcgtgggctgatgcagggaagttctagccggtcctgccctgaagaaagtgaccctgtgtgcatgcatgagagtgagcagtcagttcaatactaggcctcctatctccagagtacacaagaggactggattagccgggcatgggtggtgcacgactgtggtccgtggctactgtgggggacgtgaggcgtggaggatgcttgaggtcaacccaggaggtagaggctgcagtgacgccaagatggtgccactgaactgcaagcctaggtgacagagtgagaccctgtgccctcctccccaacccccgcaagaaaaaagggctgggagtgactgagggctacgactccccagggtaggtcaggaagagcttcctggaggcggacagcacatcacgtggagcaatgatccactgtagtgtgagctatagtgtccatcaggtcgtctaatccacagaggaagatgagtagctggagcaggaatcggtaacacgggggacttgggctcaaagggcattagggtaaaaggggaagcagattggccgataagcctggcggcacggatgggtaccccagggccccgggggaacgcccagcggaggccagagccgggggcaagaaa

SEQ ID NO: 532030 - DNA, 222 bp, Homo sapiens
gtcaatacactgctgttgcgcaacattgaaccggatagcttgcctgggaagagcaatcccaagacacatagatttggtcttttcacatagtcccatatttcttggaggctttgttcatttctttttactctttttttctctaaacttctcttctcgctttatttcattaaattgatcttcaatcactgataccttttcttctgcttgattgaaccggatagc

SEQ ID NO: 532031 - DNA, 623 bp, Homo sapiens
tcagcaggagaatcgtatactctgggagagagggcaagtagagacaggtggggccgaagggactggtgatgccgtgtatggggaaaaccgtgcttggaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcaagggagaactgggcaatgaggagagcttggatagaaatgaggaggacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaagggcgcta

SEQ ID NO: 532032 - DNA, 258 bp, Homo sapiens
  misc_feature (34)..(35): n is a, c, g, or t
  misc_feature (66)..(66): n is a, c, g, or t
  misc_feature (89)..(89): n is a, c, g, or t
  misc_feature (144)..(144): n is a, c, g, or t
  misc_feature (147)..(147): n is a, c, g, or t
catcggtaaatagcgacgcatatccctttcagcnnaagcccgtctggcatatgggaggtgcaccancctaatgcagcaagcttgttaantatatggattcctgggtcctcccatggaaatactgattcagtagaatgggggtanggnctgggaatccgaatgtgaacaccccaggtagcctgggctttggtcatggagcagcagggcttctcaacgccctttccttcttcacctctagcctgtacccctcgcctcctc

SEQ ID NO: 532033 - DNA, 410 bp, Homo sapiens
  misc_feature (366)..(366): n is a, c, g, or t
cctttaattactgaaggagagaatcaactctgtgattcctaagttataaacccaccgttattaaagttcctactggagccaaaactcccaaattgttctgtatattaaaacttttcggcagggcatggtggcttacacctgtaatcccaatactttgggaggctgaggagggcagatcacatgagcccaggagtttgagaccagcctgtgcaacataggaagaccctgtctctacaaaaaataaaaataaagttagccaggtgtggtggcacgtttctgtggtcccagctcctcaggaggccgaggcaggaggatcacttgagcccaggaggtcaaggctgtagtgaactgtgatcacaccactgnattcctgcttgggcaatggaacaagaccctgtcttcaaaaaaaa

SEQ ID NO: 532034 - DNA, 681 bp, Homo sapiens
cgtgttgcattgacaacgggaatcccagagacctggtagtgctagttggtctatcaccaagcagatggagacctcgaccgatgctgggcaaacacggtgatcgcccgcatctctagcattgaagctagcatgaaacttacggtgggacgctcgtcgagtggggcaccatggtgcgtgcgcgcaagactacatcatcggagtgacttgaccgccagcgaggtaaccggggatgatagactcgcgtcatcacgagcatccttctgacgattagagacccatcattgattggtggatgacatgtccacggtgcgtgtgacgaccagagtcagtggacttgtcctccaagcgttgctctgcggggggtacactcaccaacttttgtttagctgactgctggttactctcgctacagaatgtgccaagataatgcccctcctcaggggctccctggggactggaaccgctgacgcccatctggggagtctcaacaagtgtcaatgtagcatgctccacggttagcatcatggaggcccttgcggaatgacatcctggtgcaagaagctgacgcgtggaagtgcaattggggcttgttttgtccccagtggcgcacgattccagagtccaatgtgggggcaacttggagagagcagtagcaacaccgtacacgaagactgttccggc

SEQ ID NO: 532035 - DNA, 140 bp, Homo sapiens
cgagttagtccaacgctgtggaagacacaaaattgttcaaggaatggtttcgaagaaatgtaatgagaacgacatcaggatgatgttctctccattgtggccagatagaagaatgcctggatcctccgggtgacctgatg

SEQ ID NO: 532036 - DNA, 324 bp, Homo sapiens
ccttgaagatgccaaagagactggaagagtcttctctgatcattataaaaggaaagagctgggagtcgggggacagagagagctaacacagcttctcctcctactcaggtatatctactggattcaagtatcagacttgcatgcacaacatacatacctggcatgcccacacggacacatacacatacacacaccgaccatgcacacagaggcacacacagacatgcatacatacacacagctgtacaccacccctgtacacaacagatgtgcaggcatgtgcaaagaaacatacacagatgtgcacacgcaacaaaaccctgg

SEQ ID NO: 532037 - DNA, 241 bp, Homo sapiens
ggtgatggacttagctcacatgactgacaccacacaccactgtcacgaggtgaagaaatgagcgcggtgcaagccagcctggagccccgaggaggctgtgcctcctcttcaagagtgggaggtgtggcagtgcctggagtgttggggtgcagcctggtgaacacctccagcttaatagtgctgtggttagagcacgaagacgtggactctgctggcagcagcccccagccctgacctgctc

SEQ ID NO: 532038 - DNA, 457 bp, Homo sapiens
ggcactttcttctctccattgcctttttctcatgacttgggtaagggtctgccgctcttcctcaccttccgggtcgggccttcggcattctaagtggagctttctggagagggagccccgttctaagggcactgagagaggagtggctgaagtgagaggtaaccaggaaagcaagatcagtccatgcccacaggccatacgtgccaggtggccgacaggagatgctaatgtgcttctacgtgaggcaatgcaagcataagaagggaggtcgcaaatggagacacacacccgctagcttcacacgccgttcccatcaatctcgttgcaaagaaggataatcatggaaaatcattaaaatgacagatggctagattaagccatgagaagttaggcaagagcagatgtatgtaagtgagtgtccgtttctttgaataaaatccacattgtaaaaactaaa

SEQ ID NO: 532039 - DNA, 83 bp, Homo sapiens
  misc_feature (53)..(53): n is a, c, g, or t
ttagcttagtaggaaattgttattattaaggtttaaaaatgagaacaggtgtnttttccaaaatacttaaaaataatagtgtc

SEQ ID NO: 532040 - DNA, 597 bp, Homo sapiens
  misc_feature (469)..(469): n is a, c, g, or t
ctcacccggagggggtggggggaagggtcagccgtcaccctgagaggggcgggggtggatgggaacagcctccggggcctcggactggtctgggctccgggagcgcccccgcccgggggtgggagctcaggcgggggcggccgttgaggaggaggagcgagaggtggtgcgggtccgagtcaagaaatgtgagagcttctggcggccagagttccgctcttgggctgtagatccccagatcacctcgctcgaggtgtggcagcacatcctcatccgagccttggattggagtggaaagaagacgttgggcatcagctaccggggccgggaccggctaggacaggaagtttacctctcacttctatcggagggggacctcagcacagccttggccactgcctccaaaccttaccggcaatggcgtgtagatatccggccctcggaggacagcccatggctagaggacggngacataatcagccccaaagatgtcatgggctccgatgtgtggctggctgagaaccggtcatcactgacgagggccgccctgccctttacacagtccatcctcactcaggtgggccgtaccttgtctaa

SEQ ID NO: 532041 - DNA, 458 bp, Homo sapiens
accttttaatgtaaagaaacatgtactaaatttgaatgaaactgtgacaagtatcattcaaattttagtaaatgttattttacatttaaaaatggagttctttgtaggcttttatcataattgagcagttagtcttattgagagtatttgactaggtttactgtggaattgcattgtttacacaactaagaatgtttacggagtgtatgaaggggtggatcagttaacctttaagatgatcacagtggaattcccactttaggattttacagtagtagttttgtcgtgggatggggcttaataacccaaatcattggttccgtcctcccaccacaaacgtgggatccgtgcacgttaacgattactaggactatgcagaaacctagagagattttttttttttgtgtttttttttttttttttttgtttttttgtttttttttttttctttttttttt

SEQ ID NO: 532042 - DNA, 191 bp, Homo sapiens
atggggccttattcccacatgactaatattcttattaatatggggaagaaacaggataccaacacatctcatatatctctcccccttctctctctctctctctctctctactctctctgtgtctctctctctttcccacttttacacagaaataaagcccactattaggacacgagtgcttccggggatcc

SEQ ID NO: 532043 - DNA, 483 bp, Homo sapiens
  misc_feature (163)..(163): n is a, c, g, or t
  misc_feature (212)..(212): n is a, c, g, or t
gtgagctgatcagtactggacatgtgcttttatagcaggagcagagacagctttgccctttctgtgctgaggactacacagaaagtctgtcagctcacgatgctgagatgtgcgttaaaaactactatgaagtcacaagcactccttgaggtgtcagaagtgngaagaaactggaggctttcttagagtttgagagaaaagcttcagatccnaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggccagcaccatgggagatgcatcgattggagaaagagagacgcacgcaggaaagacacctgacgaaccaaaaacagacgagacagagatgctgtatggca

SEQ ID NO: 532044 - DNA, 178 bp, Homo sapiens
tagcaaagtgctccttctctctctactacagaaaggcaaaacaaacacaaatcattttcccttctctctgcagctctcagaggcatttctcaccctcggcccagggtagggcaggtctagaagaatccacccccagctgtgattctcccagccctacacctgggcacacattatggag

SEQ ID NO: 532045 - DNA, 612 bp, Homo sapiens
  misc_feature (612)..(612): n is a, c, g, or t
tatgggcttgggtgagggaggtaggtgggtagttggtggtttaatatttttagtggggtgatgaggaatagtgtaaggagtatgggggtaattagtgggtgggccatacgggtagtatttagtgggggcagtggggtgtaaattattccctttttctagtttgggcacagtgcaggtagtggggtgaacagagagaaccgagggagggtaacaggaagaggagggacctacgtgaacccagagttcaggaagagatttaacactaaaatttccactcagtgccgggccggtgggggcacgcgccgtgttaatcccgaggctacccagggaggctgaggcaggagaaatcgctggaaccggggagggtggaggttgcaggtgagctgagaatcacgccatggtactccagccggggcgacagagcaagacctccattttcaaaaaaaaaaaaaaattcccctctgtataaagggggagcctcagtttcaggggcccatttccaaagggggtaccccactcctcattgggaaccctcaaggggatagggcagtgaaccctggatgagcaagatttataaccggggggagcctttaagtggtcataatctgggan

SEQ ID NO: 532046 - DNA, 193 bp, Homo sapiens
tccatctccttcgttggacaggtgtgtagtctttctctatgatcaggaacttgcagtccttgtggaaaaggtcatcgctctgcacacttgttgtgcaggctggggaggtggaacagccagtgtacacagccgcaggactctggggcatgtttttcttcaccccatatgctgtggaagtggtggtggtgccatt

SEQ ID NO: 532047 - DNA, 151 bp, Homo sapiens
tgattgtatcgcattatttggattccaagttatggctatcataaaaataatgcagtgctaaaggaaacatctttcaacgccttatagagttgctgcagaccagcttctaactggggtccatacctgtgaacaatatcgtgaggtaggaggt

SEQ ID NO: 532048 - DNA, 442 bp, Homo sapiens
tcctcgggcaggagcagaggaccacccaattccaagagccagcccctgggggaacttgaagttggccctagccagccctcctttccttatgtggcttacatagttccaaagaaaaaaccccccccccgaaaacggccttgaccccaaatttttcccagttagggaggccccacctttttagaccacccttaagggcccccccttattttaaacatttgggtgggtttcccttgggttagacccccccgggcccgttttggttggggtaaagaccctatgcctattttttctggggttaaccccaagttttttttccatatccctggtcccgggtttttactctttctttgcatagtaatatcccttaaatagctttaaatttaaaaggttgtttttaatgctattactcctccttttcccttaattaaggggtggtttttta

SEQ ID NO: 532049 - DNA, 105 bp, Homo sapiens
cgctccttcgagttcttcactagtcttagaagaactttccagaatactggcttcacactggttctggcagcacaatactggtgcattctggtatctgggggatcc

SEQ ID NO: 532050 - DNA, 232 bp, Homo sapiens
cccgtgtccatcccccttagattgaagagggggttgccacttcacgtatacatgagggccatcctaaaactgtgaggttaagttatttgtataggaagactacgggtcatgggcctgattcctgtgtaaaaaaactacgactcgtcagccttgtttttcacccttatgtatcatgaaggattgggatgaatcagggagtgctaatgtgggatctgtttctagggctgccttt

SEQ ID NO: 532051 - DNA, 101 bp, Homo sapiens
aatgagatggtccatatagtatttaagggaatggggtatatcagtaatttagggaaaggggtaatatcagtaatttaagggaaagggggtaatatcagtaa

SEQ ID NO: 532052 - DNA, 259 bp, Homo sapiens
aggttcgcaagaaggatgattagtgattggtgtcaagcgtctccctctactttttgccatccccatggatataaagttgaggtgatcttttaatccgccgctctcaatcaggtggagacgattggggatgcttacatttgtggtactctggcctacccaggaccgagaatggtcgagcgccagtgcaccgataaaattgctgcgtatggcgccttgtcattactagcatgcagctttcttaccttatcgtcatgcggcc

SEQ ID NO: 532053 - DNA, 586 bp, Homo sapiens
  misc_feature (305)..(305): n is a, c, g, or t
ccagggcccccacacacaccttgtccaaaagcgcttcggaacgggataatcctaatttatacctcaagaggttttttttttgcaggaattttttgaagcttttacccactcaagcaaagcccctaccccccaattaggaggggattggcccccaaaaggaatcaccccgttaaatcccataaaagtcccattcttaaacaaatcggtattattggcatcaggagtatcaatcccctgagctccccatagtttaatagaaaccacccgaacccaaataattcaagcccggctcattacaattttanggggtttttattttaccctcctacaagcctcaaagtatttggagtttcccttccccatttccgagggcatttaggggtcaacattttttgtagccacaggtttccccggacttcaggtcattattgggtcaactttcccccaaaattggtttcatccgccaaataaaatttccctttacatccaaacatcactttggttttgaaccccccccctaaaactggcattttgtaaatggggtttgactattttaaaatgtccccatcaattgatgagggtttta

SEQ ID NO: 532054 - DNA, 214 bp, Homo sapiens
agggtaattctattatgctgcctggctgagtcatagcctgggccccagggaaagttgaattcctaagtaagtcatcatggagatggagagttgggccttggagggggagaccctataccctttggatagcgagcaaagtttaagcagagcagtggccgtgtgcagtttgagagtcttttacgcgaggggctgcaacagaagaaggtcgtccaca

SEQ ID NO: 532055 - DNA, 768 bp, Homo sapiens
agcggaagatgcagcggcggctccggtgtgtcgccgggcgggcaggagcagcgcggacccgagccgggcagggggcgcccgccacggcacccgccgcgctcctagacgccccagagccgcctgcgggcccggactcctccatgccagagataccacacacgaacggtgcctggacttacagccgtgtagatgatacgaacgagagaacacggatgaacaccacgggacgatcatgacaaggaccaccagagcgagggaccggaacacaatggaaaaagagaccaagagccacgcgacgatgaggactaccacggagaagccgcgaccatgaatggacgaaagaggacagagcagggagactggagaccccgagcaagacgcagaaagatgacacaagaaggtctggaaagccaccctgagaaatcggaccctacacggcccataaatagataccaaaagcaggaggacagacaaacgagcaacatgaaaactaagacgaacgaaaagaaaagaaccagaagaagaaagaaacagacgcgagtaccacgaagaacagacaaaagacccggacacgacgaactagaacggcacctgccgtccacccacgcagaacacaaaagaccgcgaaccggggatacaagaaacaaacacaacggaacacatcggcagacacggaaaggcgccacccacaacactggagagcaacaatgagaggacgaacagaccgacacaggagacatcgaacaaaacagccgaccgacacacgga

SEQ ID NO: 532056 - DNA, 956 bp, Homo sapiens
  misc_feature (34)..(34): n is a, c, g, or t
  misc_feature (82)..(82): n is a, c, g, or t
  misc_feature (84)..(84): n is a, c, g, or t
ttgccaccttttagacatgaaaatgccgaaactntccagctttttggatcccctgctgtgggcggtccctggaggcgggggntncgggactcggtggcggccggacagctcatcggcacgtgcagtcatgaaccgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 532057 - DNA, 335 bp, Homo sapiens
atgggaaccctccgctgcgttggataacactaacgtcagtggtatttcggccacgaagaaccctcatctatcatactcacagtattccatgtacaatgctgacggatctcagtcctcccacacatcaacagtccggttttgaccttaagagacatcatggtctaattctctagataataaaaggcccctctatatatatactaccatggctggggggtggtagaggggaatcctttgataaattagagcctatgctaataaaacaggcagtcatgggtctccattggtacttcttggttgctaagattgattccctgagtccagaattgccccga

SEQ ID NO: 532058 - DNA, 225 bp, Homo sapiens
caaacgggatttcactggtccaatagattcaggaaagcctgaatgaacttgtcacttgtggctatcccttcgctgtcgagtaaactgactcaaagaacttgcttgttctttatcttcatcgcttctatctattgacaggatgattactttgcttaacatctctggaagaacgtgtttatgagccctcatttctcttacatccattgaactctctacgtttgcggt

SEQ ID NO: 532059 - DNA, 1148 bp, Homo sapiens
tgcagtgaggccatgtcggctgccttcctgaggccagcgggaggaggtggagcagatgaagagctgcctccgagtgctgtcacagcccatgccccccactgctggggaggccgagcagtgcggccgaccagcaatgagctgagagggtggccctgtgagctgctggccgacctgtgtgagaacatggacaatgcctgcagacttctgccagctgtctggcatgcacctgctggtgggcctggtaccttggatgtgctgtgtgggcttgctgggacttgcgtgtgtgctgggctggcacagctcatcggcacgtgcagtcatgaaccgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 532060 - DNA, 281 bp, Homo sapiens
ttttccccccccccttttttattttcccggcccctttaagaataagccccttaaggccctgggatttatttgaaagggttaaggggggccaacccccccctttttggacccccaggggtgtttttgggtttaacccattcccaggggcatttttttccttaagggtgggtttggatttgggggttgggcccccctttcttttccagttccctttttttttcccccccttggggggttgaaccccccccttaaattgaaaatcctttttttgccccccccca

SEQ ID NO: 532061 - DNA, 104 bp, Homo sapiens
  misc_feature (14)..(14): n is a, c, g, or t
  misc_feature (23)..(23): n is a, c, g, or t
  misc_feature (98)..(98): n is a, c, g, or t
cctttttttaaaantattatgtnctatatttttagtctcaaacacactatatattatatatatttaatttttttatatatataaatataaatgttttnaaaagt

SEQ ID NO: 532062 - DNA, 209 bp, Homo sapiens
  misc_feature (105)..(105): n is a, c, g, or t
  misc_feature (131)..(131): n is a, c, g, or t
  misc_feature (140)..(140): n is a, c, g, or t
  misc_feature (150)..(150): n is a, c, g, or t
  misc_feature (174)..(174): n is a, c, g, or t
  misc_feature (176)..(176): n is a, c, g, or t
aaaaaacaacaaaaaaaacagtcacttttgtgttaaaaaaaaaaaaaaagctggagagacagttctcatgcataaatgcctggtaacaaaaactattattacaanaggccacaaccttttgaaaaactagnacctagccncaaggacccntcaccaaccttatacccaaaaaantncttctgccaaggacatctgctccggcaactgga

SEQ ID NO: 532063 - DNA, 243 bp, Homo sapiens
cccctttttttttttacccaaaccatttttgggacccaaccatttgcccaggggggccccctcctttcccatccccctggccttgtggccaacccggctggttttgtaaaaaaatggggtggggcccagggattttttttttgtaatttaaacaggcccagccatgctggttttatttaaaggacatgaaaaaatgttaaagggtttaaagtgatttaacgggccgcctttgccaccccggga

SEQ ID NO: 532064 - DNA, 1092 bp, Homo sapiens
  misc_feature (34)..(34): n is a, c, g, or t
  misc_feature (82)..(82): n is a, c, g, or t
  misc_feature (84)..(84): n is a, c, g, or t
ttgccaccttttagacatgaaaatgccgaaactntccagctttttggatcccctgctgtgggcggtccctggaggcgggggntncgggactcggtggcggccggacagctcatcggcacgtgcagtcatgaaccgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatcatctacaaaaaaagacacacaac

SEQ ID NO: 532065 - DNA, 154 bp, Homo sapiens
  misc_feature (129)..(129): n is a, c, g, or t
cctccacctcgactccagcggccccgacagctcggaagcacttgataaagaacagggttagaaaggcagtaggacgctctcttgacgcattgcaagtccacggaaaacaattatgggttgcttttaatnggatgaagtttatttttactggtgg

SEQ ID NO: 532066 - DNA, 223 bp, Homo sapiens
gggccccagaactattcaacattcatgaagactgaagccccccagtggaattggcaaaccccctccagcccctgaaaggaggtcgaatgggtaaaggagcatttttttattcagcaaactttctttgggtatgagggtgaaagatcaagtcctttgtgaatattttcaacaatgtagggaaatttttaaggttcacaaagggaaataaattttgtttttttta

SEQ ID NO: 532067 - DNA, 1205 bp, Homo sapiens
tgcagtgaggccatgtcggctgccttcctgaggccagcgggaggaggtggagcagatgaagagctgcctccgagtgctgtcacagcccatgccccccactgctggggaggccgagcagtgcggccgaccagcaatgagctgagagggtggccctgtgagctgctggccgacctgtgtgagaacatggacaatgcctgcagacttctgccagctgtctggcatgcacctgctggtgggcctggtaccttggatgtgctgtgtgggcttgctgggacttgcgtgtgtgctgggctggcacagctcatcggcacgtgcagtcatgaaccgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagtctttctctgacgtgcgtaagcacgaagcgtggatccacgtatcgtaactggcttgactacgtcctatcgatgaatactagtacatggtagggtagacatagtgagatctcgttaggtatgacaagtatggatcgttacgaggaacagccaacttgtgagtaagcatgccaccatccgaccaccgaactagccatccacagagcagtataaaactaggattggattgattactccccggtctctcggacggaagcgctcagtacactcttgcctcaccttttctacctagcgcgctcctttcaacaagcgagtagacctgggtcgctaaccactccctcgcatatcacggcatgctaccaatcgacttcacatccatatattatttacctggagtgtcgagagatgcacatcattctacttgcatccctataattactacaggtcaa

SEQ ID NO: 532068 - DNA, 414 bp, Homo sapiens
aatagttaggaatgcccttggcagaactgaagtcttattaaatggtggacagagctcttgccagctttgtccagcccctcagtctcggagttatgggcagggttgggggcagtgctacactgtaaagaatttccaggctgggcgcggtggctcatgcctgtaatcccagcactttgggaggccgaggagggcggatcacaaggtcaagagattgagatcatcctggccaacatggtgaaactccgtctctactaaaaatacaaaaattagctgggcatggtggcacgtgcctgtagtcccagctacttgggaggctgaggcaggagaatcgctggaacccaggaggcagaaggggcagtgagccgagatcgtgccactgcactccagcctggcgacagagcgagactctgtctt

SEQ ID NO: 532069 - DNA, 496 bp, Homo sapiens
  misc_feature (66)..(66): n is a, c, g, or t
  misc_feature (74)..(74): n is a, c, g, or t
gacacagcgaaaagaggagggcgacgagaaagacaagaatgaagagcgtggaaccacatgagcccntcgaaaanccagggaaatggggagagagaaacggagggaagaaaaagggaggagggaaacaggacaaaaggggattggaaaaaagagaaggaaggaagagagaggggggaaaaaggagaggagaagggggacaccaaagaagaggggaagggcagaaagagaaggaaagagaaagggagggaagaagagaggggagggggaaagaggaaaaggggagaaaagggaagaagaggggggaaggggagaagacaagagaggaaaaaagagagaaggaagaggaaggagagagaaggggagggaaaagaagagagagaagaaggaaaggaaggagggaagggaggaggagacgggaaagaggaaggaaaaaagggaggagaagagaaaaaaggggaaaaaaaaaggagaagggaaggggaggaagaggagaggg

SEQ ID NO: 532070 - DNA, 99 bp, Homo sapiens
ttcgactgtggactcagagggaacacgtggaaaacggttctttcaaagcagcacagttcatccatcaatgcgtgtggcgtggtcgcgcctctgactcgc

SEQ ID NO: 532071 - DNA, 744 bp, Homo sapiens
  misc_feature (315)..(315): n is a, c, g, or t
gtggcgatcagataaggaggattggtgcgtattaatcaaaagggaatgactccctttgccttagatgctctttcaaaagaaggcatagtcgctctgcgccccggaggtcacaggggagatatggagaggctgactctgtgctggtgcgtggtgcgtcacgccgcgtgcatacttctgtgtgggagcgagcctaaagttcctgccctgtgttgtgccatcttgcagcgacttgttatttgagtctacgtcgtggatgctgaggaagtggaccttcttgttgagaggttgtagcaaaccttcgattcatggtcacanttcactggatcaaaaggacgcatacattaaggtcagcgacatctcagcatcgagagtcaaaagatgcacgtgaggaactggcttgatgggctgtcaagcatatgcctatttggattgaatggcggtcgtgggttccatggttgctgagctgccgctggaaaagtgttgctcattggcctgtattgcccctggtgtttccatactctatgcccaggctgtctacagggcacggggcacgtgctgtgtgccagtgccatcgccttgttggctgattgtcttggcctgcaatctattccctcgatgggttcttgctgcgagaagctctgggttttttgaccttgcatgtagtccatttagtttgctcatttccaaggcagtaaacctttccaggaactcaggggtcaaggtttgtcggttgttttgggaccc

SEQ ID NO: 532072 - DNA, 109 bp, Homo sapiens
gtaggccctaagctgaagaagtgaggcagtgattctgccttcattcttggtttcccaaaggcccaaggcaacattctttaggggagaaggtcttcaaagtatatatata

SEQ ID NO: 532073 - DNA, 130 bp, Homo sapiens
aggcgttgtcagtgaggcagacgaataaactacactcagctcgtcgactgcacgccgatacgctgagtgtggttgcggattctggccttcccgtgtaaccagttcgggaagcaggagccaggtagtaacg

SEQ ID NO: 532074 - DNA, 756 bp, Homo sapiens
gcagaagagcagcctctgccgccttccaggagaatgtggggagacagggcactttccctcatggtattgatattttgaccacagctgactattttgccgtcggtaacagatccaactgtttcctggttataagtgtgtttattgccggctttcctgagtacacgcagccaatgatagaccacctggttaccatgaagatcagccactgggatggggtcatccgacgagcttggctgcgagggcgctgcacaacctggcccagcaggcacccgacgttcagcgccacgcaacgtcttcccgaggctgctgtccactgacactgagctccagcatcttcacaccgaggcatggcgtcgactctcgcctgcgcagaagtcgcttacgccttgtacaacccttgccacgcccaacgagaacaggcccgtcacggaccatctggacgagcaggcagtgcagggcctgaagcagattcaccagcagctctatgatcgtcacgctatacagggcgtctgggaggacagctcatgagacaagcaccgtgtgtttcaatagaaaagttgtcactttccaaaatgccctttagaggtgacaccgtcactcgatggctcggcaaccggctgatcacctgacactttcagacatctccatctcatctcaagtcactcccggcagcagatgaaggatgcagcagccccggccctggctgctctatgcagtgaactaccacacgacccgagccggcgcgaggcagcatcc

SEQ ID NO: 532075 - DNA, 103 bp, Homo sapiens
tggggggccccgggttttttttccccccccccccccccccccccggggggtttttttgggtaaggggggggggggggggaaaaaaaaggggggttttggggca

SEQ ID NO: 532076 - DNA, 428 bp, Homo sapiens
gcttacattaaactcttctcataagtgacttttacaagctgaattgtgttccccaaaaattcatatgttgaagtcctagccccaatacctcaactctgactgtattggaagacagggcctttagaggtgattaaggaaaatgaggtcatacgggtgaaaccaaatcccacctgactagtgtcctcattaggaggaatttgaccccgacatgcacagaagaaagaccatatgaaggcacagggacaagatggccacctacaagccaaaaagggaggcctcagaagaaaccaatcctccccacacgttcatctgagacttccagctccaggactgtgacgataaattcctgctgtttaaaccacacagtctgtggtactttgttatggtcaccctatacacgaatacagccagccaataagaaaaaaaaa

SEQ ID NO: 532077 - DNA, 324 bp, Homo sapiens
  misc_feature (14)..(14): n is a, c, g, or t
  misc_feature (55)..(55): n is a, c, g, or t
  misc_feature (100)..(100): n is a, c, g, or t
aacctctctcccancccctgccctcccaaactccccttgcccagcctctgttganaacccattcctactctctgcccatcacaaggcctacttttgtaanttccgcgtgagtgagaacatgctcctctttctgggcctggcttatttcactgaacataatgtcttccagattcatctgtgttgctgaacatggtacaatttccttctttttatgcctgaatattatttcattgtgtatatagaccacatgttccttatccattcatccattgatggacataggttgattccatatcttggctattgtgaatactgctgcaataa

SEQ ID NO: 532078 - DNA, 82 bp, Homo sapiens
ggaggcagggtaccactatgttgcccaggctgttgtcaatcaaactcctggcttcaaggattctcccttctgtcgtcttctc

SEQ ID NO: 532079 - DNA, 135 bp, Homo sapiens
  misc_feature (38)..(38): n is a, c, g, or t
catccaaggcaaaatatattgggtttcccttatctcgncaatgcagttggggtgactttcttttgctgtttcctccttcctcattccctccttttacccctctgcagtttcttagcgaggttgggctgttcatca

SEQ ID NO: 532080 - DNA, 536 bp, Homo sapiens
ctcctacctcagcctcctgattagctgagattacaggcgcccaccaccacgcctggctaatttttgtatttttagtagagatggggtttcaccatgttgaccaggctgttctcaaactcctgacctcaggtgatctgcccgcctcggcctcccgaagtgctgggattacaggcgtgagccaccacgcccggcagggaccacacaatttattaaccaaccaggttaataaattcttttttttttgggagacggagtctcactcttgtcacccaggctggagtgcggtgacacgatctcggctcactgcaatctccgcctcctgggctcaagcgattctcctgcctcagcctcctgagtagctaggattacaggctcttgccaccacaccccacacatttttggtatcttcagtagagaacgggaattcgccatgttggccaggcggttcttgaactcctgatctcaggtgatccgcccgcctcggcctccctaagtgtggggactacaggcgtgagccaccatgcctggccccaacc

SEQ ID NO: 532081 - DNA, 890 bp, Homo sapiens
gggtgtgattcctgctcctgcgcggttgttctctggagcagcgtcttttatctccgccggccttctctcctacctaagtgcgtgcctgcacccgatgaagattcgatggacatggtgatgatgccccctgaggcccccagaagtatctttttcggtggtgaactaaaggccgacaaagattatcattttaaggtggataaatgatgaataatgagcgagcagtaatcttaagaagggtccagttagaggggctggtgcaaagacggatgagttgcacgattggttggaagcagaggcagagtgaatttaccgaaggcaggtccgacttaaagtaacactggtgactttgaaagatgtctgtagagccaacgagttgtcccttggtggggctttgaagtaacaccacccagtggtcttacggtgtgaagtgtggttcagggccagtgcaatattattggagagcacttagtagctgtggggaagatgcagaagtcggaagatgacgaggaggaggatgtgaaagtcttcagtatatctggaaggcaggtcgtgccctggaggtggttgcagggttccaccgaaaaagtaagaattggtggtgtgaatatgatgaccggatgatgactgaatgaggaggttgatgacgccgattgatgatgatgatttggtgatgaggaagtggagaaaagggcaggagaatatttgagatgatccggcaaaatgggaaggtattagatgggaaggtcaactcttaaccaagtaaggggaatcttgaaggaaacttaacagggtttttgaagttaaggcggtaaaggtgccaggggcataattaagtcggggaaaacacgggggtaaaaacaaacattgagtgtcacaacaactagagactc

SEQ ID NO: 532082 - DNA, 434 bp, Homo sapiens
caagcagttaaatacagactcaacattagtctaagccacactgggcagcacacctcaaggtgccctatgaagcatgagactggaagttggaagagtcactggatttgggcagcgcctccctcggcgttgattttcttacaggaacaattctgtctcttctgcatgccaggttctgtcactgaggaactgaaacacttcctcactctgaagtacaagacatttggaactgacagcccagtgactggctacttgggtataccacacccccagcaaaaaaaaaaaattcaggggcaaatttctggcatgtttggaaaaatctcaggtgggcttaattttgttggaaaacgtcattatgagatcttccttaccctaaagggtcatttttccctaaggctgacagaaccccacctttagcagcataaggggcctctact

SEQ ID NO: 532083 - DNA, 284 bp, Homo sapiens
gggttttttttttaaaaaaacccttttgggttaaaccatttgcccccgcaatatttttttttaatccctcaattaggtccatcagcagggttttatagaggtaagggttgccaaaatttttcttttaactccccaattttgaaagttcggttcctttgggtgggggtttctttgtaaaatgttggcccttgtgtttccccctggcccctgtttttctttttggagttagttttgggccccttccccccttagaataattttttaataaacgggaaaaactgcca

SEQ ID NO: 532084 - DNA, 1295 bp, Homo sapiens
agaaaatgtgcggcgtgagccgaacaagacgaaatccaggaggtcttattaagagtgcttcgcgcagttccaaccaacaaggcctgtttctgactgcttgtgcgccaagaatccgagttgggccagcatcacgtactggtgttttcttgtgcattgactgttcctggtggtgcacctgatccctgtggcgtccatctgagcttcatcagtgtccacagagttggattccacactggaacttggttccagctgaggtgtatgcaggtctggcaggtgaatgccaatgcgacggctataatatcagccaacatggatgcacagccaatgatgccaacaccaaatataatagcccgagctgcccagatagtaccgggagaagatccggcagctggggagtgcggccctggctaggcaatggcaactgatctaatggactagacaacatgagtagtgccgtgcctaatcactacccacagagaagaaggactctgataacattcacaagaaacaagagtcaaccccctgacggggatagcagcaagacaaatgagcctggcaagtggaccccagcagaccaaggcaccggacgcacagagagcagagggacttgggaacagccggagccatgggcgcacaaaacaagacctgggcattgaacacccgtccaccccgagaagcacgtcaacgcgtgcatgcaggaaacacggctccaagtcagtggggcacaagacaagaaagccaaggcagcgaagatacggaaaacgggtgctggggatgcgcgcaggaaggagggcctaaagggaacccaggcaagggtcacgcagaccaagcagccatcagaagacgagtgcagcggaaagggaacacagaggggaagggagcataaggtatcgcgggaaagagaaggtagggtaaggccgagattgggcagggaagtgatggctcgcggggacattgccactgtgagaacagcagcgggcacgattttggcactgatcacagagaaggatcaacgcgatgactcggaagagaagggaaggaaacagaagaacgagaaaagatagggacaggtaaaggaaggaagagaagacagacaggtgagagaccggggaggggaccagagaggaacggcgagagggcgggaagagaaggggcaaagggggggcgcaagagaagcacagagaggggaaggaaggaaagaagaggcggagagaagcggaggaaaggggggagcggaggaaaggggaagcggaggcgaggggggcgggagagaagtcagagcggggagagacggg

SEQ ID NO: 532085 - DNA, 870 bp, Homo sapiens
taaggggctgtaagcatgactttattaaagtttaggaggtcaaaaatactgaagtcaaggggtgggcaaaggccagtcccttcgggaggcctccagggattgtccttacttgtgttccgtgcccagctttcttccaggcgtgcctgtggtgttcggggcagggccgcgttcttcaaagcgtggcgtggcttcgtggcccgtgttctgtgaaagcccgtgtgtgagtgactgtggggcgatagcgtggccaatctcgaggaactcaaccttctctccagagttctgtgtgaaaatattattatttatgtgtggaaacagagggagttctctcgcttctgtgttacacccagagggtgtggcaagtgtgcggtgtgcgaggtggggtgcagaaatctttcggctctcacacgtgcaaaagctgtggtcgccctccgtgtggttctcaccaccacattatctatcgctgtggcctttcagcctctcccatagtaagcgcgtggagacacagacacggggtgtgccacaccacacaccacacacccgcgggcataattatcttgtgggatatatattataagtataaaaagatgtgggggctttcacaccacagtgtgtgtccgcgcacagagagaatggtggttctagaagagtctctctcttgagacctctccagtgaagaattctgcgcgcacacctcttgggaggctctacgcacaaaaagtgtggtctgagggtgtatacacaggcgtgtgtgagagcgaccaccacagacacccacaccgcaccacaggtgtctactatctctcaaaaggagaagaccaaagagtgtaacaccctctattgggtcgtgggggagagaagtgtcccaat

SEQ ID NO: 532086 - DNA, 271 bp, Homo sapiens
tgatttatttcatataattggagaccttgttatcaaataaaatagatgagtttctgtgcctgtaaaaaaaaaaaaaaaactaaggtgaagtcatccttccccaaagggaccctggggagatgttcgggccctcggcggactacttccaggaactcagcacctcagggactattggacactgtcggtggctctctaatggggtcaccttggagactccgtaccccggctggccaactcttctcttctggcccggggtacgtcggctggtgcg

SEQ ID NO: 532087 - DNA, 448 bp, Homo sapiens
tatcattgccagcttcagtgcagctggagcagccgctggagcacccctgtgacgggcgagccagccacgtggatgaccttcctcatctcctactggtgtgtgagcagatcggacagaagatccgcaagatcacggactgcttccactgccacgtcttcccgtctcttgcatgcatggatgtgatggccctgcctcggtgccctgcagcagctgcaacatgcagagccaggagctgcaggagttcctcggggacacatgagcggttcctgagccacgtgctagtgcctgagattgctgcacctgctgcctgccattggcacgtgcaggtccacaacaatgaaggccgcgctaccctggccctgaaccaccgcacgccgtgagcacccacccaccagtgccctccatagcgacgcctgtcgcctctgcgccagcaccccgcccgcccccc

SEQ ID NO: 532088 - DNA, 1412 bp, Homo sapiens
cattgctcttcttcttgctgcttttgttctgtgtcttttccggtctactttctcttgactcgcttcttgttatgctcatctctctctatttcccgaacctcgtcttctttcgactctttcgtttccattctgcttactcatttatgtcatcagcctattatctcgtatctgctcttccttctctctactcatttgtctcgttcttgcgtatatggtgcactttcttttgagtttctctgctgttatcgtggtcgcttgttgtttttgtttttgtttttgtttattttgtttgtttgtttattgtttttttttttgttgttttgtttagttgttttgttgtttttgttttttgtgttttttgtttgttttagttttttttgttttgtatttttggtagtttagttgacacacacagaagctgagcgcaggagacggggaagagaagtatcattctggcgcctccatgggttttctgtatttttcttttgcgtgtgcctcatggtgtcggcgcttttggtcacaagcaacaccacggctggggtcccgacactgacgacccactccaatgccaggagggttccctgcgataaccccagggttctccccggaacccggtttctggcttagatcccgcgctcctggtcctggcaaacgctcaccacaaaaattagggggtgtcgcaacgccatggagaagggaccagcatggcgccaaatccgtggcgacagcgggggagggactggagtcccgtgatccttagtggacccacccccagaggccaggaaatggaaaccccataagagggaaataccagggtggttctacctggacacgccaagatggagaccagggacacacgggctcacaaggcgagaattggaaaaccagacactaccgggtcaccaatgtttctctgctacattggtgtctaggccccacataggaccaagggtctccccaacccgcccaggctgccggacaccggtaccatggcctattggaacccgggcccaccgccagccaggaagtgaacaccggtgggccgggccattctctgcctgagcgtgccaccatctcatgtctcagatcagccactgccattagattctcccagcgcacagcacagcgcgcaagggatcccgagctgcgcgctctctctatgaccaatctgaatgcctgatagatctgggggtggtacaccacattttaatctcctgaaacaccattctcccggtcacaccccaggtcttatggaaaaattgtctttccgccaccaaaaacccgatccctggtgcccaaaagaagctggggacccctgccctagaaggccaattgcctacgttaccccgggtaccctgtggccaacacgcaccctgtacccccgagtttttaaattaaaatttttttaaaaa

SEQ ID NO: 532089 - DNA, 550 bp, Homo sapiens
tcgtcatagctgattccttgaggtaacccctttatactctgatgctttaacaacatataaagattgtagagtaactataggtgattggcatacgaaagacgttaacacaattatatcttcatcaaatgtaacattgtttattgcagattcttccgtcttgtgcagagaacaacagcagtacatccacaaatctgtcaagctggtgggacctaatgtcaccttaattctgacttgaactggaagcattttaagaaatcttgttgcttttctaacaaattcccgcgtattttgcctatgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattac

SEQ ID NO: 532090 - DNA, 909 bp, Homo sapiens
ccgttcatctagtctaccatcattcgcaggtacattcatctcagtgctatagtctcgaatctgattttttatctgagtaggtctataaataaacatgtctagctatgtattccagttctaacgcaaaaaaaataaatcctcgttccacagaatctgccatcaagtatttcctcacgcaagcactgcgaatccataatccttctaattagctatcctcttcaaccaatatactctccgcgacaagagaaccataattcaatatctaccatatcaattactcatacattaattaatctactaatggctatacgcaataaaactattgaatagcccccgtttaacttctgagtcctcagagcttacccaagtgcaacccctctgaaatccgggctgtcttcttctcacatgctcaagaaactatgccccacatctcaatcagtataccagatcctttcccttcacattaaaacgtacacgccttctcctcactctctcaatcgttagtccatcataactcatgcagttgcacggctggcattaaatctcaaagaccagctacgcaaaatcttaagcatactcctcaattacccacataggatggataatagcaattctaccgtacaagcctaacataaccattcttaatttaagactatctatattagtcctaagcatactaacgattcctactactcaacttaaactaccagtgagccacgacctactactatctcgggactgaaacaagctaacatgattaacacccttaattacatccaccctcctctccctaaagaggcctgcccccgttaacggttttagccaaatgggccttttcgaaattcccgaaaaattgctgtctcccacatttgcgcattacctcttaatttattacaggaaatattccga

SEQ ID NO: 532091 - DNA, 391 bp, Homo sapiens
ttggcacggcgatacggcaaaaatctggcggcagtattaccgctatctggtcaaagtgtatgttcccgggaaaggcatcgtcagaaatctggtcacggacccttactccgtcagcctgaacaccgattccgggcgcagctatatcgccaacctgcaaaatgcccgtctgaaacccgatggctgggatcggcaagaccgtcctgaccgcgttcgtcagcccacagacatggcggtatatgaactgcatgtccgggatttttcgatcaatgatgccagcgtaaggcctgcataccgtgggaaattcatggcgtttaccgagaagcagtccgatggcatgcgacatctggaggcgctcagcaaggccggcatcaccgacatccatttgctgccg

SEQ ID NO: 532092 - DNA, 914 bp, Homo sapiens
ggaattcagtccgacgtggagagatgcgcagctgagtgtgtgtgttgtggtcgcagtctcggaaaccggtagacgctttactagacatgggcatggacctacatgtgtacttgatagagtccgtatcgacggatacttcacatagcaatgcattgtcttcagctgatgtgtgagcaacaggatggatggatggcacacttatagagcaacgaaaggaagttagggcacaggctgtaatgcagatctcgttgggtcaggaatcggccacatgaagcgagaagatgacagcggacatgaatgtaatgcaaagttagcatgctgaatggtcaggatggccacgaagtgtggactctcccctgatatgtatctgtagcaatggatggcacacgcacagaaatggaatgcacaacagacagctgagaggaacggaaattcagagcaaggcatctcccgctgatgtatcgataatggatggctacatggatgatatgagtgctgcaagaaccttcagacatgtgatgacaaagcttggagagaagttaacgagatgaataagttgatgaaatggatccagggaagcgagatattgatggtgatggtcaaagtaaacatactgtaatgatgtcagtacaaatgatgacgagcaacatgtgacgaccgttgtacagacatgtgtcaatgcctcgtgcgaaagtggtcaattggcctttgctttgtaggtagactccatctgatgaacacaggctttctaccctcaggtgtcaggacaaactaatgcatgttcatagtaattgaggcactgcatgactccgatgttctgcttgcactgtatctgaacgggtcatgggtccttaaaagcttactgtcagaaaacttgatcgacgtaccgatgtgcagtgtggcctagactcagg

SEQ ID NO: 532093 - DNA, 385 bp, Homo sapiens
gatctaatgatgtcacaagtaatggcatatcatgctatctcttaaggataacatatattctgcagtccaaaatatcttttcttatatctctcctgtctgtaccttcagtctccaccccaagctctgagtcctttacaatctctctctttctctgtgcaactctatccgtacctctccccgtcctcacccacaaccgctaccctgcacccaggccaagacgaggtcccacgttcttcctgcagcttccactctcccacccatataatccgttgtatcggcctcgccccactcacaacgcggtccatgcttacagcttttgtgtccgtgactcagccctccccaatcaatttcctcttagagaggtggctggaccgatatttagggg

SEQ ID NO: 532094 - DNA, 126 bp, Homo sapiens
ccgttggtgttatttttttttaaccccccttttttaattaataattttttggcacttggatcgtatccttggaacgagagaaaaaagaaacccaaactcacgcgtcagaaaatctcccccccctaa

SEQ ID NO: 532095 - DNA, 194 bp, Homo sapiens
aagctggtgccatgcttgaggagtggaaggcaggaacccacgtggcaggtgaggggatctcttcagtccattatgatgaccactgtaacctcctggcccagtggttcccagtgatactgagtacaggggcccaaagactataaacccagctgtgagaatgcctgatagctgggcctcatcaaggcctccaggac

SEQ ID NO: 532096 - DNA, 423 bp, Homo sapiens
  misc_feature (7)..(7): n is a, c, g, or t
  misc_feature (18)..(18): n is a, c, g, or t
  misc_feature (119)..(119): n is a, c, g, or t
  misc_feature (218)..(218): n is a, c, g, or t
  misc_feature (236)..(236): n is a, c, g, or t
  misc_feature (343)..(343): n is a, c, g, or t
  misc_feature (391)..(391): n is a, c, g, or t
  misc_feature (422)..(422): n is a, c, g, or t
ctctgcntcccatgttcnggcaattctcctgcctcagtctcccgagtagctgggactacagatgcatgctatcacgcctggctaattttttgatttttaatagagatgaggtttcaccnatgttggccaggctggtctcaaactcctgacctcatgtgatctgcccacctcagcctcccaaagtgctgggattacaggtgtaagccactgcacctggnaatttttaaatataggtnattaaaaattaataaaaaacaggtatttgcaagtttccattttgttatatgcttattattctttatctttatgtcaggttgctgtgtcaatacacttaggagatcanagtttctaaattgaaatacaaataaatatgtctgaaattttttctttnttctttttttttgagagggactctcaaaaana

SEQ ID NO: 532097 - DNA, 570 bp, Homo sapiens
gaagaaacttgtggccaccctccttggtgtcctggtgacgcagccctcgtgatggagcaggaggagagcccaccagaagaagacacagagaggacccagatcaacgtcctggctgtgcaggccatcacctcactggtgctcagtgcaatgactgtgcctgtggccggcaacccagctgtaagctgttggagcagcagccccggaacaagcctctgaaagctctcgacaccaggttgggaggaagctgagcattatcagagggatcggtggacgcaagagattcaacgcaactggttctcaaacagacgaccaatattcgccacccatcacctactatcacgcacttgcggatccctgctcccttctctgtctccggctactacacgctgccctcatcagccacgagaagctgctgccacacgactcaaccccgaccggcgagccgcggcgcctgagctcccacactcggccacggtgtccataccctccgcgtgcctgcccccccccccccccccctcggccgccccggcccccgcccccgccgccccgcccccccgcctccgcccacca

SEQ ID NO: 532098 - DNA, 249 bp, Homo sapiens
cctggccgactacggtgcccgtactacgctggtgcccttggacgtctccctcagtgggccttcagtcccagtcttgtcgcagtgttgcgggcagcccgtcgtgggggtggcagcatgtctcacgccgcagcatccaggctgcacgcaccagggtcgtcatgggcagccgccccagccagcaggcacccccatgtcatcacaccgcccaagcagcgcactcacacagggtccctgacgctcgacacttcg

SEQ ID NO: 532099 - DNA, 249 bp, Homo sapiens
cgttttagcaccgtggtatgaatggagaaattcaggctgggtcgagtggctcacacctgtaatcccagcactttgggaagccaaggcaggtggatcacgtgaggccaggagtttgagaccagcctggccaacatggtgaaacccccgtctctactaaaagtacaaaattgagctgggcattatggcaggcacctgtaatcccagctacctgagaggctgaggcaggagaataactggaatccgggagat

SEQ ID NO: 532100 - DNA, 433 bp, Homo sapiens
aaaactaggttttattaatttgtggcggatagaaataatggaaagtgaaagagaataagaaataaggtagtttttagtatgcgaataattatttttataataagagtctgattagattcagccacctcaaccctgttatgttgaagtggcagtgcgatcaaagcttatttatgatttttattgtgttcggacttatcttgctggtccttggtgtttttgccttgatcctgtttagactggtctgcatcagattctgaatccttatctttggcagcctcttttttatcagacgtattctccttagaggtgtcatctttagcgtcttgatctttagatgaattctctttcattttagtcatcgtatcggtggccatctgtttcagctcagccagtttgacagaagcttcattcaccaattcagtaatctgtcgac

SEQ ID NO: 532101 - DNA, 290 bp, Homo sapiens
cgaaacatcgtttcactacatatagctggactctcggtaggtgtccaacaatagcagaattgtcttgctgatggcacaccatgtgctttgtagatgttttcaatcacggctgtcaatgcctttaggacctccatctatacaccctcttgtcggatctgaggccatctggtatctggagggcctgaacaataggcctttgttgaaatgttgttccacgaaaaagatcaggactttggctgcacccttttccagctcctccatgttacagatcatatggacacgaatgttca

SEQ ID NO: 532102 - DNA, 350 bp, Homo sapiens
ccccctttcccccccttgttttttaggggcccccgggtcccgtttgttttcaccctccccctccggcgggaaaaagttttccccaggggccccgctcttttaaattatgttcccttataagttattggggccccaggaaattttccttttttgtccaggggccgggctcccccgggggtgcaaaacccccaaacctggggttttaggttttgttgagccccctttcccgggggggcttccaagggggggcccctttaaaagtaaataaatgggggggttttggaagggccagggtttccctgtttgggtttttttggggtttgaaaaaaaacttttttttttgcccccca

SEQ ID NO: 532103 - DNA, 201 bp, Homo sapiens
  misc_feature (193)..(193): n is a, c, g, or t
atacttgccaagaaaattgcctttaaaactcgaaaataaggcaggtgtggtgactcacacttgtaatcccagcaatttgggaggctgagacaggaggattgcctgaggccagcagtttagagacaattggccaacaaaaccagcctggccaacaaggtgaaaccgtcgctactaaaaatgcaaaacttagatnggcgtggt

SEQ ID NO: 532104 - DNA, 437 bp, Homo sapiens
tctcattaataaattgatctttttaataataatcctgtttctaacaatttcctaaatgtggcccaccactgtgagctcaattataagctgtttcagaagcaacataaacagacataaatgaggggtatatactttattgaaaactttaaatactcttcagagagaacatcacatcttcaatcaaggctcttgtgtggcctgcatggaaggaaacctgagctctcgcttgatatggagagatcagttgcagtgctgcctttggctggagtccctcacgacccgtgctcttctgccagcttatcagcctttgccacggcttcttcaatgggtcccaccatgtagaaggcttgttctgggagatggtcatattcacctgctaaaatctgctggaatcctttaatggtctccttcaagggcaccagcttccccatgtgacc

SEQ ID NO: 532105 - DNA, 336 bp, Homo sapiens
tgtttcagcagaggcaaatggtagtggtttgaggaatgagtggaaggtaaaaaagtgggaggaggctgggcacggtggctcccgcctgtaattccagcactttgggaggccaaggcaggcggatcacctgaggtcaggagtttgagacccgcctggccaacatggcaaaaccctgtctctactaaaattagccgggcgtggtggcacgcacctgtaatcccagctacttgggaggctgaggcaggagaatcgcttgaacctgggaggtggaggtcgcagtgagccaagatcgtgccactgcattccagcctgggtgacagagcaggactccatcgt

SEQ ID NO: 532106 - DNA, 387 bp, Homo sapiens
cccttggttttgtagacagagtctcgctctgttgcccagactggagcgcagtgccgcaatctctcggctcactgcagcctttgcccaccaggtttaagggattctcctgcctcagcctcccgagtagctgggactataggcacgtgccaccacgcccagctaatttttatatttttagtagagacgggatttctccttgttggtcaggctggtctcgatctcccaacctgagatgatctgcctacctcggcttcccaaagtgctgggattagaggcataagccaccacgtgccctgggcagtttctaaccctctgccactgatttcctgtgtggccttaggtaagttactgtccttctctgagcttcagtttccccatatataaaat

SEQ ID NO: 532107 - DNA, 606 bp, Homo sapiens
cggcgcgggaggcgcccagcgagccagagtggtggctggtcccgcgacgaaaattctgaagctgtacacctctaggaaatgaccacactagttcagaagaagcctgtacactctcttacaaatacatttggttattcaccatgaggttagcaaagcctaaagcgggtatttctcggagctcaagccaaagaaaggcctatgaggaacaagcgcaagaacaggccggcagcggcagaagtggggctatgactattcgacttggactcaagcttcagtagactcagacagaagcttggatgacaaaccctataaatgtactgaatgtgacaagagtttgcatgtcagtagttcaactcttttttcaaacaccagtaaagatcctattactgtcaatacggaagatcccataatgtgtgctgatgtgtgggcaagaagtttcttctcagagttctaatctcattcaggcatcgacggatccatacgggggaaaagccctacaaactgtgatgagtgtggagaagagcttcaaagcagagctcaaatctcattcagccaccagagaattcatactggagaaagaagcctatcagtgtgatgagtgtggcc

SEQ ID NO: 532108 - DNA, 247 bp, Homo sapiens
ctatctctgaaaaagaaaaggagaaaaaaaaaaaggaaggggttttagtccattcttccattgctataaagaactgcctgagactgggtaatttgtgaagaaaagaggtttaattgactcacagttctgcaaactgtacaggaagtgtggctggagaggcctcaggaaacttacaatcttgatggaaggcaaagaggaagcaggcacatcttacatggcataagcaggtgaaagagagtgaaagggg

SEQ ID NO: 532109 - DNA, 314 bp, Homo sapiens
aaaaccaccaatatcatacccataaaacagatggtccacccccagaagcagataataccggacagctctgtggggaacaagcacggggaaaacacctgttcaacctgcccacaagacacagtggtttcacctaccacaattctcagtgtttgagaggcacaaggaaagaaaggacatatgtggatcccttgtgcctatgcaaatacccacctcacagagttgtgtgtagaacactggtggtttggttcaacccttgtgattaaagagtttgtcaagcattttattcttttgaataaacgccacatatctaacac

SEQ ID NO: 532110 - DNA, 1331 bp, Homo sapiens
agcggctttcttcctcctcctcctcctcctcctcctccctcctcttccccaccttcctccactccctcccttgccccctccggcgttcctaccgcgtccctccatcgagactaggcttcagcgtggcgacgcattctgtgtggggaaccatggtcaccattatccggagcatgggagaaggcgtgctaccgatgccacacgaggatgggtagcggggacgtgagccagaagagagccccacacagcacaaacgctgcctgagcccatggaatgcatcaggtatgactcactgtagtcaaggacaccaggggatggacacgatagactggacaggtcgaccggcttactacaccctaggtcaatgctgaccgacgcaggttaggtgacagggagctcactggggagatgaaatcccttggtgggcgtagaaaatgcctagcgggaaagcgagacctttcatgaggcgggacatcagacggaccccggggccggggcagttgacagaaacttcggacaggacaagcgtggccccagtcactggggcgagcacaacacggacacgcagagggggagatgtaccaggcaacgcagtggtcgccaccgaaaggagaaactacgccgcgaggcagagaagcacgggaggagtcgaaagtcgtggccagcgggggcaggatggccacgtagccccaggacaacggctgcggaagcgaaagacgccacgaggtaccagcagtacaaggccatggggacgagcaagagtccaagctacagcaaggcggtacccctcgtgggcgagacatgcggagtaggtccgcaacaatgggccgccgcgaagggcacctgggcgaaaagcaagggaaggcacagaccggcacatgacagagacaggcgcatgacatggttgcgcccataaggagccgagctacatgacccagaagaggtgattccgacaggacagagcagcctggggaccagacgaccacagaacacagtagcgaaaagaagagggagaaaagagcatgcgaacagacacatatagcaatgcaagaaaggacgcagccagcatgcaatgtggaaccagacgggcacacataagagaaccaaagagggcacaataccgaagggagcgaccacagcacaaaagctggacgagcagcaagaacctaggctggagacatgagaggggacaacagtcagcgaagggaagccacagaacagaagagagaggcagcaccagcaccgaggacaagcgatgaggaaaggatgtgcgcacagcggagcacaccaacaggagggcaggcacagcgcaaaggaaatgaggatcgacacag

SEQ ID NO: 532111 - DNA, 174 bp, Homo sapiens
  misc_feature (132)..(132): n is a, c, g, or t
ctgattcactattagagaaacaaacaaaaaattgtcaatatgtcatctgatgtagaaatacttataatagtccgaaagtaaattacagaaatcttcatcagatgtacgaatacttttttgaaatacagtgcncgtcttaaatattcttaacaattttttccttcttgaaattac

SEQ ID NO: 532112 - DNA, 139 bp, Homo sapiens
gaagtgcgagagcctggatttgaacccaggcggtctgactccaaacccttatgaccactaagccccactgcttccccagccattcctgagccaaccgtggactagtagccaaccgtggactagtgggttccggagctcg

SEQ ID NO: 532113 - DNA, 178 bp, Homo sapiens
ctcagctcctattgaatcctgagtttgaggctctgcagccaggcccctgtgggggtgagctgggaggcaccgtgggagacagaacgcattgtggcgggaagggggggtcctgacagaggccgtggggtggaccaattcaagcctcttatagcccaggagcaccctcactggatccggt

SEQ ID NO: 532114 - DNA, 328 bp, Homo sapiens
ggctgcatgacagcaggcgtccttcgcggtcgcgtacatacacgggaacgggcatggcatggttcaaggtttgcagaaactccagctgatcattcagggctttttcagctgcgacccggcgccggatctgacggcgcagttgcacgattcggatgatcgaaatcagcagcaccagcaatgcgcagcagatgatctgcaggatgaccagtttgtagtcgcgccagttctggccactcatagccgcattagcgcgccagcgaatggtgattgcattaagctcgtcaggtgggatgctcagcaggtcgacgcggccgcgaatttagtagta

SEQ ID NO: 532115 - DNA, 253 bp, Homo sapiens
tggatacatattattgtagcgccattagccttaagctagtggatgactcagccagaatcatcgtcgagagtcatgagtgcgatagatcagaagcagtgtgatgctgtctggtgagtagtgcaaggttagtcatagtcgtgtagtgataagaagaagtaggcaggccacaaggagtaagtcggaatttcatcatgctaccatgttggatcaagtgggtatgccgctgtgttaagggcttgtaagaacaagtaat

SEQ ID NO: 532116 - DNA, 232 bp, Homo sapiens
  misc_feature (214)..(214): n is a, c, g, or t
tacttctgcttcatagagtaggtgacacatgagcagttatcaaggatgagtaggtcttggtcccttgacctaacggggtcagaacattccagcagaggcaatagcacgtgtcacgggccggcatgggacatgtggcttgaagtgctgcaggcacgtgggaggccggtgttacggcatctcaagggaatgggggtctgtacccgatgtacagggnctgtgaagggtgatccct

SEQ ID NO: 532117 - DNA, 364 bp, Homo sapiens
  misc_feature (47)..(47): n is a, c, g, or t
  misc_feature (52)..(52): n is a, c, g, or t
  misc_feature (146)..(146): n is a, c, g, or t
cccccctcgaagggtgaggcccttatggccggatccttatgggcctngtggnctgcttcattgacatcgcggtggaaaacctgtctggcctcaagttcagggtcatcaagggcaatatcgtacaagtttccgtgggttcggactgnccttctccctgttgctgggggccacgctgaacgccgccttcgtgctcgtgggctctgtgattgtggctttcctacagccggcggctgctggcagcggaatcccccagatcaagtgcttcctcaacggggcgaagatcccccacgtggtgcggctcaagacgttggcgaccaaagcggccggggcgatcctgcccggcgccgcccccccccccccgcgc

SEQ ID NO: 532118 - DNA, 222 bp, Homo sapiens
  misc_feature (8)..(8): n is a, c, g, or t
  misc_feature (192)..(192): n is a, c, g, or t
ctccaggntccacctggtccccacatcaataccacttgacaatggaaaccactccttccttcatgaaactgccacttggtggtttgtgcccccacgcccaactcacttccccatttcatgacagccaccgtctctcagattccaaacatgtcccttgctgccagctcctccctgggcctggccaccgacagngaccctctgcagcctgagctccgccattgg

SEQ ID NO: 532119 - DNA, 147 bp, Homo sapiens
tatattcacaggtcaaagcagcatcttggtgtcttgcaaaaaacttcatacgtttttctactgtgcatttgtatgaaaggtcaacattaaatcaaggcacatagattcagtcacagtccagtagtgttccagtcacagggggcatcc

SEQ ID NO: 532120 - DNA, 198 bp, Homo sapiens
  misc_feature (151)..(151): n is a, c, g, or t
acttattgaaatagcagacatttcgctagacactccaattaacctgatatgaggcgctaatcaataaaaaaagttaaacatttgcatgactctactatgggaataaattacctgtttaatacctcgactttttatagaaaaataatgatgnccaaggtaaaccaggtaacccaggcctgtgaactatatgcctggaac

SEQ ID NO: 532121 - DNA, 165 bp, Homo sapiens
gtgatgttgagtttctcacttactctttctgaggtccagggtccttatatgaagagattcatatatatgaagagattcgtctagagcagtcgtcctcaccgctctcggtctcggggggccctcaacgaccctttcaaggcgtattctaggtccaagcttgttttc

SEQ ID NO: 532122 - DNA, 199 bp, Homo sapiens
ctgagattgcaccattgcactccagcctgggcagtagagcgagactccgtttaaaaaaaaaaaaaaaaaggaacaaaattcagatttgaccttaggttgatcaatagcaacatggattacagtaagataaagggaaacattatttttaaagtattgaaagaaaagctcattgagccccagaaatcttatctagcccatg

SEQ ID NO: 532123 - DNA, 1263 bp, Homo sapiens
ggctcttgtgctggcaatggtgttcttcggatttgatttcgtgcgaaaattgatcgtaagcagcactggtgaatgaggagatgtctccgatatatgtctctctatggctcaccacgtaacacaccctggctgttagttgccctactggctcgactattgtcctgcattaggtctagtatagaaaggagttgtctaagtccgtgatcatgatctacggggaggtggagatactggtttgctggttcatgcgatatttgaacaccatcattgtgttacacacttggctgtgttgctcgcgcaacgagatcatatcaattgctttaccccatcgaatgcgtggctagagcaagtagtttagtgaaaccatccaaactgccaaggggcgaatgagttcgttgtcctagtgaggatattcaatgttcctgttcttggatacgaccatgtgagtcaactactaaactaaaacgcagaaagaataggcatgtgacttgggagacgtcgatttgaaaggaatttcctggattggtaatcagagcccgaaggccgcaaccaataagacgtgctaggcattggagttgtgcggtctataagacggcctgacttagatgcaatctcagatgaagcggacctttttgttgaatcaattctcgcaattgagtgaaagcggggtactcctcgtatgccgtggacatggagtacacccttgatttacactcgtaatcgtacactcctcgaatggggcactagacttccggttggtgacttgaaccgaactttttggattaaccctgagatctccaaggtggcgtttccccaaggatttccaaccttggacaaaaacattgggcgcggaaaaggttgttggcccccagtgttggggcgtgggagagaacgccttgggccaggtgggagtaaccccaattctaaaggcccttggatttgtctccagagaggacggacggccaagaacgaaaataatttttcgttcccagatggccacgaaataggttgaaagccggccttgagggcctggattttagtaaagcatgccccagggcgctgcagggaatgggggcacgggcgagtttgataaaccacaaaagcccttcattactggtgcttttggggtgtcccacgttaggcttgtatatcacgcaaggacccttccaggagagtttagccgaagagtgtagggatgggtgtgtgcacaacacaggcgagaggggagtttccactacacggggggggaggagagacaagcta

SEQ ID NO: 532124 - DNA, 349 bp, Homo sapiens
atcctgacacagtcatgcttccggaatatggagacgaggctttcaacaaaaaaaaaagttctgatggccaggcatggtggctcacgcctgtaatccaagcatttttggaggccaaggacagtggatcacctgaggtcaggggttcgagaccagcctggccaacatggtgagaccctgtctctactaaaaatacaaaaattagccaggcgtggtggtgcatgcctgtaatcccagttactccagaggctaaggcaggagaattgcttgaacctgggaggcagagattgcagtgagccaagactgcgccactgcactccagcctgggcaacagagtgagactctgtttcaa

SEQ ID NO: 532125 - DNA, 171 bp, Homo sapiens
tatgtgctcatcccctcccttattaggtcttcgttccaactgattttaggtgatagttaccctctagtcttaggtcaatttaaaaaagcacaaacattccaattaaaaataccataaattatttcattctatacttaggcaaggtacatggatttctgtgctaccacatat

SEQ ID NO: 532126 - DNA, 482 bp, Homo sapiens
ggcggggcgcggttggctcacgctctgtaatcccagctctcagggaggctaagaggcgggaggatagctgtgagcccaggagttcgagacctgcctgtgggcaatatagcgagaccccgttctccagaaaagggacaaacaaaaaaaaaaaaaaaacaaaggacaaaaaaaaacacaaaaaaaaaaaaaaaaacccgtgtggggggggcccgggcccccggaaacacgttccaaaacccacccggggggcccgcgggccccaagtgagcaaggaacagggggcaaaaagggtgacacagaggaacaccggggacagacaaaagggcgaggagatcccacacaaataaaaaccgcgccggggggacacccggacggttttgagaacaaccccagaaggggggaccccgggaggaacaacagggggcaaacaaacaaggggacccagggggccccaatcacaaaaacccgggcgggggggggga

SEQ ID NO: 532127 - DNA, 244 bp, Homo sapiens
gctagattgaagcgtatgcagtgagcgattttaggtctgtcttgtcgtaggctgattgcgcttgtaataattctgcctcatagggatagtacaaggaaggggtaggctatgtgtttagtccgggggtcaagaatgagtgattaggcgtattataccatagccgcctagtctcaagagtactgcggcatgtactattgacccatgcatgggggcttcgacatgcgctatagtggagtcataatgt

SEQ ID NO: 532128 - DNA, 194 bp, Homo sapiens
atgtagaggatacgtgtggagtgatgttagtgtaggagtatacatgcctggcatatggcaaaacctgttatataaaaatacaaaaatatagccgggcgtagtggtgggagccctgcaatcccagctactcaggaggctgagtgcagtgagaatcactcgaaccaaggaggctggagtgttgcagtgagctgagt

SEQ ID NO: 532129 - DNA, 304 bp, Homo sapiens
agttaaatagggagaatgagttaagaatacaaattgtctgtaatttgaagttctatgtacatgttataggagaagaagaagaaaactttgttctgagttcaatgattcactgggtgtggtagctaatgcctataatcccagcactttgggaggctgaggtaggaggattgcttgagcccaggagttcaagaccagcctgggcaacaaagtgggactccttctctatgaaagaaaagaaaagaaaagagaaaagaaaagaaagagaaaacaaagaaaaaagaaagaaaaagaaagaaagaaaaag

SEQ ID NO: 532130 - DNA, 253 bp, Homo sapiens
cctgggcctgtctctcccctatcttcccccagcccctcggccctgctctgagagtgagttcgtcctgtgccaatggtcgctgcatcgccgggcgctggaaatgcgatggggatcatgactgcgcagacggctcagatgaggtgggcggggagaccagaaggagggagagatggcatccaaagagttggggcagagccacaggggccctcagatctgaccaggatgcctgcttctgtgccgactaggccgatcg

SEQ ID NO: 532131 - DNA, 184 bp, Homo sapiens
tctgtaaaatagttgaagatgggggatagcctatgggtcttcagaaagcctctgggtttctagagagtcgttctggtaacaggttagcgaggatgagtcaagtttagaatggaagaggatagatgacagcttgcacttggtacctaaaaaccaaggtatgaattgtgctgaggccatgatatat

SEQ ID NO: 532132 - DNA, 104 bp, Homo sapiens
cgctcacaacgggcgcgggggaggggaataacatggcactttataagcacggtatggtaagggggaccaggcaaggtcttaaataaaactatttagagatgggc

SEQ ID NO: 532133 - DNA, 977 bp, Homo sapiens
  misc_feature (352)..(352): n is a, c, g, or t
  misc_feature (362)..(362): n is a, c, g, or t
  misc_feature (387)..(387): n is a, c, g, or t
  misc_feature (417)..(417): n is a, c, g, or t
  misc_feature (436)..(436): n is a, c, g, or t
gcaaaaacggccccgtgcagggagcttgctctgatgtattcggacttcctgctctacaagtcagtgatgtgtaccagcacgtcaccggagagatgatgggtggccatgccatccgcatcctgggctggggagtggaagcaatggcacaccctactggctggttgccaactcctggaacactgactggggtgacaatggcttctttaggaaactactcagaggacagcgtatcagctgtggaaatcgaaatcacgaagtggtggctggaattccacgcaccgatcagtactgggaaaaagatctaatctgccgtgggcctgtcgtgccagtcctgggggcgagatcggggtanaatgcatttnattctttaagttcacgtaagatacnagtttcagacaggtctgaagactggattgncaaacatcagacctgtctnccaaggacggaccaaggtcctgagctacatcccagcctgtggtgacaggtgcaggacaggccatgtgagccacgctgcatgcacataacgttcttccccccatgtagactagtgccgtaaggggaagtacctgctgcccagctgagtgtggcccctccgtgatccatccatctccagggagcaagacagagacgcaggaatggaaaagcggaagtcctaagaggactgaaaaggttccccccaatcaaggttccccagtaaccttccaaagcaaagttaggctgttccccagtgttgtcccagacaatcagagcgaacagattggtggttggggagccctttgggaaaaacggccagtctcgcaggcccctgcattctgtggagttggcacggtcacaaccttctggaattgtgccaggcagaatcttttatacacgcatcaattttcgcgccgcgccaacactgtggggcccagtgacaccggaccgtgtctttaaaagtgcctagtgggaaaaaaacagggcgtgtgcccatattaacg

SEQ ID NO: 532134 - DNA, 880 bp, Homo sapiens
tggatgttaaatttttttattttaaaaataaaatggattcataaagggcaagaagaagtcatttcttccgggtagtctatatgcttcttcaacaagcaacacctccaggaagagccggccagtggcaggcggggacgtgtgtggcaagccgggttcggggcgccgcgggaccggggctccggcgcggacagtggcaacgggtggccatgagggggacacgaagtggggcgagaaggcgcagagtctcaggccaggtccagcttcttctggggctcagctctcggcgcagggcccagtttccctcaaaatggtctactggttcacagaaatccttgtgacaagctcagcctgggagggtagatacactctacacccccaaggggctatatgggtctgtcaaagcctatcctaacttggaatgtctgagcggggatgcttggaactatcgaacacgagccatcagagaaccaaaggtgtggatgaggtcaccatggtcacacttttggaccaaccggagcaatggcaacaagagacgggatcatcggccttcagcgcctaccagaagagggaccaaacagggcacctggcatccagccactgacagtcagccttaatctgggcccaccggggaagacggtagataaggggggcctaatgggaaagcacaccgggggcacagataaagacggctcctgggagcactaaaggcggtaccccagcggacagggggcgtggcgaaacccggaacgaagggcctcctcggccatgggagaactcccataggcttcccaagaacccagcacaggaagcttgaggggcaaatttacgcacagaggcacacaggggacactgcttacaagaagtgacccgggacaaaggc

SEQ ID NO: 532135 - DNA, 1725 bp, Homo sapiens
acgccacctcatagtcccccacgcgtccagccgtcagctcctgggccccaatgcagctgccctctccagatacctggcagacctcatatatcagccaaagcctggctcgagcaggcaggggccatggagggaggggcccccgacagacatccacggggctcctggtccatctgactcccacgtcacgggcattctttcgccgaaccacagcagcacccagacagacaacataccacgaaaaacaggccgcgctcaagacatatagccacgaacgggctaacattccaacgaatgaggccagggcgagatggagccggactagacgggaccaagcccacagagcccagcgattcccggattgcaacacaaccatggcatctcctatggccctccaaacaacagcgaaatctactgcgggccatatatcaacagcggacccaaggggaggcctccttgaatggcccacacacatgtcacaaaatgtgaagacccaacggaacaatgcacggctatcccgtgacagacaagggactctacacagccaccatggccaactaggacaccgctgcagacacatttgaagccttgggacaaggtcccaagaacgacgtggcagacggcaagcgcccatcacacaacctaggcattagaagagcccttcccccgagctcccctggggatacatcttggacattcgcgccacgaacacttgggaaccatatcctaggcccttagaattcccaccaaggggcattccgcgggcaacgcgcgacaaactgggcgaatataagagtgtagcaaggagaaaacataccgtcgactctccgacaccacatgacacgccaccatacacacaaacacagacaagaggccacagaccgaccacaaaagaagacaacaccccatcagcacaggcagccacacacaaacgactaacaccagcagccacacccaaacaaaaacgagagcacacacaaccgagggccacctaattagaaccagaggcgcgagaaatctacaacacgaaaagggacaactgagcacccgcacgcatgataccacaaccgacaccagggacacccagcggcacacaaacagcaggcagcagcatagcggcaaacacacttaggcgacagacgagaccactaagcaacactacagaggacgatggcacacaaatacaacggacgaacaagcgacacagaccgacgacgactatacacgacagccaaggcgcacaaatcaacaagttcaccagcacctcaagtaacaacacgaagccgcgagaacaagccgggagcaggcagcgcgcgaacggaggcggacgcgagacgcctcagcgcgagcggcaggcaagcccacccacaagagagggcgcgcagcaaagagcacagcccaacggagcagaagacagcgacaggagcagcagcacgcgcagcacgcgacacaagaacgacgacaacgacaggcaacgaagaaggacaaggcagaaacgggacaaacggggcagtgcgggcgagaaggaagagagcgaacggagagacgagacggacacgagcaggaggacacgaagaagacagagaacggaacggaccgcgcagacgacaaacagaacgacgaaccgcacgacggacgagcagcgaagacaagaagagcagcaacaggccgagccggcacagagcagggcacgcaagagacgcgcaagcggcagaaccagagcgagaa

SEQ ID NO: 532136 - DNA, 1155 bp, Homo sapiens
gttgacaaaaaaaaaaaaaattccaggaaaaaaaagtgtgcaaattttttataggctcctaattctctttggttggcctaattgaagttgtctcccttcttatttttatgggtttttattattgctacaaagttcccattcttctgcagttatggaaacagtgtggctgtatgtgttagtaattattctcataatctcgggtagcacttttctcacttttaagtgtgcaatgtgaattagtctccagctttcattctcacgggtatttactaaatacgctttcccttattgaacttttttctttcttggggagaagggaagtttccgcctctgtgtgttggcgccccagggcttggagagtgtgcgcagggggcgggcgcgagactctctcaggcttatacggggaatctctctcgggcattcccccggggtcccggaggtgagattctctctccgggccttcaagggccctccctataggataggggggggaggttacaccgggggcgcgcccctggttcacaccacacttttctgtagccttaattttgtgggggctactattttctgagagtctaagacaagagtggtggggggtttttctcccacccagtgtgtgtgggcgcccagagtctcggtgggtgtgtcttcgaacactctccctgtggagcctctcaggggggtggaaattcccccatgtgtggccttgtggggggccctcctcccccagaagaagaggtctcccgggtgagggacttattcacaaccgaggggcggcgttgtgagaggcccaccgccgcctgggtgccccccccaggagggtgggtgcgcaccccccccagaacccttgttgtttttgtttatattatattcattagtagggaagagcgggcgaaaaagaaaagtttatcttccaccacacttctgccaatatcatcccccccaaggggcgggggtcttacaataaagatgtcgtgcacacgaggcggcggggcggagagacaaaaattgtgagtggggggcccaccacactagatgattgacgccccccctcttggttgggccccccccccaccgcagggggtgtttttcaagcgacccacatattcttccgccgggggtgtgtcgttataacaacacccccccaagaaaggg

SEQ ID NO: 532137 - DNA, 279 bp, Homo sapiens
cacagcctctcacagaggcatctaatgtaacctacctaccattgcgctgtgtaaaacagattctacctctgagctatgtggacattgccatcccatgcaacaacaagggagctcactcagtgggtaaactgtggtggactgctggctcgggcacgttctgcgcatgcatgtcaccatttcccgtgaacaccccatgagcggtcctgcctgatctgtacttctacagagatcctgaagacattgaaaacgaagagcaggctgctgctgacacgtgcaagt

SEQ ID NO: 532138 - DNA, 141 bp, Homo sapiens
atgagggccctcatccgcttatccaatgagcccctcatccgcttatccaatgaccctcatccgcttatccaatggccctcatccgcttatccaatggccctcatccgcttatccaacggccctcatccgcttatccaatgg

SEQ ID NO: 532139 - DNA, 193 bp, Homo sapiens
cgaaaaatgggtgaaaatacacaaaaatgcaagacttgttcaaaagtatataacgaaaaaatgtataaacaaggaagatagggagtagaagatacgtgtacagcaaggacagcaatggatcattcaaaagagaaatcttaaaatctatgcgagcaagatatggtttagtacgcattagatcatacaccaattt

SEQ ID NO: 532140 - DNA, 235 bp, Homo sapiens
cggggaaaaaaaaaaaaaggttttttttttccctgtgaaaaaaaaaagccggggcccctttttgtttttgaaaaaaccaggggttcccaggcgggggggtggggcccccccggtctttttaccggtttttgggattaaaaccccgggttggcccaaagggggggattttttttcgggcccccttcccccccccttttgggggaagggtaaaataaccccccggtttttttgttta

SEQ ID NO: 532141 - DNA, 331 bp, Homo sapiens
  misc_feature (12)..(12): n is a, c, g, or t
  misc_feature (83)..(83): n is a, c, g, or t
  misc_feature (93)..(93): n is a, c, g, or t
  misc_feature (112)..(112): n is a, c, g, or t
  misc_feature (119)..(119): n is a, c, g, or t
  misc_feature (138)..(138): n is a, c, g, or t
  misc_feature (146)..(146): n is a, c, g, or t
  misc_feature (161)..(161): n is a, c, g, or t
  misc_feature (165)..(165): n is a, c, g, or t
  misc_feature (168)..(168): n is a, c, g, or t
  misc_feature (170)..(170): n is a, c, g, or t
  misc_feature (180)..(180): n is a, c, g, or t
  misc_feature (197)..(197): n is a, c, g, or t
  misc_feature (260)..(260): n is a, c, g, or t
  misc_feature (321)..(321): n is a, c, g, or t
aagggagaatanaagagaccccctgataaacgaaaaatcgaggggcgcatcaaataccctcccaaaaaaaaaaggaaaaaagnccctctgggncggaaggggaagggacagnctaaatncttcttgctcccgtgccgntgactgtnaaaattgtggtgcanaaanctnanggtggtgaanaaattgcagaggaaaangagaaggaagggaaagccgcacataagcacttggaaatccttgcaatgagggtcctgggcaangttgaaaaacgtaagcgcgttaaaaaactgcaaaaagtgtccaaagaaaaaaaaaggcagnaggaaggtga

SEQ ID NO: 532142 - DNA, 1788 bp, Homo sapiens
  misc_feature (838)..(838): n is a, c, g, or t
taactgggtacataccatcttttatttatattggtgtatctatggtcacattggtgttgatccaatataagaaaaaatcatgaatacattcatacgtatatctctttaaatttgggtaattccacattggtcaaatattggactggtggttcgattatggggtggtcctaacccatatttaaaaaaaaaaaaagagagaaaatatggactctgtggccaaacagtttcttggtgggtcgcgcctatggtgttatgtggattataacaacaggcatattatcctatatatatatgtgtctctcttattttaaaacacactcatatagatttgtggaaaaagagacacccaggcgagatatctacacactatacagtggttatcagcgtggggccctcgcgggggcacacagtgtctttctatacagacacaatctccgacagaccttccacatctctcaattctccttatctcccgccgaagagacaatacacacttttatagacggtgtcagcacaccactctcctgtactaaacacacaccactctttcagaagtgtgaaatagaaagaggggaggagaaacacactattgctgtggctcatatatcgcctctataacacacagagggggcgtctcccagagggctggccctagagacaagagacaacacaacagagcgtggccgcctgtgggcttagagaaacccatcccagagtgtggtcacccacaacacgggcgttgtccctgttggcgaaccccacaagaacagacagaaaacacgacatgtgcgcaggtgcacgccccataatcatcttgcaacaccacgaagataagcanctgaccacgctcgtgctgcggcggaagcgcaacagcacagtcgatacatcaagaacggcgcgcacacaacacgtgacttctaaagagacaaagcgccttcacgcgaggcggactccgacctcatagttcagtacgacacaaaacacgcaccccctggctggtgtgtacacccacaacagacctagcgagaacaccccagacatgcggcagtacaatcataagctgcgctccgaagaaaggcccataacccacaccggcgcgggcgccccaacgaaacatccaccgacgaaacagcactcagcggggtcgcctaccccacaacaacataaccacgggacgacatagttgccgccccccaatatcccacaccatttcaaagcgactggggagacaacggggtcaagcccccaatagtctacacgggccgaagaggaaccatacgtacacaccaacaccacatagtggtcagctagcgccaaatcacacatccgagcgagtaaaccacaaaacaagcagctgggtgtatcaaacagacacacccagcaaaacaacgagcgggcgtagaaacaacaacaggtgtggccgagaccaacgacgagggccacaagagcgcgccccaagaaagagaaaacagagacgccccgcctcagatgacgattgggcgacgaagtattcctagccacagcaaacaaatatcggtgtcgagcccgacaaacatgtgtccccaccagatgatgtgtcgctagataccgggtgcaccgaagtggggacaaccagagacgtaccaccacgagcgctacaaccaaccagcaggtgtcgtctcgacagaggcgcgcacaaaagactggatgctgacatatcgacatacgaacacacagccactgctggtgcagacagtataagcagcagcgatcacaacacgatcgtagcacaatgcgaacgtaatctga

SEQ ID NO: 532143 - DNA, 209 bp, Homo sapiens
tctctgtgaatgaaacgcagtcctggcttgacctcaccatcagtccctctttatttaaaattgatttgattgaggtatagttgatttaaaatgctttattggagttccctgaaagccaagtgggttaaagatctggtgttgtcactgctgtggctcaggttgttgctgcggcacaggttcaatctctaccttggaacttcctctgcacg

SEQ ID NO: 532144 - DNA, 677 bp, Homo sapiens
  misc_feature (58)..(58): n is a, c, g, or t
cggcggggcggttctcctgggttcaggaattggcccaagggatatttaggctgaggancttgggccaaggccggcgagccgtggctccctcccaggccgggccccgaaggcctgctcgtggatgacccaggctgtttttaaggggtgaagagggtgcgttttcaatcagatgtttttggaacgtttaaattgtcttctttggaaggacccgtcccctctttgggcttcaaaggccccatttcaggcgcattgatgagaggatgtggtggtctactctgatgtcaatcttaagggctaggtatgtcccaagatctcttataactgctgttgatgatgattctaatagctaccatttgtcgagtacttcttgcccgcctggcattgcacaaagcaggttacacatacggtctcatttaaaacgtgtgaggtaggcacctgttgttatccctattgcctatgtgggcgcttgactcactggcttgaataacttgggctcacactgctaggcagtctgggggaggggagttcaaaccatggtttatctggaccgcttcccggccatgtagattaagaaagcattcttgggtcctctggagaaagcccgtatttgcaaagcaagaaaaagcttaatgccagtgaaccctctctctcttggttggagcacgcataaagactgt

SEQ ID NO: 532145 - DNA, 887 bp, Homo sapiens
gagtatatattgtcgacccaggcgttcggcttccgcagagtcccggtacgtggtccccgaaattgtgaatagttaaacaatcgggacacttctgttgaaaatgttccgcctcaagtacagaaatgttaacttgtccaaagagataatacagggcaggaagttttcagaaacttattatacacggattctgccaacactgggtgaaacaaacgcactaggatccctgggttacgttgtagttcaaccgtcaaagagattctgctggtatttggtcgtatagttgcaaactcgttggggaaggaaaaagaagtcaactgacaaaaatgaaaagtgggatgcaaaagattgggcacacagttgtatcacagtattcctgtaggtagaaagcagtgcacagcacaagatggacaagtgcaccagtcgaagcaagtagctggtctaaggtaacgtcagagaagattcaacccacactccgtggcatcgtggagcgcgcgagccaactacaagcggcgtcagtgggcatggcgtggccaggaaaccgcccacggaatgaagtcattggacaccccctggaggcagaacacagtggacatgggggggtgcgacggatgcggcagaggtaaccagcggtgaacttaagtaacgcgatggaagggtccggagcagacatggggcccagttggcagatgaagacccgaggcaacatacgtgcacgcaatgtgagctacgaagcaacagagacgagaacactgactcacacgggacaacagaaaggggccagaaaacgacaagcgcagacgagtggagaacaggatcctacgagcataagcgagaaagaacagcatggcgcagacaaggagacacgagaggacaaataaaaggaagag

SEQ ID NO: 532146 - DNA, 391 bp, Homo sapiens
tcgccgaacaaaagagatctttagttcaagaccagcctgaccaacatggggtaaccctgtctctactaaaaatataaaattagctgggcatggtggcacatgcctataaattctagctactcaggaggctgagcaggagaattgcttgaacccgggaggcggaggttgcagcgagccaagattgcaccattgcactccagcctgggcaacaagagcgaaactccatctcaaaaaaaaaaccaaaaattcaaaaaaaccaaagaaggtaaatgccaaacgtatgccaattactgatgaatggaaggaaattattcacatttggcaaaattagttcaaaatgaataaatcacagaaattctcctcccataagaaaatacctaatttgtatctt

SEQ ID NO: 532147 - DNA, 226 bp, Homo sapiens
acgaaaccccttctctacaattgatgaaaaagatgatctgggccgggcacgctagctcacgcctgtcactccggcactttgggaggccgaggcgggtggatcgcttggggccgggagttcgagaccaggctggccgacgtggcgaaaccccgtctctctgaaaaatagaacgattagccgggcctggtggcgtgggcttggaatcacgaccgctcggggtcgacgc

SEQ ID NO: 532148 - DNA, 136 bp, Homo sapiens
aaacttaaaggggggcccttaaatttaactttttttaaaaactgggggggcaaaaaaatttaaaccgcttaactatggaaaagaaaatttgaattttttacttggaaatttttataaaaacagctgagttttttta

SEQ ID NO: 532149 - DNA, 643 bp, Homo sapiens
  misc_feature (399)..(399): n is a, c, g, or t
gttagaaggccatcttcatactgttcttgccagagacttgtattcccatttctacgtatgtctcagaacatgaacttatggatatatcaccttctcgtgggtgtcagctggtgaaaggggccccacacagaccatacgctcaagaaaataggctatgggaggaagaacagcacacagtaccaccccatcccacccccaaatatgttattaactgaaaaaaaaaacatgctagtttctaccaggctagtggtgtaccagcgctctcgatttttaagatctgctccccatatactgggttttgccttctcatcaggttgtacaacacatgtcgcagattggctctagtctgtccttatgccttcggtcttgtctgaggactgcgatacaggccttggtccnttgagcattcaataccagtaagattctacagaaaagctggaagggaccaaaatactgattgtaataaatatttgtgggcctccttgtactgactgggcagccgatgaagggggtggggaaaggtctctgagaggcaccaccgatggcttctaggtctacacaagagacaggtactgccattagctgtgcgtggagacatcggaggaggagctgctgttgctgttggtggtctgggccctcttta

SEQ ID NO: 532150 - DNA, 371 bp, Homo sapiens
caggcatgcaccatcacgccctgctattttttgtatttttagaagtagagatggggtttcaccatgttggtcaggctggtctcaaactcctgatatcaggtgatccgcccgactcggcctcccaaagtgctgggattacaggcatgagccatcgtgcccggcctttttgttttttttgtttgtttgtttggtaagtttttttgtagagatgggggtctcactgtttcccaggctgatctcaaattcctgggctcaagcaatcctttggcctcagcctcccaaagtggtggaattataagcgtgaaccatggtgtcctgcaagtttgccttttgagtccaaggacaaggaaattatcagcctagaaaggcca

SEQ ID NO: 532151 - DNA, 977 bp, Homo sapiens
  misc_feature (31)..(31): n is a, c, g, or t
  misc_feature (835)..(835): n is a, c, g, or t
ctgaagcagatcaaacaaatactaatatttngccgagtttataatttgtgtgccgcggacgatgtgtgcacctattctcccactgtcgacattgtcgcggcacacctggtgtgttctccttgttggtggtttatatcccccattttgtggtaccccaatttgtcggggttttccacaagtgttcgcaaatcttcatagctggtgtccatcataaactaagccgttgtacccactttacaagatcggcctctcgcggtgaaaggattccaccatctgcatccaaagaattgtcagatggcttgcacccaacacctgggggccaaatgtagggtttccctccacccccggcgcgaccaaattacttcccccaaaatcaggttccacggggcacgcaaaggagcagcccctcttcctggcggaaaaacaatggcgatgggccctcccacacgcgcccataggcttcggtggccaccccacttcttgtatgcacaagttttttttatattagctcgcgggtagccaccaactgctgagctgtcagagtgtaaacatcatagagggggcaagagcacaatggatgtacaactgttctcgcctccccaaataatactggcgaaaatctttcctcatgtccagaccccagctcatcaaaatggttgcgaacgtatcgtgcatccagcatggtgccaaggcccatagcgttagggatgcccccgatattagccctgcttgtggcagaaaccttccatgtcttctgccaaagagtcagggaagcaccaatattttctgatatataaaggcgtccgcggctgttagtttccccacgtgttcgtangcacgctcggtgtatcaccgcagagagaaaggattaaacaaggggacaaacaacaacaacaagacatggcttttccttgggaaaacccttgctatacagccgcaaaccgcccaaaaacaaaaatttgaacaccccacataca

SEQ ID NO: 532152 - DNA, 211 bp, Homo sapiens
ttttttaagggggggggggggttttccccttttttaaaacccccccttttttccctttttggcccccattttttttttaaagggggaccccccaaaattttttctttttggaaatttttttttagggtttcccccccccccccccccccggaatttttttttttttttttcccaaatttttaaaaaaaaaacccttttttcccccccccca

SEQ ID NO: 532153 - DNA, 421 bp, Homo sapiens
ggctactatacggcaagtgaccatggagttgtagcccttggattcgttggtgctcagggaatacccattacacccgttggctggcatgtctatcgtgctcaggaagatgatgcaaagcacgatgtgtatggagctgatgctgattgcactgtaacgttcttgcacatccttgactacaatagacgtccaggatgacatatgtcactacactggtacacgcgcctgggttggccgccatccagaaggaatgatgatatctatatatgactgatagaatgctagtgggtcagcggtgctactgatcccgagcgtttttacacaagaacggtgggtgtcacaaggctatgactggacaggcacagggcagcggcttgacagctgagctctgtgtcgacaggagactgatgattggtgcgtgttt

SEQ ID NO: 532154 - DNA, 150 bp, Homo sapiens
ccccgggatccaagcttgatcctactggcaggatcaaccaggttgtcgtctaattcggactggcaggatcaaccaggtggtcgacgaattcggactggcaggatcaaccaggttgtcgacgaattcggactggcaggatcaaccaggttg

SEQ ID NO: 532155 - DNA, 150 bp, Homo sapiens
gacaattaaacgagataaccgcttgtttctcagaagcaaatgtcagacagacgcgaaaatgacatgtctccaagcaacaatgtggtcactatcatgtccaccaccactgaaacaagcaagggtgcagtgctgtcagacatcgagggtttc

SEQ ID NO: 532156 - DNA, 715 bp, Homo sapiens
agcgggacggggctgccggaaggcgggtctggagcgggcgagacgaccaggccggcgagcgcagtgcagcgccgctgcggtgcgcggcggccgagatgggggcgtcatggagtgatgagcggagctactcggatatctgcggcggcgcctggcgctgcagcgccgcgtactactcccgcgtcctgccgggaattctgcctcagctgccctcggctctctgctgctgttcgctcagcgcctggtcacctgcacggtgtggctggcggcctacggtagcttcttctagcctctgctgagaacagctatgatcctctcgtgttgccatcttctttcacccctcttaggtctgcttggttatctccggtgttgcgtgcaagattgatcagggagacgtctgtcaatcattgagttcccttggcattcaggattgacttcatcttactgcttcagcgcgatagaaagcactgaccttcatagaaatgggcaaggtcaacggatattgtcaatcaatgaggccatttatcatgcaggaaggtgatttactaccatctgcatcttattgaaagatccagtggaaccacatgggatatcccaagtagtacccgtcttccagagtgccaatgccccggctggacgtgttgattgaagtatacaggagctgccaggagatcctggcacaccagaaaggcacatcaacaagtcccatgagccccag

SEQ ID NO: 532157 - DNA, 436 bp, Homo sapiens
  misc_feature (5)..(5): n is a, c, g, or t
gttangaggtacaggaagaggttggcgatggggtcctggaaagatgaagggtgtgttacccaccgtgctctacggaacacattggctgaccatttccagtgccgtatgatgctgggcaagctgctgcagctctctgagcttcaattttctcagctataaggtcccttctggtgccgcagttgaaagtctacaaatacatcaaaatcacacaaatcccctggcccaaatcagaagcaaggggtacgcctttcctcatactccagccacagttttctgatgccacaagccacccagatcccaaagaaaacaaatgcctctgtacaccttcctcctctggatcacccacagtcggctgcactgcagacctaggccatgttcacagccccaacacacacacacacacacacacacacacacacagtgggttaagtaagca

SEQ ID NO: 532158 - DNA, 147 bp, Homo sapiens
ccgttcatctactctgctggggtgatggccttccctggtctcgggtagcttcctcacacgcctgtgctcaccagtagtcgtagtcctgctgcacactggaacgggagcctctgtggcatatccagtggttctttcccatgtgcagct

SEQ ID NO: 532159 - DNA, 668 bp, Homo sapiens
agaatttgaaacgacaggggaaaggaggtctcagtgggcaccgtcccagcatcgcggacaccacagcggcccttcgctccacgcagaagaccacacttctcaaaccttcactcaacactatacttacccaaagccagaagatgcacatggaggaacatgaggtggctgagctgtaagcacccacgagcaccatacttccaaggtccaccgtgatcaacatccacagggagacctccgtgcccgaccatgacgtctggaccctggtcaacaccatgttcttgaactggtgctgactgggcttcataggatacgcctactacgggacgtctagggacaggatgatggccggcgacgtgaccgtggcccaggcctatgcctccaccgccaagtgactgaacatctgagccctgaagctgggcatcattatgaccattggatgcatcctgttactgggagatgactctgtgacagattaccatactatgttacagatgatacaggaagaaacgtgttactagaagccgaccatagcctgcactcttcgcactcgaatgtgctgctgactcttgcacgctgaggctgttgcccactggcccattagtcctgcccctagatacagccagttatacccacacacctggatgacagggacattgcactgtgccgct

SEQ ID NO: 532160 - DNA, 225 bp, Homo sapiens
ccagcatacttctgggaactcaggttaaatgcttgctggaaacctgcctgtattagtcggtgtcaggctgctaataaacacatacccgaaagtgggtagtttataaagggaagaggtttccttgtatagttccacgatggcttggggcgggctcacaagtcatggtgagacaggggaactgataacgcaagtagcgcccccacttttacacggcgtgcgcatgga

SEQ ID NO: 532161 - DNA, 1650 bp, Homo sapiens
  misc_feature (831)..(831): n is a, c, g, or t
  misc_feature (834)..(834): n is a, c, g, or t
  misc_feature (840)..(840): n is a, c, g, or t
  misc_feature (846)..(846): n is a, c, g, or t
  misc_feature (848)..(848): n is a, c, g, or t
  misc_feature (851)..(851): n is a, c, g, or t
  misc_feature (855)..(855): n is a, c, g, or t
  misc_feature (858)..(859): n is a, c, g, or t
  misc_feature (861)..(861): n is a, c, g, or t
  misc_feature (867)..(867): n is a, c, g, or t
  misc_feature (876)..(876): n is a, c, g, or t
  misc_feature (885)..(885): n is a, c, g, or t
  misc_feature (1227)..(1227): n is a, c, g, or t
ggagccaaagataggctagtacgaggctgggtgtgaaggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaagatgatggacaacacttgagggcttaacagctgaatttgtgaacttagagttcctcagtttaataaatgtaggcttgatctcagtttcaaaatctccccaagctgcctaaattgaaaaagcttgaactcagtgaacaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgagggatggtgaagaagaggagtttgatgaagaagatgatnaanatgaanatgtananggngatnagnncnccgatnaagtcagtnaggaggaanaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtacctgtgatacaaaccccaggacacccacccacccaaagagccaaagaatagtttcctgtgacatttccgcctttcctttccatgttagctccctctgtggataatttaccaccaaggcttgtggactttcaccccanacaaaatttgtaagccgtttgttaggtttctggtgttaagaattcttgcctgtagccgttggatagcctgtgcattggtgaagttcaacccgtctggtggctaccagtttacactgagaattgtaccagcattttttacctttctgttacaacaaaaaagcttgtgtacattaaaatcttaccattttggaaaaacaaaaaaaacaacaaaaaacaaaaacaaaaaaaaaaacaaaaaaaaaaaaatcgcgggcctatttttctcggggcggcaaaacagcgagtcatagggggcctgtgcgctaacaaggtgttctcacaaaaccatcatttcttaccaaaggggaaatactcgggggtccccaaaaagagccttaaaatcctacaaaacgcgggtcactgataaaacccaccaaacgagga

SEQ ID NO: 532162 - DNA, 180 bp, Homo sapiens
  misc_feature (24)..(25): n is a, c, g, or t
agcagttttggcccgtgggccccnnctgttttccccctgcccaaggaaaggggacctggccggggcccattttcccctaagtaacctcaggggccggccacggccccgctcccgagccccgccccggccacggccccgtgttttgcactttcatggcccctccaggccaaaaactgcttt

SEQ ID NO: 532163 - DNA, 119 bp, Homo sapiens
agcaggtggaaggagcccccattcaaatgaatctatcaaactgggaaaatactgcatatcaccaccatgtagaggataagtagcaaatggactaatttagtatggtaagtaactattca

SEQ ID NO: 532164 - DNA, 387 bp, Homo sapiens
gatacatgaactcgatggtgtgaatagtgacaaaaacgggggggggtagtcagtatttactcctacagagcatattttactgagctagaataatgctaggctctaagtggcataactaaaaagctggcaggacgctggtttgcacattctctactgttaaaaccctctcgtcaggcaaagcctgcaaaaccctcaacaggacagaagaaaggatcaaggacttcagccatggacgtggagactgtccattcacatagaattctatgtgcattaacataggtacaatcagagtagaacttggggccacaggctctaaactattatgaaaagggaataaaatataataaaaatgtggctggagtagctgtttggaaaatcatagtatca

SEQ ID NO: 532165 - DNA, 335 bp, Homo sapiens
gtttgctgactttggggtaaacaactttgttataaaccagtttttgccccaaaagcatgtgcccttttcaggggcccaaagtggctgaggaaggaaagcttcaagctggccatgggggtccccaacagtcattccaggcttaaatgatgactagcctaggtcatcagagccccgactccccagagactaaaatcagagctctgtcttgttatgataaatttcatttgcttggaaaaaaaaatgctgaaagcccgtgtttaaaatttttgggcaaatgccccaaccaattgacttggcccaaaaaaggtaaggtaaataaacctttttccaaatga

SEQ ID NO: 532166 - DNA, 135 bp, Homo sapiens
cgatctggggtcgaggatatccaaggatatactatcttagcccgctcatcactccattcgaacaaactcatcataagattgattcttccgcagcaaaatcctggatgcggctatatccacactaggccctggatg

SEQ ID NO: 532167 - DNA, 281 bp, Homo sapiens
ttgggggggggccccccctcctatttttcaagaggagtttttccttttccgcttttttaacccgggggggcccctccccaggggggccctttttttttttgtgccccccccctgtcccttttttccccaaattggccctgttatttgggggttcccttcccctcctggggttttaccggccctttttgggggggcccggggtttgggggggtccccccttaaaaaaccccccccccccccttttttttgtttttcctttttgggggttttcccccccccca

SEQ ID NO: 532168 - DNA, 1296 bp, Homo sapiens
  misc_feature (75)..(75): n is a, c, g, or t
ggagtctgagctggtgctgatgtgcggctgtgcggtgtgctgtgctggtgcatgcatgcatgctgtgtgggtgcntgctgtggctggtctgtgtggctcctgtgtgcctgggggctgtgctgtgctgccatcgtttgttgccctgtggtgcctggtgggtgatgtgcctggggatgtggtgtgcccctgtgtgtgtgtctggcatgggggactactgtgtaaactggtgcctgggagtcttgagtgaaacgttgtgatgccttgatgggatgcattgcttgctttgggatgcccctgatgccctgggatagccccggatgccccgacagagatgggatgcactggcccctggaacccctgatgcatcaccccctgagagaatggctcccggggagcccgttgggggccattgagagttacaggaggagggccccgcctggcaaggcacaagcgaatgggacgtgggatcggggaagcgtggaggcactggtgggaacctttgggggttagagaacgtgggggtttgagccccccttgtgagggtgaaacatgagcatggcccagcctttttggacggtagaaagccgcatggtgagtgcgtttggagaagaagcattaagttccaagaagaggcattcccaggcatgttcccagtgggggacatggaattgtgcgcacggcggacaggacaatgctttagagagcaaacgggcattagatggggtggtgaggccttagagccgagtacacgagtggcaaggggcatgagaggagaaaggccagtgtcattgtgacgctctattgggaaggtttacccagaagctttccccggagggacgaaagattgagtctttggtgaaccccggatggtgttggagtatcccacatgtgctacccaaatttgtgtcagagaggaagagccaacgagggcactctgtgcgaggttgatcgttgaaattgtcgccgccgcgtttggcgcaagatgctttaaaatgatatgtggccgacagtttgctgtgtacagcgtaactataggcgtctacgccacacgtacagtggcgacgggctaaggagacggcagtgtgtagagcgcaattccagacgttttatacacgtatgggccttttggactggagtattaccagaagtcacaagagccagcagagtggatagaaagcaccagattaggcttgggtatctggagcagaaagcaattgacaaggagtggcagcgcagttaccgccgcgagaggggggcatattagtgggggatcatatgttaaggagaggcgattcg

SEQ ID NO: 532169 - DNA, 399 bp, Homo sapiens
ggcaggttccctaacagtcaggattccggttgcagtttttctcccccgccccaaagatacgtggttgcagacggagaaatggaggccagagacaaacaagtactccgctcacttcgccttggagcttgggccagaggtattttgttgaaggccttggtcttcagttcctcttcccagggagggaatttttacgggaaaccatattaagggagtcatttctcaacccacaggccttccgggaaaccattcccccctcctggatatcctccctcccagggccctaaagaatttgatacatactagatccctacaggggttccctgggtcagggagatgctaaggaggcaaggaaggacgccatcccccccctccctacagtcacatatctactgggctccc

SEQ ID NO: 532170 - DNA, 1292 bp, Homo sapiens
cgtatctttgcgtatgagcccgaggctgtcttctctccgtgagttggttgacctctctgcgtttttgtgtggttctgcctcttccccagatgttctgtggctctctcgtcttgtgagacgtgatatgtgtgtggtgtgcctccccgccgcgccaggttcagtatattgatttcttttgtcaggcgcggtgtgcttctttcacccccccgcggtgcttcgctttggtgtacgctgcctcctctcggcgtggagggtggatgtggtctttcgttcttgttctgttcgctctgtcttctcttctttaagcggcggggcggggagtggggatgcgtgcgcgccggcaggtgtgtgtgtgtgggcgccctctccccgcgggcgggtgtgttgtgcgctatggtcccccgcccttgggttggttcgtggggttgtggtcttcgttagctgtgcgtctatacttttggtcttttggtcttgggctgggtgttcccctcgcccctgcgtggtgtggtgtgttctctgtcgcacagagcgcagcgaggggtgtttgttttgtttgctcctgcaccggccctctcgtcactctctgttttgtccgttgtcgggggtggcctctctctcgcgggggagcgcgtgtctgttttctctctctctctgcgcatgctgctcaccctcgcgcgcggcgtgctctctctcgccgcgtgttttctctttcccgcccctctcctcgcacccccccctcacactcacccatcaagtgtcccgcctccttgtttttctcccccccacacccgtgacagaggcgcgcgcgcgcgcgccgtgaaacacttagagagggtgtgggtgcttctctcgctccttcttgtgccgccacttttcttgttcctcctccagcgcggaccaccctctcgcgaggaggcgccacgccctctaatactctctcctccccccgcgcgcgcgcgccccacccgcgccgcctcccccgcgcgcgcgcggttgtgtgggagagcccgcaccgcctctcttctctctctctgtgtgtagaattttttttatgtgtgtgtgtgctgcgcgcgcgcgtgcgctgcctcttctttcttgttgtgtcgacagatattttttgtgtgagagagaagtttttctcccctcctcgcgcggcacccccccctcccctctctctttacaaacaccccctcttctttttcgtgctgtggtgcggcgccccccctctctctctcctccccctctctcttttttttttttaaaatatcaccccccctcctcccccccaccca

SEQ ID NO: 532171 - DNA, 821 bp, Homo sapiens
tggggccccattggtttaaatgggaccttttaaaagcggggggtccccccaaccccccaggtaaaccgcggggggttttttttggccagccaacaattccagtggggggttccaaaatttgtccagtggcccagagggaaaagggggggtggggcagcaaggaaggggcgggagacagataatcagttctcccaaccaacccgggggggggccctccggtgttctccaaaagagtgtggcccagaggcgcacagtcacagtaccacccacaaaaatatccagagggccacggggggggggcacccctcttaagaggcgcaggccccaccccggtgttatgtgtggcgctgtgttgtgtgtgtgcgccttgtgtgtggggtcaaagccgcccgtcgccacctcggcgttcttagaggggcgcccaccacaggggggggaggggtggcgcctgggggctcctcacagggttgcggcccccgtgctttatatacgcctgcgaagagagtgtgtctctctggggggccgcgcgcggacacactctccctctcacaggggggaaggtccagaggagatctctctttactccaaacatcacatatcaaacagataaggggcgctctgtttctccccaaaattagggtgggggcgcttcttctcattatcagatagagaaaagctgctatataaaagaagagatattgtgcggcgaccaaaataatgggggggaggacataaagacagcccagaagaaaaacaccgtgtttgttgcgccaaaaacaaactcgttgggaaagacaacaatctttacagaaaagatgccg

SEQ ID NO: 532172 - DNA, 142 bp, Homo sapiens
gggcctcccggccaaatcccccggcctgggggttttttaaggggcccccccccccagggggggccaaatttttcggttttccccggggatttttaaaaaattttttgttttgataatgaaaaaaaacccccccccgggggca

SEQ ID NO: 532173 - DNA, 894 bp, Homo sapiens
cgcgttatgtggttgggctccctgttcgcgggcccctgttttaataatctttggggggccaacacctgtggagagtttatttccgtgcccgcacccggtgctgtgttatgtgccgctctctttttcccacgccgtcagtttttcttacccgtccaaatagctggcgtcatccggttgtaaaaacgcacccgtgggttgggttaacaaattgcgttgaagcccctctcctgccgccgttcaagccgtccgccacacgcaaccccaggcaaggagtaacgcaaaaaccacgctcctgttaatcgtagtgaaatgggctcgcagggcccccgtggttcctccccacgccgagggggagccattacgtctggctggtctccccaacgtggtattccccacttgttctaatcatttctccccggcgaggaattaacccttgcttcccactgtatccaagaataattgtataacaccccacaccacgtaccctcccccttttggtaccaacacacgcatcaacacacgccccctctgtgcactacgcaacaccaacaccccggtggctttctaatcccgcaacaatgtaccaacccacccccgtcgttgtatggccgcaccaatttgccaaaaagtgttttctcccatcgtgcttatttcaagacgcgtcttttcacacatgtgcccacggcgtaaacccctcgtctttccacagagcgagtaaattcttccgagtccccctacacaataatttattactcatctggacgcccttggagcttatttacagggcagacgccaccctttgggagcttaatctgggggagtaccccgtctaagcccgggaggttattccccgcccgcgggcacccaaaggggacccccctttccccacaaaac

SEQ ID NO: 532174 - DNA, 957 bp, Homo sapiens
tgaatacgtgccactgggctcctaaattctgcccgagcatgtataattgccactagattaagcacatggtttgtgaatgaagtagacaggaagacgatggagagtgtgatgccctaagacagactgcacggttctaactggagtccctggatttatccagtaggtacatgtgcatagaatggacgtagtatagatgctaagactatgttgaaggaacaagaaaatgacttgaggaatgaactaagagctgactcggataaaataggtcacaagttctgaagagagagtggaacgaggagggggttccagtcaatggtccgtaatcgctacaatggtgagcgcatggatgggatttgatctcctggtcagctactgggaaagaaaattactttggcaaatttggctgtacaattatattaaagatggcactatcaatgtcgggggggtttaggcttaatctagcagaataagtcttaaaacctatgtgtgtaaatggttgtgccctttggtgtctagttatctttgaagatagaatgtaaaaacaagtcatgagataagtggattttgatcccaataaaagcatgggtataaggcgatatgtgggatgaacagtctggggcaatggtggcttaatgtgggtataaaatgtacttattgcggatactattttcatattgagggtgggagaacactgttgggggactatggctttgatgggaggtgttgtcctatttgactgaaggttgtaccgagagtggagcttagcttggcttggatcattaagaagcccgaactcggttataggagattggtaggcgacagtggagaggggaaaagtagtttggagagtttaagaaggtctcaaagacgtattcaggaaacggagttaatacgagaaacaagagagagcgtgaaaaagagacaaaagaccctacgaaaaaggggaacaattgtagg

SEQ ID NO: 532175 - DNA, 426 bp, Homo sapiens
cggatagtagaatgcatgtttacaataattaggagacagagtgtctggccacttctcttcgtgtgaacagtcctcaagtgtctccccaaccgccgccttcagacgctgcgataggtcgtggcccatgaagtgaaatgtggaatagagtagcaagaagttttccggagagaactagtgagtttaattcggggcatgtgacattggacgaggctacagactgggaagcacctcagacgggtctgtgcatgcctgaggcttaagagtaaacatttgtcgagattacggaaaccatccgaaaagagctgacctaaagctataagagacaggcccagtggctcccgcctgtggtctcagctactagctactcgggaggctgagacaggaggatctcttgagcccaaatttgagtctacagtgagctatgat

SEQ ID NO: 532176 - DNA, 255 bp, Homo sapiens
  misc_feature (84)..(84): n is a, c, g, or t
acttagtaggatccccccaacaccagtcgtagagtcacgttccgcacgtatctagtctcatcgccctccatcctacgcatcttnacataacagacgaggtcaacgcatccctcccttcacatcaaatcaattggacacccaatggtactgaacctacgcagtacaccgactcacggcgagactaatcgtgcaactcctaacatactatccccccattattcctcagaaccgggcgacactcagggtaccgcagct

SEQ ID NO: 532177 - DNA, 214 bp, Homo sapiens
gtttttgttgggggcaggttcctcttcccccaggcccgggagcctcccccaagtttcttgaagccccgacctttcaggttagaccctgggccctggaggttaggggattttccccaccccagccccacccctgctccttccctaatgctttgaggtttttttggttggaagctgcagctggcccaagaaagaaaataaaaaaccacccttttga

SEQ ID NO: 532178 - DNA, 559 bp, Homo sapiens
atgtcttacgtagatggttgtgtgatcgcggtgcccaccgcaaaccgcgaacaattcatccggcacgccaaggccgcagccgtggtgttcaaggagcacggggcgctgaatattgtcgagtgttggggcgacgatgtgcccaagggcaggtgacctcgttccccatggcggtcaagctcaaggaagatgaaaccgtggtgttttcctggatcctgtggccatcacgcgaggtgcgtgatgccgggatgagcaaggtgatggaagacccgcgcctgaaggcggacgccaatccgatgccgtttgatgggcagcggatgatctatggcggatttgagctgatcctgaacacctgaggccaggtgttcacggacggccgctgtagtctgatcgcctgttgcagggtaggaccgacgacagaaccgatgcaggaccgctacgaaaactccgcaaaacaagggcatgacgcgatttgtctgacagaaccgtcgggtagacaacccggctgggtgggctaagttcaaggtcgacgcggccgcgaatttagtagtagtagtcgacc

SEQ ID NO: 532179 - DNA, 1015 bp, Homo sapiens
ggtccattgcttaccacctgtagcacccctctactcaatagtctcccccaagctttgtgtgctggtctcgcgggcttcatggatgatgaatgggccggaggggagttggtgtagtcactcaagagattctgtgcttccacgaggcttgccgccactcctctggtgctattccctgaggaagaggccagcaatggccgggatcgtggctcctgctgcttcagttcctgcggcatcctgggcgtatccaagatgtggtacctagaacgtcttatccactgcaagttcagagatcccctggttctctgatgacaggtgtcagatgcctcctgggtctcagaactgctgtggtcacttctgttcgtccctttcgcgggggtatcaagtaaggtggcttcgtcctgttcatcgcgcaactaggggaagcgaatgaggagtcagcactccgtgtacatacagttggtggccaagggatattgggccagaacagggataacgggtcacttccgggtgaacgaagtagagcgacggtgaaggcgagaaagaatatcccggtattgcggccccaggcatgacgagtcttctgtttgacctcgactcaccctgtgtacctttgtcctgatgtggcaactgggaagatctgagctcggcaggagtcacggacgtttaggcccatgtgcatttggagtgtcactcccgagagacctgccgatgacctgggtgagcagactgagtatcactgatctgattgaggggccgagctttcatgctgagaccgtacaagggaatcagtgcgtacgacaggctatgctcaagttcagtctggccgtgaccctaagaaaaggctagattggaggttctgggccgggaagctggagcgagaagctttgatccagaagggttcgagacacagagggtggtagaagtgcagcgcggatggggcccacaggtggggaggaagccccctgctgcaacagtggcaagggcagggaaggtacaagaggatggagtctaaacg

SEQ ID NO: 532180 - DNA, 775 bp, Homo sapiens
aatgtgaataaacagcctttgttgcttacacaacagcctgtataggtggtcttctatacggacacgcgtgacacccaggagttcgagacgagtctgggcagcatatactgaggggaaaaaaaagccttctttccttgggaaagtgcacggaaggccacgttcaaaggctggtcctgtgatgtctcctggatgccctgccaatggatggctgcgattggcgtgctgcatgaggagcgctgctgtcaccagcttggaggagcctagggaactgtgtgtgctgctgtgctgcgagggcgacagcgaggtgacccaatggctgggggtttctctagctatggatcaggcagtgctctgggggacttgggatcgctccaatccgtggtgcgagacttccagaagaacgctctcatgggacgtggctgctgctgcttattgtgggcatgcggcctactcgactagacgatatcttgggaagccgggagcgtaagtcggaatgactcatgtctcacactgcactccttgaatggaatatcaggggggaagactcaggtactgggccgtcacgtttggcatgagcaatgtatgtcccggggactcgtgtggaccttcgcaggacgtggcagtgaggtttcaacagacgaggagtggaccctgcttggacccagctcagagggaatctctacagagaacgtgatgctggaaaattctaggaaacttggcattcatagattgggcaacttcatgtaaacaaagaggcaccctaggcggaatacta

SEQ ID NO: 532181 - DNA, 1137 bp, Homo sapiens
  misc_feature (430)..(430): n is a, c, g, or t
  misc_feature (525)..(525): n is a, c, g, or t
  misc_feature (552)..(552): n is a, c, g, or t
  misc_feature (582)..(582): n is a, c, g, or t
ttatagccgcatatgtccaatggcggagatggacccatgtgtgccttaatatattcttgcaaattggcaatgttgaattgagcgcctctctcgattgtgatgtgctcgtgctggaacatagctgggttagcagggaagaccccctagttgttagatttgtagtattcaggagtgtactggccgtcgctgttgacagccgatacaatgtctgtttgcctcaagctaaatgagtcttagcgtctaagtgagtagcacccctttactaacttagctagtagtataaaatcattttatttagttaattaccagagagatttagcataattttgttctggattcagtaaatcaagtcagcttggatcattcaccttaacttttcctttagcagccatttccactagtttccattaagtagtgttctataaacttngatccaaagcagaatcaatgtcttttccatctcgtgacttaaagttctgtgactgtgatgcatgtgagtgttccgacttcatctgttcctcttanctacggtgtttcccttaccatggcatncataggatgaaatgaatgactgcccagaangagaatttgtccagattattcagataacatcataaagcgaatactattataaataagtagaatatgaataaatagaataatacaattccaaaatagtcaatgggaaagtgactagtaatataggcttgcaagagttggtaccttttagctatatttgcagattctctgggattttaaggaagtgagaaaacagcagagttgactaaatttgatatttcttgtcctctaaatatttgataagtttcgtgggattgatgcagtgatgttgtagtgcgcttccgtatttataaatgaaagcacgcgttatgttttagtgtttctaaacctaaaagtgtactgggtttgaaatcaacgtggttggaacactgttgtgactgttatttgaagcatgtcgtcgattgaagaatttcattgaggaagttttcaactcagtgtgatcagtttgattctgttgtgagcacagcacctaatatttgaggagctctgtttgaggacccgtgcttacgggggctttgttcgtaaacaatatcgcatagattgtgacttgaggtccgg

SEQ ID NO: 532182 - DNA, 965 bp, Homo sapiens
gctcctattaagtggtggacgtggcatgtccaagtgcatttctgaaaattctgctaaggggtcattcagtttagaatacatttagttggatttaatgggatgtgtgcctgaagtcactgtcacttcttgtacagtgtgcagtttaagctatgctggcaggggaaacgcacatatcctaccttgagtattttatttgatgccaaaatgcttctttaaattttattctattttattttatttagagacaaggtctctaaaacaatatgtttcctgggctggggtgcactggctattcacagacatgatcataggctcactgcagctcttgaactcctgggttcaagctatcctcccaaggagctgagactacagacacgcaccaccatgcccgattcaaagtgcctctcatatccacagggaagaaatgctgagttatccataaacttcaaagcctgagcatggctgtgggaggcagctaatagacaactctgcaaagaatgggaatcatttgaaaagaagcgtggagctttcacaaaagagaagagagctagagcaataaacaatttctatctacacaaagaggagcagacacgttcctgtctggaccctttatttggactccggtgggtctgaattgaactgctttagtgggagctacagaaggctgggacctggggatcacaatggatgctgtaccgtgagatgaagttggggggcgtgtcatcacaaggatgcgggtgagacgcagaataatgctggaaagccgtgcatgaaacaggggggtggtccgcgagtgaggctgcgagcaggcaatatcatggtcaaaacttatcattcgggtagggcgggaacccagggacggtattttaccgcaggggcacgtacaatgtgttaatcggtggacacgggggtaaacgtgaaggactacacagtgtcctcttcttagatgtgactcaagtcgtccg

SEQ ID NO: 532183 - DNA, 888 bp, Homo sapiens
gtagggccccttccagaaaaacttttcaagggtcttccaggggacccgttgagaaaaatacctcgcgtttgctccccctggaattccccccggggcccccccgttaggttaaacccaatatcgtgcgcagaaagagttgacaacaccattgtcgcatcgctgcgtggcgcccactctccttgttgtgaaatacatttctcagaatagcgccgtgatagagcgccatctttttatgtggtcgcatctcgtctcatgctcgctggcagtcttgagcgcatctcccttctcacacacgatggggacacacaaggggcccctgttagcttggcaccacacatggggggtaataaatttcatctaccacagtgtttgtcccccgtttctcacccattccgcccgctaaaagtgcgtcattccgttcacagctgggtgagactcgtatatccccacgccacgcacatatgcgcccagtataagttccggtgtcacgattttatgtcgcttgggggacatagaaatgggtggaggcgctcgtccaacagtccgccagcgtaccattgggaggggtaaacccacgttacaaggggctgcacacggagagctacagagaggtggacacctgcacattcacgcctcgggtggaacaagagatgagaatacctcggcacccaaaaaaaaaaaaagtagccacggcatggtggcgggagcctgtgtgtcccacgctgttcacgtaggctgaggcacgagagttcaacttgaaacctgggaggtggaggttgctgtgagctgacaccacgccactgcactccagcctgggtgacagtgagactctgtctcaataaataaaaaataataataaattgctcagatttctttggttccttttta

SEQ ID NO: 532184 - DNA, 106 bp, Homo sapiens
  misc_feature (23)..(23): n is a, c, g, or t
  misc_feature (100)..(100): n is a, c, g, or t
ttttatattccgtgaatgtatantgtcttgtaatgttgcataatgttcacctttttatagtgtgtcctttattctaaacagtaaagtggttttatccttntcacac

SEQ ID NO: 532185 - DNA, 738 bp, Homo sapiens
cccgccgtactttcctccagcttgttcctggatcggcttttgaccggtagacatattaaaaaggaagccattctcaacctgaatgcgttcaaccttgaacgtcaacgaaagcaatgaaacttaatatctattatggccggactgtgcaggcatgtgcactgagtgcatggcgtggcaggatgcatacaaggaggcccctctggaggctattatcaagcgagccaggtctatctgtcagcgctccgaaggacagtatgttgaccggagttcttgtggggggctctagtctcagtcgcttttgacagcaagctatacctattagggtccaattgccgccagcctagctacagagcatgtagtagagtggctgtcagcgaacttcttctcctacaatcatgatgatgtgtgacaattagatctgatcttctggaaagacgacccatgttaaatattaagttcaagggggagcaaattagtcagttcttgtaacattacaatgtatagcaagcaagtggtcagatttcacacagcaggttccttggaacactttcagctcccgatgctcctaaatatccaaccaataaaacaataggctttgaaacaatatgggctcctcatccaaaggacaactgctgcattgaaactcgtctttagctgagtgtagaaaagtgcatcttatgaaacagtgttagcagtggtaggttggggaggagatagctgcaccccgtctcgaaataa

SEQ ID NO: 532186 - DNA, 5228 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagatgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccctccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattgctgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532187 - DNA, 170 bp, Homo sapiens
tggggctttcgaacgtgcgttatggcaggggttttatattgataattgttgtgatgaagttgatggcccctaagatagaggagagacctgctaggtgtaaggagaagatggttaggtctacaaagtgagttccaggcaactcgaaagccccaagcggggtaccgagctcg

SEQ ID NO: 532188 - DNA, 1557 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagatgacttcgtcatggtccccgcgcagtttccaggtgacctggtggctgaggcgcccagtgccaaacccccgccagacagcctgatgtgcagtgggtgagcccccatcccttacctctgtattttaggggagagaaactgtggccttggaagtggcccgtgttatttacaatgagccgagatcgcgccactgcactccagcctgggtgacagagcgagactctgtct

SEQ ID NO: 532189 - DNA, 431 bp, Homo sapiens
  misc_feature (37)..(38): n is a, c, g, or t
gcaatctccgcctcatgcagtttcgaaactgacatanngcaggatttttgtctctccttctatagctgaaccccacagtccttaacagggcctggcatgtgtcagtgaacaaacgagcctcagtttccttacctgcaaaagaggatgaatacattgtaaaggagatgattcgtgttgaggatgagcctccgtgcctggctggttgtgagtgggcgggtggtgttagctgccgccgcgtgtataaagcctgccacgtagatcccagtctaggctctttggcaagctgagctcatgggggtggactaacctgtctgctggactcgggcagtcgggggttggcccggatgagctcctcctgctcctccagtcagtttgtatctgcagggctcagcctctggcccccttccagcttcctggtccgacagcgcctt

SEQ ID NO: 532190 - DNA, 256 bp, Homo sapiens
ctgatcgtggtatcttggcaccccagcgtctagcacagatctaggcataaggagggcattcacatacattggtgatgtgaagttaatgtggattgagatgtagtacaggaccaagttatgagaaacaagagaaccatgaactttagctgttccttgggcactcgactccggtcatgtgttgtacggaccagtgattcgacatgtaccttccttccccagaggtacacagtacaatatctctgataaaaagtggtgc

SEQ ID NO: 532191 - DNA, 4309 bp, Homo sapiens
aagacgttggtccccaccatcccccgggagaccaacgtcttgttcttctcgtagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagatgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccctccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattgctgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532192 - DNA, 2938 bp, Homo sapiens
gctgtacggtccatcgtaatctgctgcggcagcgagaccatggccttggctgtcttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccctccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattgctgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532193 - DNA, 184 bp, Homo sapiens
ataggctgggggttattgacgagtacttcggctggatcactagtgcttatggtctccaaggaaaaagctttttcctgtcttggacgggttttagaggtattcactggaacgtcttctctaatctcttctcctaattcttctgtgtcctgtgcagtagagttatcttcaccctgcttcttctttt

SEQ ID NO: 532194 - DNA, 2186 bp, Homo sapiens
  misc_feature (25)..(25): n is a, c, g, or t
gcaggctgtaccgcctccgaggtangggatatcgtcgacccacgccgctcggtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532195 - DNA, 727 bp, Homo sapiens
gggagcccaaacctggagaaggtcatctcgcatgcactcctgaggggcttggttctgggaaaactaggaaaagcaggacataaggcaacgttagaagaagcccgtcgtcggtttaaggaccacgtggaaggaaaacagattctctccgctgatctgaggagctcctgtctatctgactagttaggaagcatggtgatggcactactttagcatataatgtgtgagaaacttcataaacgaagcagatatgcaagaagagaacaaccggaatcgaaagagtccttggtcgctactctttggcctgacctgattcaataagtcctcacgtttgcgctttcagaagaggtacgtccagaggaccactgtatcgtgtaatagagtgagagtagctggaggcatgtaagcgatggtaggaaagctgcttggaaattcataaaggacgaactgggaagaattttataagcgataccaggaggattcttaatatgccagactaataaagctatctagttgagggatttgcagttgatagaaatcggtggagaggttaaggctttcttcgaggagtcagccagtctccttcagctgaagcgtaaccatccagagcaggtcgtgcaaacactattctgctgaatgctgactggcttaaagcgagatgctgagagcatacaacagtacctccttccgcggaaaggcttcaacaccacaagtgtggattcctgaggtg

SEQ ID NO: 532196 - DNA, 3836 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagatgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532197 - DNA, 1771 bp, Homo sapiens
ggtagtaaaaatccagtctgaacaaacatgggaaaagtcagcctccctcctgccccccttcccgcccaggcaggccaggcagcagcagtaatgacactgactgagcggcgggcactctgttgtcctggggctgggctgagagcgctgagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532198 - DNA, 1826 bp, Homo sapiens
actgaagcctgtggagggagaggggagtgtgagggagacgcccagagtccccagcccccagcccagccgggcactcacacttggtgacgttctcgatgtcggcctggtccgagagcatgtgctgcagcccctccaggagcagcagggccttgtggtagcgtgggacgcagcccctcacggtgctggaacatctcgtccagggcagccgactgcaccatctgcacagcgtggctgaagatgagcctctcggcagtgatgctgtgaatgcggtccaggagccgctgcttgtccaggaagaagcgctgcagccgcaggctcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532199 - DNA, 205 bp, Homo sapiens
atctggctccaccgatagtccagctccctcagtctggcacccgactgctacactctagcctctattagccacttcagaccatccaggtgtcttcccgggccctgctagaccctggtcacattccctctgctgatatgtgctggtctcagaaggccagagcgcccgctttccaatcagccaggatccagctgcgtttcacttccga

SEQ ID NO: 532200 - DNA, 920 bp, Homo sapiens
ctccctacctgggcctggaagcagatgaggggagggtgctgggcacacacctgtcctgctgctgccacagggaggggcggcaggggacagccaccaacacaggtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532201 - DNA, 1403 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtccccccta

SEQ ID NO: 532202 - DNA, 221 bp, Homo sapiens
cagggcctggagccccatcggccaagaacacttcaacaaacagagtggcctccctcctgtgccatcctgggccactgggcacacagggtgtcaaacattcgtgacctggggactcaggccccggtgctgcaggagtgtcctgcccatgccccccccccccccatctctctcccttttggaaaagattctcttctgtcagtgttaaagattttgttttgttg

SEQ ID NO: 532203 - DNA, 136 bp, Homo sapiens
ctaactcaggagctgctaactcaggagctgctaactcaggggcgagctgctgctggtaaggagactgagcctgtggctgtgagagctaaggtcggggcggggatgtagagggtgatggtaggcagctccccctgag

SEQ ID NO: 532204 - DNA, 166 bp, Homo sapiens
gcagcagcgatctacgcaggacttggtattgagtggcatgtgacgcagagacatcaaggggctgggggtgcagggaggtcaggccactggggcaccagttgaacactgttggagctagtcctcaagggccaaatggtgtcaccaagtatgtaggagtaaggtgtat

SEQ ID NO: 532205 - DNA, 889 bp, Homo sapiens
  misc_feature (44)..(44): n is a, c, g, or t
  misc_feature (65)..(65): n is a, c, g, or t
  misc_feature (70)..(70): n is a, c, g, or t
  misc_feature (77)..(77): n is a, c, g, or t
  misc_feature (100)..(100): n is a, c, g, or t
  misc_feature (116)..(116): n is a, c, g, or t
  misc_feature (119)..(121): n is a, c, g, or t
  misc_feature (126)..(126): n is a, c, g, or t
  misc_feature (130)..(130): n is a, c, g, or t
  misc_feature (137)..(137): n is a, c, g, or t
  misc_feature (145)..(145): n is a, c, g, or t
  misc_feature (147)..(147): n is a, c, g, or t
  misc_feature (175)..(176): n is a, c, g, or t
  misc_feature (186)..(186): n is a, c, g, or t
  misc_feature (196)..(196): n is a, c, g, or t
  misc_feature (226)..(226): n is a, c, g, or t
  misc_feature (263)..(263): n is a, c, g, or t
  misc_feature (301)..(301): n is a, c, g, or t
  misc_feature (312)..(312): n is a, c, g, or t
  misc_feature (320)..(320): n is a, c, g, or t
  misc_feature (322)..(322): n is a, c, g, or t
  misc_feature (340)..(340): n is a, c, g, or t
  misc_feature (369)..(369): n is a, c, g, or t
  misc_feature (372)..(372): n is a, c, g, or t
  misc_feature (409)..(409): n is a, c, g, or t
  misc_feature (412)..(412): n is a, c, g, or t
  misc_feature (427)..(427): n is a, c, g, or t
  misc_feature (465)..(465): n is a, c, g, or t
  misc_feature (468)..(468): n is a, c, g, or t
  misc_feature (477)..(477): n is a, c, g, or t
  misc_feature (503)..(503): n is a, c, g, or t
  misc_feature (528)..(529): n is a, c, g, or t
  misc_feature (550)..(550): n is a, c, g, or t
  misc_feature (644)..(644): n is a, c, g, or t
  misc_feature (695)..(695): n is a, c, g, or t
  misc_feature (697)..(697): n is a, c, g, or t
  misc_feature (701)..(701): n is a, c, g, or t
  misc_feature (706)..(706): n is a, c, g, or t
  misc_feature (708)..(708): n is a, c, g, or t
  misc_feature (714)..(714): n is a, c, g, or t
  misc_feature (724)..(724): n is a, c, g, or t
  misc_feature (739)..(739): n is a, c, g, or t
  misc_feature (747)..(747): n is a, c, g, or t
  misc_feature (776)..(776): n is a, c, g, or t
  misc_feature (802)..(802): n is a, c, g, or t
  misc_feature (824)..(824): n is a, c, g, or t
  misc_feature (858)..(858): n is a, c, g, or t
ggggggggtgaaagggccaggtcagagggccaagttcagacttnagcagcagaatagggtcagantttancaaagtnagaactcgaggttcatgtaagtncttagatcccgctccnaannnctgtntttntcctccntccttctntnctccctccagctcagtgtggacacacgnngaggtctctncctcccagcnaaagctcgggtatcccaagctgggaaatgngtcactcggggctggggtgctgatctgtagcctagtncttcctggtccctcttgaggacagtggggatgggattngaacgggcctnggcccggngncccaggcccattcctggntcccagccccccctcagcagcagtttgangcncgggttggagatggggaccccaagtggaaggttgggnggntgagggccctggganagtgaaagcaggtgagcagtggatgtgcggtggttggnatnttggaagtnggtgttatagttcttggagtattggngggagggagtaggagatcggttttnnggggttttgtttcttcatggntctccctgaccatgcgggctacctcagggaagccagcttcttcagcgagctgagccgcatccctgccactcagctcacagacccccacccaggnagccccacggcccaggagatagctcacagctgccccctggcccgctcgaananaaanatcantngggtcnccagaaggcntcccgggcgttgatnttcccccngctcttctgcctcatgcggttccagagtntctaagtatggaggtcccctcctggnctgcctcagtatccggtgagtntcttatctcagctcaaggatctccttgtcctgtnttctgatgtcttctgcaatgctttgtggtgg

SEQ ID NO: 532206 - DNA, 131 bp, Homo sapiens
tttgttttcagtttctcagaatttgtcttagcgcaaagcagtgagggcagtacatgttctttttgcattaataattattgttatccttttagataatgatgtgttcatttgaactaactacattatcttga

SEQ ID NO: 532207 - DNA, 385 bp, Homo sapiens
ggaaccacgaaggcgggggctggcgccatgattggcagagctagaacaaggaccctgtcaaagctgatgttgatccccctggactcagggttagcattagttagagaagcaggaacagcacagggttgcttacactcagcactcttgtcacaacctaatatttctggtacaaataaggacaatgcatgtccatcctagagttttatattctttgctggctctttaaagtttacagagaaaacagagggcagcaatgtctcaataattctgtatttaaagaacaacatgggtcgggctctgtggctcacacctgtaatttcagcactttgggaggccaagggcggtagatcacaaagtcaagagatcgagcccatcctggccaaca

SEQ ID NO: 532208 - DNA, 197 bp, Homo sapiens
gcggcagatggtcagtggatgagcacatcggcaggtcggagccctgggcgcatagtcgaactggaatccatcggtcatgcgctcgccgaatcagacatgcctcttgtccttgagggttctggctgatgtaccagttcttctgaggccacactgggctgacgtggggtacgcgcaggtctcaccagtctccatgtggc

SEQ ID NO: 532209 - DNA, 334 bp, Homo sapiens
tcgacatcgacggtttctcgctggaagactctattttcttgaagcgcggggaactacgtattcccaccaacaaaaatctgttaaggggcagggcgcagtggcgcacgcctgtaatcccagcccttcgagaggccgaggggggcggatggcttgaatacaggagttcccgaccagcctgggcaacatggcgaaaccctatctctacgaaaaaaacacaaaaattagccgggtgtggtggtgcgtgcttgtaatcccagctactcgggaggctggggcaggagaatcacttgaacccaggaggtggaggttgcagtgagccaagatcgcgccactg

SEQ ID NO: 532210 - DNA, 151 bp, Homo sapiens
aagagatagtcatcaaagccccgcattacccagggatcgggcccctggatgaatccggattcccacagcaattagaccgacagtcgaccggcccaaggactggtacaagacgtgtttaagcaattcacatggtgcacaagccggtgtgcac

SEQ ID NO: 532211 - DNA, 107 bp, Homo sapiens
ctgggcacgtgagggcgcccaggggggctggcaaggagctgccgccggatcccggggaccctcctattgatgcccgtggtcaccacaataaagagccctccaccctc

SEQ ID NO: 532212 - DNA, 438 bp, Homo sapiens
  misc_feature (37)..(37): n is a, c, g, or t
gcacctacactaagacatgtcggggacatgcaggtanatcatgctcgttggttgtgacgattgttcgatagatgcgtgcgtgcaaatacgcgactatctgattcagacaccctagcccagtgtaacgtaggcatccaccagttcctcacgactctgtcaaccagtgaacattcctagagacgctcgcgtctcatatcctgaatcctggctcccactcaagagtcactgcgcattccataggtaccgcaaggtccacagtagctcttgtgagcgctgcctcccatcaacactgtgctccatgtcttttttcttggcaagccccttgttcttttcccaggggctccaaagaactgtcataagtgtttttgcctggtagaaaaatccttaaaacccgggacctaaaagcccatgaagtcttcctggaaccttggattgctc

SEQ ID NO: 532213 - DNA, 159 bp, Homo sapiens
ggtggtccatgccaatacctccaaagaactcaagcaatcagcaagaagaaatctctttaaaaagcttggaaacgacaagaatatacatttctcaaaagaagatatacaaatgatcaacaaatacatgaaaaaatacttaacatcactaatcatcagggt

SEQ ID NO: 532214 - DNA, 120 bp, Homo sapiens
tgggtgcatgatgtggtccaggtatcaggaggcgagtggagattgttgagccagaagttgagactaggtgtgctgtgatcgtgcactccatctgggggacagagtcagggcctgtctcag

SEQ ID NO: 532215 - DNA, 363 bp, Homo sapiens
aataaagagaaagcagagtaaaactgggactctgagatacgactaaagttctgtgtgatacgtgtgccttatttagctcaagacattcctggagcacctataaaaactgacttgtaatccaggctatgtctctctagcttccgtaatctctggcaaggccatttggattctccagctgtacactaaggagactcgatcaggtgattccctttctcagctgtcagttctctaattccaggctgggtagctcgtggcactcaaatgcaattaaacctctataacctcaacctaatcatgattacagaagaggcccatcctcccaaacttgatgtcacacattacagtttaaattagaggcgctgt

SEQ ID NO: 532216 - DNA, 646 bp, Homo sapiens
ggtggtggaggtggaggtcagagtcagagttggaatcagggctacggcaactactggaaccaggctacggctaccagcagggctacgggcctgtgctatggcgtgctacgactactcgccctatgtgctattactggctactggccccggctacgactacagtcagggtagtacaaactacgggcaagagccagcagacgtggtggccatcagaataactacaagccatactgaggcggcagcagtatggctctgggggccgtggaaaaccgcaaccgagggaaccgaggcagcgcgagtgtggtggtcgtcaggtggaatgggtcacgagtcagatgttcggactcacgggctacggcaactacttgaaccaggctactggttaccagcagggctaccgggcctggctatggcggtacgactactcgccctatggctattacggctacggccccggtacgacttacagtcagggtagatacaaactaccggcatgagccagcgaccgtggtggccaatcagaatacttacaagccattactgaggcaggcagcaggagcgaccaaaatgatcgacacatgcttgggtctgcgatctggcgtgcactcaatcatgttccaaatttaatttggcaaactttctatgc

SEQ ID NO: 532217 - DNA, 441 bp, Homo sapiens
tttaagggctacccctgccttgactcaagtttgtgaaacatttcctctgtgttttcttctagtacattcatagtttcaggttttacatttacatttttaacttattttgagttggtttttgtattggtgagaagtagggttctagtctcattcttctgcatgtagatacccaattatcccagcacggtttattgaagagactctcatttccccattgcatgttcttggcagctttaccaaaaataagttggttgtcagtgcatgaatttatctctggactctttattttgttccattggtctatgtatctgtttttataccagacccatggtgttttgataactatagttttgtactacatttttaagtcaattaatatgatgcctccagctttgttctttttgctcaggattgctttggctattcaggctgtgtttagta

SEQ ID NO: 532218 - DNA, 369 bp, Homo sapiens
  misc_feature (102)..(102): n is a, c, g, or t
  misc_feature (203)..(203): n is a, c, g, or t
  misc_feature (233)..(233): n is a, c, g, or t
ccgccacatcatggtttattttttcatttttttaagataagtcaatacattacagtatattaaaaattatcactagggcagcggggggggtaactcccatcnaaggggaataatctatatctttacccctttaaatgaagctggcattgggggattcttttatcaacaaaatgcagcaaaagtaacattgggggatttctaantctttgcctcaaaaaaccgggggggttttncttttattggaacctgagggaacaatgaaaaaccgtgtggaaagagatccagctgtcccacgtcttctagggattccagggggggctcatccatgtaagggaagccaggatgttagatatcaatagccataggact

SEQ ID NO: 532219 - DNA, 148 bp, Homo sapiens
aactgaaaccattaaaaacagaaaacctaaacagaaacataaacatagtacaaaatagggctgggtgtggtggctcacgcctgtaatcccagaactttagaaggctaaggcaggtggatcatttgagcccagcagttcaagaccagca

SEQ ID NO: 532220 - DNA, 848 bp, Homo sapiens
ggggaggagagcggggggcgccggcggcagcgcgcgtggaggcggcacttcgcgaagtggcacttcggggcgggcggcccgccgggtcgcggcctggcgctgcggggcggggagcggctcggacgcaggacgccgcgggccgggcttacaggtgggagaggccccgaccccgccgcttcgcaggccagcttcctgctgtgttccctgcacccaccgatctcacacgcagccctaggacagacgtccactggcctgagttgggtctggggccaacacggagcaggtgggggtagagcagctctgctctcctggtggaaagttgaatggctggaaccaagatgacagatggaggctggcaggcaaacacgggaggcctcctcactccaagaggggagtcagcctggggacagttcttctccaggccctgctgctcccatcagctgcaacacaggagaggtaggcttctccggaaaagctcccacggtcctggatcccgctccaccttctagaagctcccagcgttacttcctgggctggcctgcaccatcgttgcgctactcccgtccacgggggggacatatttcggtgacccgactcaagaaacggcaggctgctttcccgggtgggcagtggctcagcaagtctcggtgcttgaagcctgctcccttccgccaggaggtggggcaggtgcgctggaatgcgggctggaaggcctctccctgagaagaagggttatccactgctgtgcatggaagtgacacaggcttcggccctgatggagaacacacccgcgggcggtgaccagggcagaacaggcaggcgggagtctcaactaggatgggaacagg

SEQ ID NO: 532221 - DNA, 88 bp, Homo sapiens
catggatttgctggtgcagtacaactaggcttaatagggacatgctgtgtgactgactgtgggtaattatcacacctgtcccccaaaa

SEQ ID NO: 532222 - DNA, 123 bp, Homo sapiens
ccggatgccggccggcggaggagttcctgaaccagagctcgcgcttctacttctgttttaatagtgaccgcatcgactccctgctggggagcgatcggcagcagacgcacattctgcacgtca

SEQ ID NO: 532223 - DNA, 857 bp, Homo sapiens
  misc_feature (407)..(407): n is a, c, g, or t
ggcaggttccagaccagcctgctggcctgcgactcttcacagtgcaaattccccacaagcgcctgcgcaagccccctccctgctacctcacagcctgggatggctccaacttctttgcccttcggcaccaagtcctgtggccatgaagtcgtctcctgcctcgatgtcagtgaatccggcaccttcctaggcctgggcacagtcactggctctgtttgccattctacatagctttctctctccagtgcctctactacgtgagggagggcccatggcatgtgtggtgacggatgtggcctttctacctgagaagggtcgtggtccagagctcctgtgggtcccatgaaactgccctgtctctgtgggctcgtggacagtcgttgccagctgcatctgtgtgcctcacnggcggcggtgtccctgtgtggctcctgctccctgcggtgtgtcgggcttattatggtgaccatccgtggtgctcaagagtgcctttccaggtttcctttagcttccgtgttcctgggacatcaggacgcctggacatggcatctctaagagcagagtgggggccgttggacctcccttggtccactccattgcggttcccagctgaggtggctctgacaagatgatgggcatgcttgccttctagtgaaaggttgctatggcctggtgtgctccagtcccagggacttgcttcgcttctgggtcctcagaccgggttttgagcggcgtatctgcctttttgctaccaggtcaggtggtgtctttaaacttggtgccactgggcggtgttctggaagttctccccgtggggctaagaccgttgggggggcgtcttgggcggccaactcttg

SEQ ID NO: 532224 - DNA, 1007 bp, Homo sapiens
gctcagtgggcgtcgcgcgaaggctaagggagtgttggctgggctggctcctgggagccaacatgcctcggtatgcgcagctggtcatgggccccgctggggcagctggggaagagcacctactgtgccaccatgggtcccaggcacctgtgtagcccctcaagcggtcttgtccaaggttgtaaacctggatccaagcagcagaacacttcaactactccggtgcatggtttgacatcctgggaaactgaatcgacggtggactgacttgtacattggacgggactgacttcctcttgacgaatttcgggtccccaagcggagggactctggcgtacttatgtgcatgtggagtaccttttggccaaataacttcttggacgtggctgggacgaacctggtcttgggccattgtaaggacgggacgagctatatccttcttcggcattgtccaaggtcgagattgacgttgtacacatcaacctggctggtgatgaaaccagcttgggtccaggcagcttcgaagcacgctgggaagttccagagtcttgtggagcttcacacctgtgtgggattcctcaagttcatggttggagttcaattccaaagtttaattttctgtggccatcttgggcagcccttgaagttggcccatggatctctctaaggacaactgtccggccaaggttcacagcactccatggccccagacagtggggcaatcctgctgagttacacacacaggcaacaacacagggcgcatgggccgcacaattttaaggcatcccagaaagtggtattcgcaattaacgaggattcaacaagatgaagtataaggaagccaacaaaatttcacggaaacttggagttagagggtatattggtgggactggatgtgatgactaaagggactgggtatggcttttgaactttaaagaatcaggtaaggatgcagcgcaaacaggcttgaacaatgggatgggagcaatatggatgtgggcattcaa

SEQ ID NO: 532225 - DNA, 1324 bp, Homo sapiens
tcgacgcaccactcccggcctaacacagcgcacacaccccgtctcctactaaacacactacacacacacacactcacgcccacggcgctgcgccgcgccacggccgcccgctacgctccccagcctacctcacgcgcacacgccctgcagcgctacgcgcagcaaccggccgctgcacacccctggcgcagcgccgcgcacgcgctctgccagctgtacacccacagcactctgccacccacctgccaccatctcaagcccctggcgccgcaccccaacgcctgaagcaccatcctgaatggccgcaaacacaaaacacacagacacacagacaaacacacaaaaacacacacacacacgtcgcgcgcgcgcggccggccccagcgcgcgcccccccccgcgcgacaacacaccccgccccctcccacccacacgccccctctgcgcgcccgcggccgcgcgtcgcgcgcgcgagccccccttgttcgggcgtctcccacgcgtgtcacaccgctgtggccctactatccaccctgtgtgtcgtgttctctccttggccgctcctacttccctgccggcgcctccctctgccccccctcgcgcgtcgcctcgtggcagccctcttctctctcctactcccccaccctccctatcccactcattccctccccctctgcgtcgccgcctcgcccacactcccgccccccccgccacccgcgcgacaacacccatcttcccccacaatctcgcactcctctctccccccctcgcccctctcctcccccccgcgagcctctcctccacactcctcccccgctccgcgtcccacacccacacgcaccccctcccccaaacatcccccctccccctctccccccacctcccgctcctgctcggccgcaccctccccccattcccccctcttcccccccctcccccccctccccctctccctccgctccaactctcagcacccccccccctcccctctccgccacacgcatccctccccctcctcaccccccccgcgtcccccatcctccccatccatcccttccacccccttcctcctgctgctctcccacttcacaccactacatcacaacctcatccctacccacaacgttggcgccgtcgcccttgtccggttctcgcgcgccacaagcagtgaagatcgggcgcccttcgcctgctccttgttcgttgtgtgtgctggagccgttccctctcctcctcgccgcctctatccccggcgcgcgccgcctcccccctcttgctgcctgcgcttctctgctctctctcgctcccacgcaccggccatctt

SEQ ID NO: 532226 - DNA, 890 bp, Homo sapiens
  misc_feature (59)..(59): n is a, c, g, or t
  misc_feature (130)..(130): n is a, c, g, or t
  misc_feature (628)..(628): n is a, c, g, or t
  misc_feature (819)..(819): n is a, c, g, or t
tgagacatagcagtgtgagcgcttgtgggcggtggcgcgcggtttttcctctcaagcgncgtgctccgggcgcgcgccgtgcgtcatcccgacgtctgccacgttcgctattggcgggtcgacagcaacnacgaagctgaacaccgcacctcaacaacacgaattaacaagagatattaactcaactgtgtacataaacttatctcggtctggggtgcttagtggggggtgagagtgggtgaggggctatcgtggtttcgaagtgggcttgattacttcacactaatgcgtctgccaccccaccgaagaagacgctacgcggagcgacaccctacgctcacgccccgaccccgccacccgaccacgtgcctcaccacccagtgtcctgcgctggcgcgtcgtcgccacgtcctggtgtgtggggatgtagggtcgctcggcaggggcggccgcacatgcggtggttttgttagttgcgaacattgagactcacgcgccgccgccccgacccaagcccaagcgagaactaccactcaccctatatttattgtatcgatgattaagaagaatactgttttagacatttgttatccgtgtgcggattcacgcgtgcgcatctgtgcaatancgttgtaggacgacgtatacatcttatccaaacgacacgcccttcctcccaaccacttcgcacatcatcatcaccgtatcagatgtaaccttttaagatcggcatcacttctactgcacaccgtactccgcggagcagtgtccggatgcggatacaacaggtgctatgtgatggtcacgctgagcgatgcnccgttaatagacaaccacatgagagcccggtgcaacgtcgtccggtagtgtggtcaccctacttacggctt

SEQ ID NO: 532227 - DNA, 292 bp, Homo sapiens
ggtcgacatgcagtttagaaaagtgaattccagatggattatagttctaaacgtgaaacacaaaataataaaacttatagaaataatagctcagtaatatttcagtggggaagatttattgaacaggaagcacaatgaaggaaatgattgataaattgcactacattaaaggacttcttttcatcaagatactataagagaataaaaaggcaagttaaaaaagtgtcaaaaagtatttacaatattttataaagaactcttacaaatcaataagagaaagacaaccctatag

SEQ ID NO: 532228 - DNA, 696 bp, Homo sapiens
  misc_feature (10)..(10): n is a, c, g, or t
  misc_feature (143)..(143): n is a, c, g, or t
  misc_feature (145)..(145): n is a, c, g, or t
  misc_feature (165)..(165): n is a, c, g, or t
  misc_feature (186)..(186): n is a, c, g, or t
  misc_feature (198)..(198): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (214)..(214): n is a, c, g, or t
  misc_feature (224)..(224): n is a, c, g, or t
  misc_feature (235)..(235): n is a, c, g, or t
  misc_feature (243)..(243): n is a, c, g, or t
  misc_feature (249)..(249): n is a, c, g, or t
  misc_feature (251)..(251): n is a, c, g, or t
  misc_feature (256)..(256): n is a, c, g, or t
  misc_feature (263)..(263): n is a, c, g, or t
  misc_feature (268)..(268): n is a, c, g, or t
  misc_feature (351)..(351): n is a, c, g, or t
  misc_feature (353)..(353): n is a, c, g, or t
  misc_feature (358)..(358): n is a, c, g, or t
  misc_feature (364)..(364): n is a, c, g, or t
  misc_feature (407)..(408): n is a, c, g, or t
  misc_feature (411)..(411): n is a, c, g, or t
  misc_feature (417)..(417): n is a, c, g, or t
  misc_feature (477)..(477): n is a, c, g, or t
  misc_feature (510)..(510): n is a, c, g, or t
  misc_feature (529)..(529): n is a, c, g, or t
  misc_feature (531)..(531): n is a, c, g, or t
  misc_feature (546)..(546): n is a, c, g, or t
  misc_feature (549)..(550): n is a, c, g, or t
  misc_feature (554)..(554): n is a, c, g, or t
  misc_feature (557)..(557): n is a, c, g, or t
  misc_feature (561)..(561): n is a, c, g, or t
  misc_feature (563)..(563): n is a, c, g, or t
  misc_feature (567)..(567): n is a, c, g, or t
  misc_feature (578)..(579): n is a, c, g, or t
  misc_feature (695)..(695): n is a, c, g, or t
taagcccttngggaggaaggaggggaaaccagctcagccccaaatcctggtctctgtccaagccaggccccaggacagagggggactgatggtgtcagggtgggggtggtctcagcatgaaatctagaaacggcatcaggccncncccacacaaaaaaaaagcancaaaatttcatttttttctancttttctttccntctttncacncnttantaaaaatttnaaaacattatnacaaaaangggttntngtagntgccccnagccnaggcgccggaggcccaggccccagccctgccctgccccggacaccgcgtccggcgcggtcgggccctaggccgggaggcctcntnggtgncccgangccggcccgggctcaggcagggccatgtcatcattaaggtgcnnatnaggtanttcctaccctaaacctcatctcagggcttccgccgcccactgcctgcccctggccgaggntctgaactgtgacgctgagcccggggctggctngagggtttgggctgcaggnanggactggagttaganggnngganttnttcntntttnctcccggtctnnggccagttctgcctccactgcatccagctcctcactgcctttccttcagcttgacccgaagcagcgctgcataggtgctgtagcgggatttctcaaactccaggtaggcctccttnt

SEQ ID NO: 532229 - DNA, 340 bp, Homo sapiens
ttgtatattagtatttagaatttttaatgtgacacatgagcttgttttttgtttgtaataacttgttcatgttggattgatgataatgctaatcatgagagatgtttcttatgttttccttttaataacatacatactagagaaatcatttttacaaaggtatgttgatgggaattaaagtagagatttgaaatacattttagcaagttcaggatattcatttttaacttttattcaaaatgaagcaagtgatggtatattttcaaaatttatcttcattccttcatcagtaaccagttcttgcatttgatccgtagagttgtagttaaatttgtctttc

SEQ ID NO: 532230 - DNA, 710 bp, Homo sapiens
attctagaggccgaggcgggaggattgctggggcccaggctacaatgcagtgcaaaatcatggctcatgagcttgacctcgtgggccccagaaaatctccggctcataagccctcgggaatagctgggagaccaccaggcattgtgcgcccattcaaggagctcacgctaataatttctatacaaactttgtgggtaacgagaacgaggtctcccctaaagtgtatctaaaagacgtgccaccccgtgttggtatcaacgctttgtgacaaagggcaaccaaaattatcatggcccaatgacatttcgggaaaggtggtaaattcgacaaattaaagtcttgaaataattcccgtagtgaagcccacacgtttttcaaagattgacgggagaaaaaaggtattgcaatttgagagttaaaagttaaacccggccttgggggtccacaatttattttaagtaaaaccttcaggggtggtgacaatgaaaatctcaggggaaggcctttgctttgaggtagtaggaaacaccaggtaatgcattctgggggcggaaaagaattctacacttttgtattcaaaggtccaggggggaattgccccataactttcattggtcttcgggagccctgaataataggagtctttaaaaagaatacttctagcgtggtaagatattatcaggggaagtaatgggtgaaagtggaattaa

SEQ ID NO: 532231 - DNA, 385 bp, Homo sapiens
atttcaattaattcttttatggggggccaccaaaattcagggttagagtaaatttaggtttgtgggcccatggggccgggtttccaagcccccattaaacaaaaggcttttttttaagcccgaacaggggggttttttaaatcaaatgggaaaaaaattagccaacggaggtcaggcggtttggggacccctcctaaaaagggatcgggaaaaaagattatttttgggcggtgaacccctatccaggggaaagtttaggggcaacttttccaaatcattcaggacttaaaccctgaaaggcccttttaaaggtttcccttaaatccaggggtttactgggacccatgccccccccgtttattgaaaaaaaggtttgcggaggcca

SEQ ID NO: 532232 - DNA, 318 bp, Homo sapiens
caacggctcgaagaggtgtggtaacggtcagacggaacttacgcgcaagtttgaacagataaacaatataggatcatccagatccaggtgttcatctttatgtgagataaatcttgatgatggtattgattatgaacgtctccggaaagagttttctccatttggtacaatcactagtgctaaggttcttatggacggtggtcgcagcaaatggtttggttttgtatgtttctcctccccagaagaagccattatagcagttactgaaattaacggtataattgtggtcaccaagcctttgtatgtatcttttgctca

SEQ ID NO: 532233 - DNA, 290 bp, Homo sapiens
cccctcatacatgagtgcccagtgactgttcttcattcatcgcgccctgtcgttttgcactaatcatatggttgtcattgcgcattatctgtgaagagtccagactggaataagcaaaacttgtccgcacagacagatccatttctacaactgatagcctgttgtaggagcatcacctgtttcaggcggaccaccttattcattcgagacaccattgtatgattcggggccatggcaagatggcagcttctagcctcagccacaggcttccgtttgccatcgaggcacag

SEQ ID NO: 532234 - DNA, 392 bp, Homo sapiens
gtcatatccggactccacgacgcttaactgggaccatgctcataggggtcggaaaccggtgccgccttgatggagaatcccttggcattggcgccatcgatcaccaaacttctcgtgtttaccggtacagtttcggttacgccacctgtaccgaacctcgaagatcggcgtacaaggtggagaaactactcgatccgacaaggatacggtgtacaactgtcagaggagttccagcttcaatcctggccagtccaccgacgccttcgtcgtccatcacccggaggcaaactatttcaatgccacgtgagacgcaaacagcgaccggcgaccgtttaatcgccgctttcttgtgggatttcgacggtactctcgtcgaacctgagtcccggtgg

SEQ ID NO: 532235 - DNA, 145 bp, Homo sapiens
ctgatctgagtttaccgagtggagagtaaacgagggggtattgtctacatgacggcagctggatctcgagcgtgtgctccgaagatcttcgcatcttccggatctttgaggggacaaatgacattcttcggctagtttgtggctc

SEQ ID NO: 532236 - DNA, 190 bp, Homo sapiens
tctaagcaagttagcattattatgattaggtattcagatacccgtgcaatcaagcactcaaggagagatttgtgggttgtgtgcaaatcatatattcagggtaatcaacagcgtcatgtagtaagaagtaacgcttcacattgtgttatgtgatgtgaacaaccggtatcatagttattccaggggggtt

SEQ ID NO: 532237 - DNA, 635 bp, Homo sapiens
  misc_feature (1)..(1): n is a, c, g, or t
  misc_feature (96)..(96): n is a, c, g, or t
  misc_feature (101)..(101): n is a, c, g, or t
  misc_feature (116)..(116): n is a, c, g, or t
  misc_feature (120)..(121): n is a, c, g, or t
  misc_feature (127)..(127): n is a, c, g, or t
  misc_feature (156)..(156): n is a, c, g, or t
  misc_feature (165)..(165): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (192)..(193): n is a, c, g, or t
  misc_feature (281)..(281): n is a, c, g, or t
  misc_feature (317)..(317): n is a, c, g, or t
  misc_feature (354)..(354): n is a, c, g, or t
  misc_feature (360)..(360): n is a, c, g, or t
  misc_feature (365)..(365): n is a, c, g, or t
  misc_feature (371)..(371): n is a, c, g, or t
  misc_feature (378)..(378): n is a, c, g, or t
  misc_feature (388)..(388): n is a, c, g, or t
  misc_feature (409)..(409): n is a, c, g, or t
  misc_feature (448)..(448): n is a, c, g, or t
  misc_feature (466)..(466): n is a, c, g, or t
  misc_feature (472)..(473): n is a, c, g, or t
  misc_feature (479)..(479): n is a, c, g, or t
  misc_feature (481)..(481): n is a, c, g, or t
  misc_feature (506)..(506): n is a, c, g, or t
  misc_feature (509)..(509): n is a, c, g, or t
  misc_feature (554)..(554): n is a, c, g, or t
  misc_feature (560)..(560): n is a, c, g, or t
  misc_feature (564)..(564): n is a, c, g, or t
  misc_feature (573)..(573): n is a, c, g, or t
  misc_feature (612)..(612): n is a, c, g, or t
ncccattgttctagattcctctgccccatctaaaaacatgggacagccagcttgacttgcaaggcctcagttgaaggcccccatgtacatacaggncagtncggcagtactaggcnaacnngagggntctcatccccatatgggggctcatttcangtctatggntgactaccttcatngcngngtgcgagnnggtttcaccccttgaaaatatggtcacttcagcataaaatagttaaatctttataatggtcaattcatcctacctccttttacatgcngctgaaaaatgacaggctagggacatagaatattgngaactttatactgttagaatcaatgtccattaaatgntcactngctantggtcnctaaatnaccaaattanggaaattatatatggaatacngcaaaaacacagtaaaaagactgaagttcgcccatttcngatcaggaagtctcttcnctcctnngcttcntntgttgtccttctggcttcaaaattnctnctattattcctgtttttcctccttttgatcttccttttgttcccnagtgcnagancttccaganccttctcgctcagatgccatctttttgtatgccatttcnaacagcttcaaaaaagcctgccg

SEQ ID NO: 532238 - DNA, 143 bp, Homo sapiens
gtacctgcccatgtgggtctgtacaacaggaaatggtagaacaacttattttttaggatttaacgacaaccggttgaacaaaacggtagggtgtcatgctcacagagaataaacgatttgtacgaaaaggtgctgaactgcca

SEQ ID NO: 532239 - DNA, 717 bp, Homo sapiens
agcggaggggagtggggtcggacggggagctcatgcagaggtgagctatcgtgcgctatgtcagtcggattgcgaggacctggactcggatccaagatggcgttacgggaagcgaactgcaggaggacggtcgcagcactcatgtgtgatcacaccagagtcacgtaggaggctcatccgcacgaggagcatcacctcgaggatcaccagtctgtatactcacggatgtctagctattgtcgctgatcgcggtgactcgccttggcggcaaccagatgtacgtccaggtggctggatatccaagcctctcaggttcggagaatggagtcttccatcaatcatatctcacagacttgttggatattccataacggacgaaacgtggcacgaacgagagattggtattttgacaacaaataagaatacatcaaggacttcacaataataatagcagcctgtcgaactatggcagcgccctgtaaggtatattcggaaacctatcgattacgacagttctggatgatgtgggccatggtgtcaagttggctaaaagccaagcatggaacataaccagcctgcagaactggcacactgtcgagaacaaatcctcctactcagaaaccgtcaagtcctcccatgtcaggccaggggaacactgggacggaatactccttattaaaccctggacctggtaaaacccccaacagttcctaatga

SEQ ID NO: 532240 - DNA, 510 bp, Homo sapiens
  misc_feature (110)..(110): n is a, c, g, or t
  misc_feature (173)..(173): n is a, c, g, or t
  misc_feature (227)..(227): n is a, c, g, or t
  misc_feature (296)..(296): n is a, c, g, or t
  misc_feature (318)..(318): n is a, c, g, or t
  misc_feature (325)..(325): n is a, c, g, or t
  misc_feature (372)..(372): n is a, c, g, or t
  misc_feature (401)..(401): n is a, c, g, or t
  misc_feature (403)..(403): n is a, c, g, or t
  misc_feature (409)..(409): n is a, c, g, or t
  misc_feature (499)..(499): n is a, c, g, or t
ctctggggtcccaggctcccgtcctggaccttggcaccccgccccccgtgcattgtcgtcttctgagtctggctttgtctggcacatgaagttggatgggtagactctgnagcgtcagaccagcttgcgatgctgatgaataagctgattttgatggggtgtgtgaaacgganatccagcccaggggctaacttgctcgtgctctcatttaaaagcagaaaatagcnacttcattctcggatccgttgccagccccaaaggattaattatctacacacccagaagcagtggagcanaatattttggcaggaatttcangaattgnggcatcggtgcttaatatctggttctttacagtccggtagaaatttnaagggatttgaatactgcaagctatctgngnatagangctggggattcggctggaccatttgcaagtgccatttattttattttaattttaagtttttgagacatatctgactcagctggcaacagnaggccttgctt

SEQ ID NO: 532241 - DNA, 865 bp, Homo sapiens
gtctgagagtgtgaccctctcctgtaaagtatttatcccacccattaatataatttctgtataataaacttgacctgaaattatttcattctttatattaaacttttaaaaatgttttttattttcacccttagatatgggaagagtttttttttttttttttttataacagggataactggacgcagggctaggccctctttaaaaaaaaattggagcgctaaaacctcattttctcttggggaatttcctttccaaggtctctttataagcaaaggtccactccattgtggtacgctgggggtccaacttatattttccaccggggattaatatcccatggttgggaagggtagtactacttttatttatcaggcttcgatggggggacattgggatcgtatctacttctggactatttatccataaggctgctaggaccttctggtgtactgagtgtcggggtggccatatgtttcattcctcttgggaatatgccggggagcagattggcgggatcatatgaacctctattacccctggggggactcccaatggtttccactggtggtgccacacttctttttccccatcaaacgggcgtgagggtctgagtgacccaaatccccaaggcttgaataactactttaactagccacctcaaggggacaggcacccagggagcgggtgatcgccgaggcgaggatagaaactcttcaggaactatggcctaggctactcagaagcacctggcaggcctcaagggagggcgaaagaggagagaaacccagagcggaagcctgggagataaaacgggacacaggagaggtacactctcacacaacacagtccaaaaatcgctctc

SEQ ID NO: 532242 - DNA, 560 bp, Homo sapiens
tccataatgtgtgccaggctgtaatgcagtggtgcgatcaaggctcactgcagcctcaatctcttggctcaagagatcctcccacctcagcctcctgagtagctgggactacaggtacaggccaccttgcccagcttttggtttttgctgttgtagagacagggtttcgccacgttgcccaggctggtcttgaactcctgagctcaagcgatccaactgccttggcctcccaaagtgctgggattacaggtgtgagccaccgcgcccagcctaagatatttttttaaaaccacgtttagaggtcctacaagctcgggtcatctgggctgccctcgccttactgaattttaaatttacataaattaaaaagttatatatcaactccccaaatccttgtgacttaagcaaggatggagctcatctatagtagaacagaataaggtcaagacagggagaagaggagagacagtcaacccgtaatccggcccctgaatcaagtcatttctgagtcaaaatctccctctgacctttactagaggtttctcttcctcctaaacagg

SEQ ID NO: 532243 - DNA, 861 bp, Homo sapiens
  misc_feature (291)..(293): n is a, c, g, or t
  misc_feature (295)..(295): n is a, c, g, or t
  misc_feature (328)..(329): n is a, c, g, or t
  misc_feature (361)..(361): n is a, c, g, or t
agcggggtgctgagctggagtgggactgacgggtgcggacgatggccgtgtgctgtggcacgcgtgcttgcgtggccatggtgacgtgggtgcggagcctggagccggagccgacgggcggtggcctgcactgggaccccggaatcccgcgctgctgcccacgattctgcttctgagtgaacctagaaagattgtacaatgaatggtgattctcgtgctgcggtggtgacctcacacacccctgacacagcccctcacaaggcagaggtacttcgaccgagtagatgagannnanccagagtacttgagggagaggaacatggcaccnnaccttcgccaggacttcaacatgatggagcanaagaagagggtgtccatgattctgcaaagccctgctttctgtgaacgaaattggaatcaagtgatacaggagcaatttacgaaggggcaagaagcccacaggcctattggcattacagcccgattgccagattcttatgaccacgaatgtaccaagatgtctacccaggcagctccgcaaggaggggatggctgccttaaaccatgagtcttggtatggtgactcctgtgaacgatcttagaggatctgattctattgcgtatgacagaacggacgagcaagttattaccgcgtgtaaagttggcagcggtctaatagactaggcagaatcttctattggagtggtcctcagccttatctagcgagatcattctaacaaacgcgaggtgaaaccttcgaagcaaggaacagcgttcctcaattgatccctaatgggccttctttagcgttgaagttgactgcgtccaggatgggtaaagatccagttaacagggaagaac

SEQ ID NO: 532244 - DNA, 955 bp, Homo sapiens
gtctctcgccaggtgtcctcgtggaaggaccgggaccgcggagtatggagtgtgcgagtgtgagcaggcctgagcatccctgttctgctccgtcagatgacatccgtctataaaccacttggcgatggtcggtttcaccatgtatagcaacgtactgtgatgcaccagggagagacagggacgagctggaatgtcctaacatatttcccttcaagcatcattcatctcattggcaatgatggagtccgaggtggtgttatgtcattgtggcgcagcacgacggatggtggggtcgtccgaaagacaggatgcaagacagtaattcagcagtggtgccctgtcgctggtgaagggctgttgtgtgccctggcatgggccacagtagcaaccccattgatggcagcgtaaggaccataccaggggggcacaccttggggataatacaaaaacactttagacattcaatgggaagtagcattgttggctttcaatgatgcctgggggtaggggtgggcgtatgggttgtgccatcctaacggttgcgaccctacccaattgtaccgatttcacgtggtacccatcgtttgcctcgtggcaaatttacatgcgttgccgagtgggttcgcccaggtggcttgggttggacaatattgcccacgatttgttggttacgtaccacttgatagacgcatggctcacgcaagactagtggggatctccgcgaggcccccgcaggcaacaggacacttccgtatttatggcacagggcattttaagtggtggatgcaggccacttaaatttattcttccctagggtggctttcatatggtggtttcctgacagttgttctgggagccctgacttgtactcaatgaaattaggattaagcgactcgtggtgtgaaggccagaggataatgcggcagtcatgttgaaacagtgcttcatagatatc

SEQ ID NO: 532245 - DNA, 224 bp, Homo sapiens
aggcatttttctctttgtctgttaagggggaactacagcgcgtgtgagaagaggcaacccatatgagcagtatctagctattgggcgtggacagaaggcttgtgacattatatttaccatgaatgtgcattgctgtaacctatgatgtgaagagaatcctgtgggtgcacggggtgagtaagggcgtgagccacgagggtgctgttgagtgtatcaggttaccg

SEQ ID NO: 532246 - DNA, 451 bp, Homo sapiens
gacgacttcgcaggtgtacatgagaattcctgaattgggcagcagaggtggcagtgagccaaatctgtgcctgtactcaacctgggcgacagacagactctatctcaattaaaaaaacataaaaaaaaaaaacacacgaaaactgtggtaaatatccattaacataaaaatttaccatcttaaccattttcaagtggcattacatacattcgcagtgttgtgcacccattattaccatctaatttccagaactttttcatcttctctaaatgaaagttagagcccattaaataaataactccccctgctccctccctctatggtaaccactgctccctccctctatggtaaccatcattctactttctgtctctgaatttgactatcccaaagttcctcatataattagaatcacacggtatttgtctttctgtgtctggcttatttcact

SEQ ID NO: 532247 - DNA, 611 bp, Homo sapiens
ccttgtggaatcccgcccctttgcagagtcccggcatgcactctgacagtgccaagcctcgtcttgttgactgatgttcacaggaaccttgagccaatctgctgcacagagctccgtgcgagagaggcaagagagactgctcttcaagtagttgcagggtcaggagcatgagggacagggatacatgctctaggtgagagcagagtgccatgggacccatgggaagtatggttgccacacttcgggattcgttctgctttaaattggtccacatgccctctgaggtaaaagaggcacactccacagcccgagacacagtcccgtttccttagaaagtcacacacacgatctagatgcaccctgtatttccttgacacgttctttatacccctgggcctgtgggctcttccttacgattagaatccctggacacctctcttctgaagaactgacactcttctttcaagacttagctcactccgtcactctctgtaggcatatgcagaggactagcttggatgaagccggtacacagcctcgcggcacacatgcacagtgctgctgttctccttccacatctctctccatgcggtacaggacctgcttggttt

SEQ ID NO: 532248 - DNA, 505 bp, Homo sapiens
  misc_feature (155)..(155): n is a, c, g, or t
  misc_feature (162)..(162): n is a, c, g, or t
  misc_feature (164)..(165): n is a, c, g, or t
  misc_feature (169)..(169): n is a, c, g, or t
  misc_feature (199)..(199): n is a, c, g, or t
ggcttttcaagctctcgtgctggggtgggtagcctggaaaagaatcggtgctggtagctcaatcacgatgttttaggccatggccttggggccaatctgttagtcgccgctgagagtctgctctggcacaatcagcggcatgatttcttcgaccnacctcgncnnggtncccccagaacagtttcgcgccatggcgaanggggcatgcagttgctgttcctagtcgatgccaccggcaagaagaaccaccgtctgaaacgagtgtgaatcgcgacgcttttccgaaagaattgactaataagaaacgatttatgagcgaacgagcccaacgcaagtcaaatagccacaaactgaatgagatccccgaagctgtgatcctgcaactcggcaagcgctcggatcgcgatctttcggttgaatgtggtatttcggcttacttcttgaagcagaagcggcttgcctggggtatcgaccagttcaaacgtggtgtatacagaacgaccca

SEQ ID NO: 532249 - DNA, 288 bp, Homo sapiens
  misc_feature (177)..(177): n is a, c, g, or t
gcacgaggcaaaaccctgtctctgtaaaaaatacaaaaatttgccatgcatggaggtgtacgcctgtagttccagctactcaggaggctgaagtgggaggatcacctgagcctgagaggtcaaggctatggtgaaccatattgtgccactgtactctagcatgggtgatggagtganaccctgtctcaaaaaaaaaaagaaagaaggaaataaaagggtattgaatatggttaccagtattattactagaaaaagaaaggtaacaagttaaatctaataattataaag

SEQ ID NO: 532250 - DNA, 99 bp, Homo sapiens
gggactcgagactttccggcctgtaatcacttaagaaggtacaaatattacactgatagcatcgtcaaccctgatggctttggtggattcccctgtgcc

SEQ ID NO: 532251 - DNA, 694 bp, Homo sapiens
tttgtatttgtagcagagacagggtttcaccatgtggccaggatggtctcgaactcctgacctcaagtgatccgtctggctcagcctcccaaagtgctgggattacaaggtgtgagccactgacctggcctatataggcgttatttcttaaaggctattgtaggtaatgtatgaccaaggtttattgttgatgtataagtgtttatgccgcacaagatgtatattgtactatttaggttgtcagtggaaaaatggggtaagcttagcgagtttcgaaatattgaagactgaagtttaaaagaaattaaagtacaagggtactgaagagaatgcgagtatagaaaagtaggctcaagcacaatgattagagacgaagagtaccaaagcggatgtgtgtatgtgtgtgtgtgtatgcatgctatgtggctgggaaacaactatgggagactgattactattcacattatatatgtgtcacagtgaaacacgtatccatgctgtccatgctaacagcatcaaccgacatagcctacacgtaacggaagggtccgcgactgccacacacccgacggcaaaggaggaaccaaaagaaacacgagcaacgaacataacgtagcacagcagagatgcaggccacgactgcaccacccccgcaggcaccatcgcgcatcaatcagcccaacgaaccgaccaa

SEQ ID NO: 532252 - DNA, 314 bp, Homo sapiens
gcgtaatatctaatagtgggtgtggtcccccactctgggttcgattctcaaccgtctatacaacttggggatattttatctactttagtacctatgatcttactctcttaattagatctttactctccccaaagagtatgagtaaaatgtatagacagacccctccatataagataggcatatgaggcatagctgccattaagtgaaaaaatagctgagtctgggtgcagtgtctcatgcctatgtaatcctaagcactttgggaggcccaggcaggcggatcatttcagcctaggacttgaagaccagcctga

SEQ ID NO: 532253 - DNA, 104 bp, Homo sapiens
gcacagtaaaaacacacttaatggattgctgtggcttatgcctattatcccaacactttgggacagactgagtgcaggcggaggtaccttgagcccaggagttc

SEQ ID NO: 532254 - DNA, 91 bp, Homo sapiens
acccaaggtgctgagagatctccagcctgctacacgcacgccccaggcgtggccgctgttacagaaacaataaaccctgatgggcatggaa

SEQ ID NO: 532255 - DNA, 115 bp, Homo sapiens
cattactgtacatttatggttctccagtgtttgttcatcattttttcatttttcatcgtggctttccgtctgtgtgtcacctgctgctctgcacattctgtcacatccatggtcc

SEQ ID NO: 532256 - DNA, 668 bp, Homo sapiens
  misc_feature (258)..(259): n is a, c, g, or t
  misc_feature (621)..(621): n is a, c, g, or t
ctccccccgccggaggggagggggaaaaaaaaaacacacccccccccccccccccctttattaatataaaaaaaacccgcccccccccccgcggggggggggggtttttttataaaataaaaaaaaaaaaaaggggggggggttttttttttgggggggcccccggggccccaatataaaaaaaaaggggttttttttttttaaccccccccccccttctttttatgtaaaggagaaaaaaaaaaaaatatttttttnnaaaaaaaaaaaggggggggggagggttttttttttttttgagggggcccccccaaaagaaaaaaaaggggggcccccaaaaaattattttggggggcccgccccccccttttttttttaaaaaaaaaaaggtttttttaaaaaaaaaaaatggggaaaagggggtgggcccccccttaaaaaagggggggggtttttttttttaggggaccctaaaaaattcggccccccaaaaaagggggccccccgcgcagggttaaaaaaaaaatgggggggggtgggaaaaaaaaggggccccgagtccccaagaggttttatttggcccaataaaaattgtttaagggattcctaggttaaaaaggnccaggggtcggccccttccagggttgtggtctcgtgcccgaatttcc

SEQ ID NO: 532257 - DNA, 119 bp, Homo sapiens
ggcacaggtcaaaaagaccctttattactttttatgattgccactaatgctttcttgccaaatgcctttgaagcaggtgctttttgggctgaagctttttgacccttctgtggtctctc

SEQ ID NO: 532258 - DNA, 182 bp, Homo sapiens
aagggtgtggcggaggcactgtaatcccagctactgggaggcgggggcaggagaatcgctggaacccgggaggcggagatgcaggagccacgatcgtgccactgcactccaaccggggcaacagggtgagactccgtatcaaaaaaaaaagaaggaaactaagcaataaaggaagggaaaat

SEQ ID NO: 532259 - DNA, 152 bp, Homo sapiens
ctgaccgagaagattcccgagagtaaatcattttttcaatccagattaacaagcatgtctctctgccaagatccaggtaaactggagtgaccctagcagacccagcttagagttcttctttctttcttaagccctttgctctggaggaagtt

SEQ ID NO: 532260 - DNA, 342 bp, Homo sapiens
tgctatgcccctagagtccctctgggtgaattctgaccctaaaccagatttcccaggatcccatctgcaggctccacagcaaatgggatgtcccacagatcccattctcattgccagaattgtaggggaagaattataattttctctctactttttgcgagttatttgctgggaccttccccttccccgtaacaaaagacagattaataagataaaaacacatagaggcttattaacatgtataccttatgtatacatgaaaataaactctaaggaaggggttttgagttcagatttaaatatcaccgtcagctgaaacaaagaaacattttggaaaggtta

SEQ ID NO: 532261 - DNA, 174 bp, Homo sapiens
atccaaagaattcggcacgaggctccaccttaccaccagacaaccttagccaaaccatttacccaaataaagtataggcgatagaaattgaaaccttgcgcaatagatttagtaccccaagggaaagttgaaaatttttaacccagcttatatagcaaggtctaacccctatac

SEQ ID NO: 532262 - DNA, 556 bp, Homo sapiens
ctgacacacagggcagacccacgggccgccaccccgagcaccaccccaagaccggagctgcagcatggcgggcgcaagccggagctgaagctggagggacgccggccggtggacagcgtggcgccagaacatctgacttcagacaacgtggacatcgtcgagagctcagcagcgaggctcatgggcaccatggacgccgttcgacgtccacgagttctgaccaggtacctgcccctgggcggccccgcccgcacaccgagccggagcaggcctaatggggagcgccctaccttccacgaccggaggcggtcccacacgatgtgggcacacagagacgtgacacccgatcggaactccgaccgatagacccacacgagacgagagtcaccccacggcaccgccggcactcacagacggcgacgcagaccgacgaaacccgggacacaatacagggagaacaagacccccgaaggaactcgaccccgaaccaaacggaaacactgccacagagacacaatcaacgagaccagcccgcgacagcaccacggcagggccc

SEQ ID NO: 532263 - DNA, 1237 bp, Homo sapiens
  misc_feature (136)..(136): n is a, c, g, or t
  misc_feature (147)..(147): n is a, c, g, or t
  misc_feature (173)..(173): n is a, c, g, or t
  misc_feature (196)..(196): n is a, c, g, or t
gtaaggacatggttggactaaggactacgtgatctgtaggcagcagcattgtgcgttctccagcctttgcgtactggggtcactcattgttgtcgtacaggagacagctttagatgaactatgtcatcactcccanaatcttctgcnatgtgtagaaaagcagcaaggactanattgcctaggggaaaagacttcnttcactttgggagtgaaacaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaa

SEQ ID NO: 532264 - DNA, 598 bp, Homo sapiens
tacatactgattgaggagaaagggcaaaggagaattctaagaaatgcacatgtgcaacaagtatagtttaacagctatataaccttccttgggtagcagtaattagcaaggcaaccatcacctaaaatttgtagtcaacacaagctgaagcatgctcattaatcaatagtaagggagagtcccacaaacctgggatgggaactatgtggagaaaggcagaaatggaaaaaactagacaaaagaagcccagaccgaggtgttgataacaaaacactgcctactgatctgcatgagacactccatctcagagtctacttcctgaagaactcaacaagtaacaactcgtactaggaacaattcaaagcagcaggagattcataggaatttggaaaatatgcttatttaccatcaagctagcaataggatcctaatatttaatttgatgggtacagatagactctggtacaaaatggtagtctagttgttaaaagttccactagtgtgtattggaatggtgcatagtagtggaaaagaatgcactggctggtgcgttatgtcaatggtttgataaccatgaaaaaaacagttaattataaaa

SEQ ID NO: 532265 - DNA, 284 bp, Homo sapiens
gcctggcctcaaaatctttaaaaaattttacctgtaaaaaaaacccccagggttttttttttaataaggggggggaaaaacccatgccccaaactttggttgaagggggcctaaaaccccggggcctttgctcccacccttttttaccgaaccaaacattttcctttaaatgggggatttataaaacgcccccagttttctttgtttttctaaaaaaagaagggccaggaggatccccctctaaacccccttaggccttacctaagttccggggaaaaaaaaaa

SEQ ID NO: 532266 - DNA, 338 bp, Homo sapiens
aaagtgtatgtcccaaatacggactaaacagaaatgtccagagacatctgggggaggtgagatgaaatattcagactttgctttttgcttccctgagctgccctgcctcccaggtgtagttgtagtcccagtgagtccttggagacctacaagctaaatgagatatagattgagtcattcctcttgaatttcacagtctggagtgctgagagtcatctgatcttacggctctggttaacgaattctggccatctagcggcctgtgaaggagacttgagcacacactaaggccttgttagtgggatggctgtggtaggaggtccaagtgcaatgcggaa

SEQ ID NO: 532267 - DNA, 2350 bp, Homo sapiens
  misc_feature (1304)..(1304): n is a, c, g, or t
atttcgattaaataaaaatggctttagtaattcaactttatatttaaaataattttaagacttcctgttatggaaaaatttaacatcgaataatacaacgaatcctcatgtaccatcagcttcagcagttataaacctgtgggcagtctcctttcatctataccattgctcattcccatatctactccgccattaagctaatcacaggtgtcatatcaacttaaaaattaatatgactgaaagcataagctgttgtagttccacatatttgcgtaatgtttattagtttctttcctaagactgtatgtcttaagaaatttgccctttgtattttgtatgtgccatttggggaatataaggaaaagttaaatttctggaaattaatgtgttctatgtgtttagttggaagtaattgttatggtagtatcagcttacttgcttttttgttgttgttgttgcagccgagtgctgttttagaaaataaaaagtaaatttaaaatgtgtttttgagttaagctagatatcaccccagagtactgtgatttttcagttacaatccatttgatatattctgcagtaaaattatatttcatgtacagttttcattttgtattgttccttatatcacaattgcaagtattttggttgttcttgttgatatgtaaagaacaaattaactactccttatttgttcatggtatagacataatgaaagacttcaatatagttgaaacaatcttttccacatttgcctgcttttatgaaaatatcattcattcagagtacttgacatttgaatatgtactgtgaaacttcttctttgatattttctaattctcagctatgttccctaatgggtcttgtatctagtgcctgggtagcatagtgtgactgggataaaatgtcagttattccacagatttttttttattctttgtaagtgaatgataatttttactatggctacagtttaattgatcactcattatatatttaattttggaaaataatttcatctaaccctaccatatatagatatttttggctacaaatactaaataaaaatatggcaaatatattaaatctttgtctatatagtttattttgctttaaaatttgaagataatatttattgtaattgctcaatactgacttctttagctgatcgattatagttagggctgttttttgcctttattacatttctagggaggatgttcagattataagaatctttttataagttagcttggcaatcttgcttctgtggattgtctcatttccattttggatttttatattgnaagttgttgctaaaaattatttttttcccttcttccacttaccttttggaccatgaaggatatattaattaaagtcaagctgctattgagttttgtgtctgaataatttcttatacacttatcatgagatttacttctatcatataagtactgctagtaaaaccaatgaatgtttaactccttcataagcaaaattatttttatgtgatctctaagaaattcctcctttcacatttttctgttttcatacaggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaa

SEQ ID NO: 532268 - DNA, 464 bp, Homo sapiens
aagacgctacttcgcccgtaactcatagaagagcttatcacctttcatgatcacgccctcataatcattttccttatctgcttcctagtcctgtatgccctttgtccctgagagcaacctccaccaacgaaaacttaactaatactaacatctcagacgctcaggaaatagaaaccgtctgaactatcctgccccccgcccaatccatccctagttcctcatcgccctcccatccctacgcaatcctttacataacagacgaggtcaacgatccctcccttaccatcaaattcaagctttggggcccgaacgcaaaagtgggtactgaacctacgagtacaccgactacggcggactaatcttcaactcctacatacttcccccattattcctagaaccaggcgacctgcgactccttgacgttgacaatcgagtagtactcccgattgaagcccccattcgta

SEQ ID NO: 532269 - DNA, 1859 bp, Homo sapiens
  misc_feature (136)..(136): n is a, c, g, or t
  misc_feature (147)..(147): n is a, c, g, or t
  misc_feature (173)..(173): n is a, c, g, or t
  misc_feature (196)..(196): n is a, c, g, or t
  misc_feature (1750)..(1750): n is a, c, g, or t
gtaaggacatggttggactaaggactacgtgatctgtaggcagcagcattgtgcgttctccagcctttgcgtactggggtcactcattgttgtcgtacaggagacagctttagatgaactatgtcatcactcccanaatcttctgcnatgtgtagaaaagcagcaaggactanattgcctaggggaaaagacttcnttcactttgggagtgaaacaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtatatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcactttgcaaataatgcattttttacaaatggaaggtttatggcaactctgcgttgagccagtctattggtgccatgtttccaataaaacttctcctttcatgtctcgtatattgtgataattcttggagtatttcatagtttttcnctattattaaatctgttgtggtgatctgtggccagtgattgttgttactattgtaattgctttggaatgccatgaactgtgccctaataagacagagaacttaattgat

SEQ ID NO: 532270 - DNA, 154 bp, Homo sapiens
cattgagcccctgtgatgctggttggtgtcggatggacttgataacttggcctatgtgaaccctggtcacagtgccctggggctttccataaggcacctcgcactgcctgtttggagcctgtcagactctccagcacagtgacaacactcttgc

SEQ ID NO: 532271 - DNA, 1832 bp, Homo sapiens
  misc_feature (136)..(136): n is a, c, g, or t
  misc_feature (147)..(147): n is a, c, g, or t
  misc_feature (173)..(173): n is a, c, g, or t
  misc_feature (196)..(196): n is a, c, g, or t
  misc_feature (1723)..(1723): n is a, c, g, or t
gtaaggacatggttggactaaggactacgtgatctgtaggcagcagcattgtgcgttctccagcctttgcgtactggggtcactcattgttgtcgtacaggagacagctttagatgaactatgtcatcactcccanaatcttctgcnatgtgtagaaaagcagcaaggactanattgcctaggggaaaagacttcnttcactttgggagtgaaacaatctgatcaagagactggacgtgtacttctgtttctcagtttatctggatgttatcagatcacagaccatggtctcagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttctataatcctaaagaaccttaaatgtgggtttgtttgaattggcttctgagaatcattgaaataaaggaaatattacggaaaagagatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtatatctactttgctttgttaaaacatcatgagagtggaggcctgccacccagaaaggcacatactagtgccttttagtacaattttatgtcatgtagaagaaaatggcaatgttcctcctattgatacagatacaggcatatgtcatcttattgcgttttgctttattgcactttgcaaataatgcattttttacaaatggaaggtttatggcaactctgcgttgagccagtctattggtgccatgtttccaataaaacttctcctttcatgtctcgtatattgtgataattcttggagtatttcatagtttttcnctattattaaatctgttgtggtgatctgtggccagtgattgttgttactattgtaattgctttggaatgccatgaactgtgccctaataagacagagaacttaattgat

SEQ ID NO: 532272 - DNA, 831 bp, Homo sapiens
gtaacgcatgcctgtagtcccagctacccaggaggctgaggcacaagaattgcttgaacttaggaggcagaggttgcagtgagccgagattgcaccactgcacttcagcctgggtgacagagcaagactccatctcgaaaaaaaaaactctctgtcaagtatccaagtctcaataactgtagttgtctaccaattattctttcaagtcaacatggtgtctatgaaaagagcagctagagcatatgtaactcaaataattgcacaaatgctaatgatactcacaagctaatctatgcttacatcagcaggtctcaacttcttaaaattagttgttttttaaattgactcataattgtacatatttatggggtacatactggtcgttttaatacatacactatttagtgattggatcagggttattagcatatccaaggtatcaaacttggagacaactattgtactttggtatggagcataaatgtttttctgaatattttccatttggtcagattattacacagaggtgtatatttaacagggttgcacgatttaactaaaattataatttctactgctaaggacattttaacgtgacactgttcttgggtttgagcctgtgagcacgtggtgctgaagaatgtatggctactggtacagttgggctgctcgcttgattcatgcttggttctgccagtgccatgtcaccccgcggcaactcttttctgttttttgcaaatagtctggcctggacctttgaaggtgtgggggccgggatccggccacttcgaccgggtgctcttgggttttccccgctgagctctgggggtt

SEQ ID NO: 532273 - DNA, 938 bp, Homo sapiens
gtgcttgtctctttcctggatgttcgaaacattattctaggcaaatcacactatgtatgtatgggctggtggctgccatgcagccccgaatgctggttacgcttgatgaggagctgcggcattgccagtgtctgtccgtgtgggccaggcaggtggatgtggtggggcaggcttgcaagccgaagatatatcacagggttccagacgcatacaaccccagtgttgtggcccacggggaacgggcagaatgggcacctgaggagttcttcctgtaacccccattctgaaagggtttgtaatcctccggaaaaaccccaattatgatctctaagtgaccaccaaggggctctgaaatgtgcaggctgattgtaatcaggcacggccattgccatccctgtggcccagggttgggaccacgggtctgcagactttctggggggaatgtgtcggctccatgctcttgtgtcaactgagtgagatcacggttgtccaatagaggactttttattccccaaaaaaaaaaataaaacacaagaaacacatttttggggcgcttcggaccctcaaaaaaatttcataaaccacttcgttgagcgccgcgggcccccagacggaccggagaccagggccacgcggtccctagggaaaccggacaaggaaagtgggtgggttccccccaatgaaaacgccggcgggaacgaggtgtgggaacaaatccaggggaccgcggccacacggatctacacgggagcacgggcgatttaaaccagcccatgggaaagccacgctcaacaaccagcacacgacacagagcgaagagagcgacacgcgcacgacaacgcgcagcacgcacgaacgacaaactaagcgagcaatgcacacgactacaacagccgcagatacactgagacacagcgtgcacacagtacgatcgacgc

SEQ ID NO: 532274 - DNA, 163 bp, Homo sapiens
aataaggactcacaaggatgaccatataatttaccatctaaatgggggtgatggtggaaatgaagggcaaggctatggttaatgccagcacagcaggcgtaatcagtactggcacatgtaaagtggggatgcaacgttttctccagaatgtagagggagagag

SEQ ID NO: 532275 - DNA, 431 bp, Homo sapiens
caaaaagggaaaagaaaatatcctcccgggccagaaaggcaagcctttttcggttgggcaattggtcaaccgccagtggaaggtgcccccttaaaacctgattttaattggaaaagaactaaaccctgggtgtggaaaaaaaattcccctggaaaaggtcctcctggttggggcaaaaaaattcaccctgcttgggaaacccccccccggaaaggattttgtttgagtaaaaacccccgtcctttaaaaaaaaaaatcctggcccagcatcctttttaaattccgggaaaggaaaaacttcaaaaaaaaaaaaattgttccgaccccccaaactgtcccccggaaaaaaaacattgaaatgccccgggtttgttgtgattacccagttaaaccttcccaaaggacgaaaaaaaacccccgcctccccgggg

SEQ ID NO: 532276 - DNA, 890 bp, Homo sapiens
  misc_feature (870)..(870): n is a, c, g, or t
gataatcacgattgcttttcaagaaaagcttttaatcccagtttctattcgcaatggatgttttggagacattgagggtgggagctttttggcgccaaccaatcgagggtcagcgaggagtgaggaggagcggctcatgttggctattgtttgctctggagacgtgcatccggcccgggtacttgtgatcggtaggagagccgggatcgtcactttccgtgcgaccctctgcgggtagggactagtgctagaggggctagggcggggagcacaggcacgcgtccagctgcgcacgcaccttagcagaaagccggtgtcaggcctcgagccggggcccacctggagccctcagcctgcgccaccacgcccgccagcgcccggatatggcgcccccggctcagaagggccgggctccggtcatccccagtccagtcgcggccactgaccctgtgagatcagccctccccctccccaccttcccgtcgacaggccagccgcagggcccgaagccgcacccactcgcgtctgctagcagccgctcttgtcctgcagggtacggctcgcgggagtgcttggttaccaatggtgaagctggcagccaaatgcatcctggcagatactcgctgagcactactacgtcagagtcaccgtgcaaagtgcagtgggcctgcaagcatgagtcagttgcactgcaaggaagaactaagatgcgtgtgatacgttctaacacagcgtacacaaagcgaatgccctttgtgtgccagatgcggggaaatgcctcacaggcacaggctgctacttgttctggttcacggagaagaaagaaaacaacatttgacattgatctgtattttgtttactgttaaatanactcgaggtactatatagtg

SEQ ID NO: 532277 - DNA, 1026 bp, Homo sapiens
taaaggcaaggaaattattttattggctgaaataggtataacactggaaataaaaattaaccaaatgtaagtagtctccttccatgaaacagcagagtaagagataacacgtgttcggaagtctctgaaccatgtgatctgatgactctggaagacatgacctgtcaggtgcgagacatgcagtctggaatatactacagacgaaggggcacgaacactggacaggaaacaacagcacctaaagctataatcacccagatccaaactgaacgaaagcaccaaaggccacgcacaacagcaaccacaaagacagcaaataaagcgaccatcacagcaaccaacagtgacagcaacaaaacaaagcagacaccaacggaataagcaccgaacgcacgcaaacaccaacccacaaaaccaacacaaagacacacagacacgcaacacaacacacaaacaaccacacaaacacaacaaacaacgcaggtaaacctcacacagcaaagaccaagaaaaaacaaaaaccaacatgacacgaacaccgcaaaaacaaagaagaaccaagcccacccagcaacaaaagcagacaccacaagaacagcgcacaagtcaacacgaccaaccagcacaaacagacacgaggccgaagacaaacaagcacaaagacacaacgaacgaacaaaacaagaaggacaaccgaacgacaagcacccagacacaaaacaaacaacacaacacaaggagaaggaaacaaacacaaaacaagcaagacacaaacacaccggaacaaagaccggagggaaggacacaccgaaatggagaagcgctgcgctcagacacgacgagcaacaagcacgaatagagcaagaagccagcaccaccaacggaggcaccacagcgaagaaccggcagcaacgagcacgcaaccagggcgagcagagcacagagaagaaacagacagatagaccggcgacaggagcaacacagagaaaaggaaaaaaacatcccccggatggtgctattgctcga

SEQ ID NO: 532278 - DNA, 112 bp, Homo sapiens
tgtgtaatgcccgccactacacagggcaggtcaaatattcactagattaaaagtaagagacagcttgaaccctacgtggagccattcatacatggacccataattaaggaca

SEQ ID NO: 532279 - DNA, 463 bp, Homo sapiens
  misc_feature (195)..(195): n is a, c, g, or t
  misc_feature (210)..(210): n is a, c, g, or t
  misc_feature (263)..(263): n is a, c, g, or t
  misc_feature (379)..(379): n is a, c, g, or t
  misc_feature (452)..(452): n is a, c, g, or t
  misc_feature (454)..(454): n is a, c, g, or t
ccgcctcctaaaacctagtggatcccccccgggctgcaggaaatttcggccaccgagagatccttaagaggttcctttaaccagaaagttcctgccctacccttttcctccccttcatccttacacgaattaaattggatagccataaaaattcaagttaaaaaacataacattcggtccggtatggtggctcanacctgtaatcccaanactttgggaggccgaggcagacagatcacttgagctcaggagttcaaggccancctgggcaacatggtgaaaccctgtctctacaaaaaatataaaaattagctgggtatgatggtgtgtgcctgtagtcccagctccttgggtagttgatgtgggagtattgtttgancctcggaggtcgaggctgaggtgagccatgaccatacccaccacactccagccagtctgggcacagagtgagngnggtgtctca

SEQ ID NO: 532280 - DNA, 321 bp, Homo sapiens
attctttatagaacgttctgtcaggagccagtcgtcttgtcaagcagctgatatggccacctactcttactttgcaccgatatactgtttgccagtagtgaatgaaggtggactacttggagacatcaaaagctaagtttccaggagcactgaggtagcaatgctgtagaaacctcacatgtaaacagtgtaccttaaactgagcatcctttattttcccccatggacctcactttccaatgactagcaagcctgaagaggccaacatggtgccagacttggcgccctgccaggaccaaggggcatgtgcactctccagtg

SEQ ID NO: 532281 - DNA, 959 bp, Homo sapiens
  misc_feature (1)..(1): n is a, c, g, or t
  misc_feature (93)..(93): n is a, c, g, or t
  misc_feature (116)..(117): n is a, c, g, or t
  misc_feature (125)..(125): n is a, c, g, or t
  misc_feature (227)..(228): n is a, c, g, or t
  misc_feature (262)..(262): n is a, c, g, or t
  misc_feature (294)..(294): n is a, c, g, or t
  misc_feature (304)..(304): n is a, c, g, or t
  misc_feature (330)..(330): n is a, c, g, or t
  misc_feature (343)..(344): n is a, c, g, or t
  misc_feature (347)..(347): n is a, c, g, or t
  misc_feature (350)..(350): n is a, c, g, or t
  misc_feature (352)..(352): n is a, c, g, or t
  misc_feature (355)..(356): n is a, c, g, or t
  misc_feature (358)..(358): n is a, c, g, or t
  misc_feature (369)..(369): n is a, c, g, or t
  misc_feature (398)..(398): n is a, c, g, or t
  misc_feature (402)..(402): n is a, c, g, or t
  misc_feature (411)..(411): n is a, c, g, or t
  misc_feature (440)..(440): n is a, c, g, or t
  misc_feature (454)..(455): n is a, c, g, or t
  misc_feature (494)..(494): n is a, c, g, or t
  misc_feature (505)..(505): n is a, c, g, or t
  misc_feature (515)..(515): n is a, c, g, or t
  misc_feature (518)..(521): n is a, c, g, or t
  misc_feature (523)..(524): n is a, c, g, or t
  misc_feature (537)..(537): n is a, c, g, or t
  misc_feature (578)..(578): n is a, c, g, or t
  misc_feature (623)..(623): n is a, c, g, or t
  misc_feature (952)..(952): n is a, c, g, or t
ngaaagccttcagggttcagttgtatgtcatgtaacgaggagtagcactgaatttggcataagacttaatgaccttatttacagcttccaagnaatccttctcggtagcaattttnngccgtgcnctgatggcaaacataccagcctctgtgcagacgcttctaatctcagcaccagtgctatttggacacagtcgtgctaacagttcaaatctgatatctctttcnncactcattgaacgagcgtgaatcttaaatatgtnggtccgcccctctagatcgggcaagccaaatncccttccccnctccaatctccctggcctcatcagtnctgggtcgaaagnntcnggncngtnngnggggatgggcnctttaatattgcctcgggggtcaaaaccntcangctgattgntcagttccaacattgttctctgcacttgnttgtgacctccagnnccatcatcaaaacgggcccctccaatagcatcaatttcntcaaggagggngggggggggnttnnnngnnctgggcatttcanagggttcacgaaccattcgagccccctcaccgacgtatttntgttcaagctcagatccaataactcgaatgaggcacgcatcagtncgattagcaactgcccgcgcacagagtgtcttgcctgtaccgggtggaccaaagagcagcacgcccttgggaggctcaatgccaaggttcacaaacctctctggatgaagtaatggggtttcaactacttctcgcagtttctcaatctgttccttacagccaccaacatcactgtatgtgacatcaggtttctcttccacctgcatcatggtaactgttgggtcaatcttaggaggcaatggaatgtgaatttgatatttattctatccacgcccactctcatcccttcttcaatgtcagtaggtgccactgatcactaaggtcaccanaaactgg

SEQ ID NO: 532282 - DNA, 285 bp, Homo sapiens
  misc_feature (1)..(1): n is a, c, g, or t
nctggcggctgggattggaggtggacacaaggaggaggcagcagacagctacttcagcgtactcaacgcattcatcgacaggaaggacaggtactactccattcaccagataagtgggaagctgcagaatgtggcagggcccacccgggctgtctggagagggtggagtggtcggtttccccttcagaagttttctggtgtcgggggatgttggagcaggagggtgtaaacctttaaacactgaactctgaccatcttgtcgctggttgtcacatcaaccccggg

SEQ ID NO: 532283 - DNA, 565 bp, Homo sapiens
  misc_feature (434)..(434): n is a, c, g, or t
  misc_feature (544)..(544): n is a, c, g, or t
gtgtggtacctggtgcatgcactgcggctgcccatcccgctggccaggcactttggggtggtgaccgcccgttaccgctgggtggctggggtctacctgctgctcggattcctgctgctgcccctggcggccttcgggctctccctggcagggggcatggtgctggccgctgtcgggggtcccctggtggggctggtgctcctcgtcatcctggttatggtcctgcagcggccccggccggcctggctgcctgtccgcctgcgctcctgggcctggctccccgtctggctccattctctggagccctgggaccgcctggtgacccgctgctgcccctgcaacgtttgcagccccccgaaggccaccaccaaagaggcctactgctacgagaaccctgagatcttggcctcccagcagttgtgacgggcagttgntgcgcagaccgccccaccctccccggctgggagggctctggagggccctggagggggggtccccgcggcagctgacctccggtcacctgcttccccttctgtgaaaattnaccaggctgttatctggaaaa

SEQ ID NO: 532284 - DNA, 512 bp, Homo sapiens
attattctcattacataataataaaaaacttttaccattattttttctcaaaaaaacaaaaatcaagaaactcttgaaaaaatttaaaaaagtaaccccaatccccccttaaaacattaaattaaagctattacaaccaaatttacattaactaaaacatatttcaaaactattacaaattaaccactcataacccccaacaacaatatccacacaaaaaaaaataaactgcgatcaatggattatacaaaatcaaaaaaaccatacatttaatcctataaaaacaaataattctttaaaccctccttaacatttccccaacatatccaatatttccaaaaatctagctccttcaatttcaaaattttcttaactctacaaacccattataattttctacaaacaaccctatttctacttaaatacgcttattcacataaatcctttctctcgccaattctatttttagcctattataaaacatttactatcttcccaaacatgaatgtctc

SEQ ID NO: 532285 - DNA, 382 bp, Homo sapiens
  misc_feature (290)..(290): n is a, c, g, or t
gtgggtgcagcccagggagggcaagccaaagcagcgcaggacattgcctcacctgggaagcgcaaggatctgggggatttccctttcctagccaagggaagccatgacagactgtaccaggaaaattgggacactgccacccaaatactatgctttcccaacagtcttagcaaacagcacaccaggagattatatcccgcacttggctcagcaggccccacacccacagagccttgctcactgctagcgcacagtccaagatcgaactgcaaggagacagcctgacttgngggaggagcgtctgccattgctgaggcttggagtagattaaaaaaagcaaccagggaagctcaaactggggttggagcccacccgcagctca

SEQ ID NO: 532286 - DNA, 116 bp, Homo sapiens
cactgatgcagatcaggaacaaggcaggcttctggcatatggatatggtttctttctcaaccgtcgccaaattcatgaatcaacctgtcaatgtcgagactcatgtgattgcttca

SEQ ID NO: 532287 - DNA, 241 bp, Homo sapiens
gcagcttaccgaggcagtcgttctcataatcgcccacggacttacatcctcattactatatctgactagcaaactctaacactacgaacgcactcacagtcgcatcataatcctctctcaaggacttcaacactctgctccacactaatagacttacgatgacctctagcaagcctcgctaacctcgccgtatttacaccaaccccgccgctagggatctgagccgtaaggccgactcctg

SEQ ID NO: 532288 - DNA, 350 bp, Homo sapiens
  misc_feature (147)..(147): n is a, c, g, or t
  misc_feature (207)..(207): n is a, c, g, or t
  misc_feature (215)..(215): n is a, c, g, or t
gcgcgctcaagacatggagctgatcacaaatgtcaccgagtatgagaagctcgccaaggagaagctgccgaagatggtgtacgactactatgcctccggcgcagaagatcagtggacgctcatggagaacagggaggccttctccanaattctgtttcgaccacggatactgatggacgtctcccatattgacatggccacaaacgnctgggctncaacattaccgcgcatatcgagagcgctctttcacccgtgcaaaaaagggctcatcctgatggagagcttgctacggaaagagcaaccctctgtgcgagaacaatagagacattgtcctaagggtctacttccag

SEQ ID NO: 532289 - DNA, 109 bp, Homo sapiens
gtattcaaattcaattgagcaggtgctaaaaacaaccccaatgtgctcctttaactccttgtttaaatgacaacagttagaatgtggtcactagaacctactgtgccct

SEQ ID NO: 532290 - DNA, 826 bp, Homo sapiens
  misc_feature (243)..(243): n is a, c, g, or t
agcaaccctctaaaagcagtttagagtggtaaaaaaaaaaaaaaaacacaccaaacgctcgcagccacaaaaggggatgaaatttcttctgggacatcctccggcttctcccgttactgatcgtctgctccctagagtccttcgtgaagcttttgattcctaaagaggagaaaatcagtcaccgggcgaaatcgtggctggattacagggagctggggcatgggaattggggagactggactncgctatgaattggctaaacttaaaagcaagctgggttctctggggatataaataagcatgggactgggaggaaacagctggccaaatggcaaggggactggggtggccaagggttcatacctttggtgggtagactggcagcaaccggagaagatatttacagctctgcaaagaaggtgaaggcagaaatgggagatgttagtattgtagtaaataaggctgggggtagtctatacatcagattggttggctacacaagatcctcagatggaaaagactttggaagttaaggtactggcacatttctgggactacaaagggcatttacttcctggcaatggacgaagaataaccatgggccatattggtccactggtgggcttcggcagctgggacatggtctcggtccccttcttactgggcttactggttcaagcaagttggctgctgtgggattccataaacactttgacagatgaactgggctgccttacaaataactggcagtcaaaacaacatgtctgggtcctaatttcgtaaacacggggttcatcaagaaatccaagtacaagttggggaccca

SEQ ID NO: 532291 - DNA, 1357 bp, Homo sapiens
  misc_feature (194)..(194): n is a, c, g, or t
  misc_feature (386)..(386): n is a, c, g, or t
ggttttctctgcgctgtgtgcgttttccctcctcccccggccctcaggttccatggacacacatggtccgtattagtgggcagctagtgcctgcagcagcacttgggccttttgcatggcaggggaggcagctagcaccaggacatcctgcaagacagagctaagccccgcaatgtctggatcttgagtcccantggacggcattctctactgtgctagttcagacatgcgagactgtcttgtccgtgtaaccaagacatatagactcaccgttcgcaatttcacagcacagttccttcggactgtcgcattcaaaaggacagccgaaagaccaattgaaccggcacaatgagagactatctcttgcatgcacagcctgcacggtntgctagcgtgtgtggcggcaccgtagtacgtgttctctctgcctatgcgaaagcgcagatgcgtgggtattagcgtgggcgccctgtcacagcaaaagagtcccttcagggcaattcgtcccttcaaggacatgtcacctgtactccccttgaggcacgtggctgcggtgccaaagttaccacacgttttgcgaaaaccaccccgttgccagttggcgacggttggtgcatttccacattggcggaccttgagcgataaacgggggcggattaataaaggaggtgcgctcggcggcgcacttcccccgtgttccggcctggaagaatcttcgcggcccattatggtggcgattatgcattcggtcgcacctgtttgtcgcggattctcatgggggtccccacagggggttccccggcctcttccgccgaaaaaaccaataactaagagaggccataacaccgggggctcggtggaagttccgcccccttttatcgttccccctgggttgtggcgaccaaagggaaacttcctcccggtggcaacttctggtgattccggggaaaaagcgaaaaaagtaacaacctgagggaggggagcgtttctacctggttgccagaccactggcgacgcaaaacgagtttatccacagggacactccttctagagggagacgacttttttgcgcgcccgcccgttgtcggggacgataaatagggcggccgagttaaaactttaggcgtgaagcattcggacatccgcacctgtttggcgtgcgaccaaaacaagcgccgcccgaggataagcgcacgccttaaaggtagaactcttgggaaacccccgcgattatgcccctattggaaaaccgcaccacaagcagtgggtttttctggtgggaagctcttggtacagcccaaatcattattcgggggtggggaaaatatgcggttccggttagcgtttatgacccccc

SEQ ID NO: 532292 - DNA, 207 bp, Homo sapiens
atcgcgagtcatacgtcgcgtctctcaaggcactatcagatcctcactcccagctaatagctgttgtggatgacgtcatagcaagccatcgcttgacctcgcctttaccccccactattaacctactggaagaacgctctgtgctagtaaccatcgttcatccctgaatcaaatatcactctcctagttacaggactcatcatacta

SEQ ID NO: 532293 - DNA, 355 bp, Homo sapiens
gaggtggttactagacgatccccttgtgtgtctcatattaaggtaacagctctaacgactcctgcagcaacttaaatgtaactggctaccctaggctcgggcttagaactatgtaaagaagccaaggagtacagatctagatagcagagaagtccgtactcattctaaaacattgcaactacggtaagagtccaccccatgaagctagtaacagatagtagtaatactttgactgaatactataagtatatatggtacagactaaaaacaaatgtggcaagctcggtgggctgtgctgacccagtaggacattgacagactccagcttccaccctctggagaccttggacctaag

SEQ ID NO: 532294 - DNA, 442 bp, Homo sapiens
tgtagcctgttttctcatctttgtaaaagttcataattgtacagagttactctggtaactgagatcagatgcataggtagcgtttatgaatgaccagaacactaacggtgtagatcacggtgctgtttacccttccccttgtacagccagacggcacttgaaaacaacaattcctcccgctcctccaaccctcttgaaagactacctggaaagtgtgtatcttcgtccttatcatgatcttcattggtcactctcagaggaatgtgatggaagcttctctggtttgtattctgcttcggggtatcgtgtcgatatgtctccagaatattgtccatactttgttgttcaccacatgccactggcaactataagatttagaagcctccttaagcagtaaattttctgccttgtgctctgtctcttcaggtactgtatcatacaa

SEQ ID NO: 532295 - DNA, 405 bp, Homo sapiens
gcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcgggaaggggaaggtctagactagtacattcacatagggattacttttaatcaagtccttttaagttttgttgaccgcccaccggaaccaaaccttgccttggggttgaaaattcccttgccgtggtccacccccccctaatccctgcttccaaggcaggtgttgttaatctatcatagcacttaaa

SEQ ID NO: 532296 - DNA, 247 bp, Homo sapiens
  misc_feature (61)..(61): n is a, c, g, or t
  misc_feature (103)..(103): n is a, c, g, or t
  misc_feature (119)..(119): n is a, c, g, or t
  misc_feature (152)..(152): n is a, c, g, or t
  misc_feature (169)..(170): n is a, c, g, or t
  misc_feature (183)..(183): n is a, c, g, or t
  misc_feature (185)..(185): n is a, c, g, or t
  misc_feature (197)..(197): n is a, c, g, or t
  misc_feature (215)..(215): n is a, c, g, or t
  misc_feature (218)..(218): n is a, c, g, or t
acgtgcagtaaatacagtattcaagcagtcactatttctatgtacatgctcattaattctncaaaaaacccacaaaattatcaaatagatcaaaatactgtcntgtgtttccacacttntatattcagaaaaaccagctgataatttacaantgtcataaagttcccanntttcacaattacnanaaaggataaaantgaaattggggtatcatnttngttgcaatttatagcaactttacccatac

SEQ ID NO: 532297 - DNA, 1039 bp, Homo sapiens
taaaacccccccccacacaaagagaggggagaccacaccaaaaaagagcgcaccaccccccctctcccaaaagagcgcgcgcaaataccgggggggggggcacaaccccacacagagggagggggggggggaaagagggaaaatatgggggggcggggagaacccaacagggggagagagaaatggcgcgcgccacaaaaagggggagagaaacacgggggagacccgggggggaaaacaaaaggggggcgccccaaaacggcgccgggagaaagcggggaggagagggagaacaccacaaaaaaccgcgcgcggagggcgggagagaggagggcgagcaaaaaacacaaccacccacaaacacggaggagaaagcgcaacccgcgcgcgccaaaacaacacaagaggagagcacgcggcgggagcccacatatacacacacacgagaggggggagagacccgcgggagagtagagagagacacagcgcgcggcggagagggagggaaaacaacgcgagagaggtgtcatctacagagagaggagaggagacaccaccgaggcgcgcgcactcatcggagcggagaaaaaaccgcgcaggagtgcagggcgacgagccacgacagcgcccgccccccacccacgacagacgcgggggcgagcaggatgagggcgcatcacacaccgagtgagaaaagcaagtggggctaaccaacagagagccacaccaccaaacaaacacaacccggctggcggcggacacaaaaacaaaaaaacaaccaagatgtgagggcgagcaccacaaaacaacagaggagagcatctatacccacaccgcacatgcgaagagagcacagcgcccttcgatataatgagaaacacagcacgacggtgagcaatatgatgagatgaaggagacccacccgagagaaagaaaatgagaggtgcaacacactacggcgggggaagaactcaacggccccggccgctcgccctcccccgggagagggagcaagaagagaatgaaagcaagaagagta

SEQ ID NO: 532298 - DNA, 314 bp, Homo sapiens
aaaaccctagtccagacgcaatggggcactttacagaggaggacaaggctacgagcacaagcgggggggagcaaggagaatgcggaagatgctggaggagaaacccggggaaggcacctgggaggcaacccaaggacccagaggatcaatgacagccgaggcaacctggccactgccactgccaacatgggcaaccccaaaggcaaggcacatggcaagaaggagccgactaccctgggagaagccataaagcacccggaagacctcaagggcacctggcccagctgagagaactgcacctgagacaagcagca

SEQ ID NO: 532299 - DNA, 137 bp, Homo sapiens
taatcctgacctcgtgtgttcagtgattctcctgctcagctcctgagtagcttggattacagcagccggcaccatgccgagctaatttttgtattgtatataaagatggggtttcgccctgttggccaggctggtct

SEQ ID NO: 532300 - DNA, 227 bp, Homo sapiens
ccctaggtagagaagacgagatgatattatttacgggggaaggcgctttgtgaagtatgccttatttctcttgtcctttcgtacagcgaggaatttgtagtaatttgaaatccgacctggcattactccgagtctgaactcatgatcacgtatggattttaatcagttgaacaaacgaagcctttaatatgcggctgcaccatcggagatgtcctgtatccaagcat

SEQ ID NO: 532301 - DNA, 105 bp, Homo sapiens
cttaacgctgtataatagtcttttttaatagaaacatgtgttggaatggatcaatgtccattggaggaagcttcttgtctgaatccgaaggcacagctgtgtctg

SEQ ID NO: 532302 - DNA, 415 bp, Homo sapiens
tccttttactgcgcggtggtctggcgtcggggttgataagcccaggctggcgtcgtatccgttgcggtacatgcgtggtgtagctgacgcgttcgcgcggggtgatctcgcccacgaggtttgggtctaccgccaggatcgggttgccgagcagttggttaatgggcggtttttgccgccttttgcaagtaactgtcgaagtcgggaaactgttgcgggcttcccgggcttgcggcgtaggcctgtgcggcgccctgtgcctgttccttgaggtcggcgagtttctgtcggtcggctgccgatgcctggctggtggaaatgagcaccacgacgctggccatgcaggccgatgaatacctgcatcagatgcccaagaacctgcattaccacacctacgacaaaaagctgcgtcacc

SEQ ID NO: 532303 - DNA, 431 bp, Homo sapiens
aatggtggatgcacagtgacccatgtcggcctgaatgtcctctatggtccagacctccccagtatttacccttcatgcagcctattggcggacaggagaaaacctctacttgtcctgcggcgcggaatctagcccaccggcagagtatggggggacaattaatgggatgtttcggcaatcaggacgaaagctctctatcccccaaattactacaaagcgtagagggctctatacttgctcttgttcgtagctcagccactggcaaggaaggctccggatccgtgacatgtcgatggctctggtccttcaggaataggacgtcttcctctccttaatccactatagcagccgtggggtcataacgtgtatttcagggcagactggcaggacagttgctattgattcttcctcaaactacttacagagcgagc

SEQ ID NO: 532304 - DNA, 350 bp, Homo sapiens
atccagcgattacgggacttacctggcagagcattctcgtggtgctctggtgctgtaggtgccctggtctgctggagcacaggtgaacggggcgaagctagtggctgctggtcctgctgtcctgctggtctcggggaagccctggtgaacgtggtgaggtcggtcctgcttggcgccaaatggatttgctggtcctgctaggtagctagctggtcaacctggtgctaaacggcgaccgcaggcagccaaagggcctaaggtttgaaacagggttgtacgtaggtcccacaggccccgtatggagctgctggtccagatggtccaaactggtccccccggtacctgctagg

SEQ ID NO: 532305 - DNA, 1590 bp, Homo sapiens
caaccttttcctccgaaccgccttaagaacccccctcctaatactaactacctgactcctaccccgtcacaatcagtggcaagccaacgccagcttatccagtgaaccagctatcacgaagaaaaactctacctctctagtacgtaagtctcccgtacacaagtctccctgtaagttactacacactctcacacgcccaacagcaaccctacacgtcagtactcctctagtacctcttctctcgcaaccaccccacacctctactcgcccaagccattgcgactcatcactcaacaccgcactgcacgcgccaacccacgcccacgcacacgtccatgcaaaccgcccagcgtccaccactacctctccccttactctcctaacaccccccctagcctcagggccctcaccctatccacccctaacgtcgaatccgccaaccatgcaccctctccaaacatccctccgaaccacaccccagcccccttacgcgccgctccacccataaacaacgactctccctagcgtcaccgctcaccccttccctccacatgaccccccacacgcaacaccttaatccacaacacccctccccctgcaaccccccaacacccacacccctctaccaccctacccttgcaacccttaacgccacctatcaaccaccaaaacctacgccccctctcaacctacctaccgccctcacacacacgcaacctaaccgcccatcccactcctactcaacccagcaggaacccctcccccaactcctttctaacttggacaccgcataccccgccccttaacacacatcgcccactccaaccttgccttgcggagccgaccggccctccgccgcccccgtacattcccggccctcctcggcggtgggtcgttcccgcgccgcctcaagcgccttcaccccctgcctgggcccccccggacataacggacttcacatcccttcccactcctccaccacacaaaccgggtttacggacggccccggggggccccgttaacgttgcggtactacacacttcaacccccataacacccggtccccacaaattccacaggccgaacctctgttccgcaaaatttgttcccgatcgccagaacgtccgcatcccccagcccaatggctgaagcccaacacagaacgaagccaacgcggaactctaaacggccaccaccgccatcaacagccaccgagcctcccgtgttgcatcccccacctatgttggcaactttagacgcagtttaacctgtccatccccctctttaaactcgtgtcgcacagggtggcgcccacagttaaagacaccattgcctaacgttttacgcaccccacataaaccgcagcccgatcccccccgaaccttcccaggtagggacgcccatttagagcacgaacaaaccccaggcagcacgcgcatagggagaaagcccccgttttaacggacgacacacgctttgccggggccgattcccagaagctttctagggaccacaagtttatacgcgttgcgatgtcgtacagcaagacagttccacaagcgtggcgccaaaagcataagctataaaggg

SEQ ID NO: 532306 - DNA, 376 bp, Homo sapiens
atagttttagaagttcaatagcatatcatattatatctcgtagcaagctcaggaaaggattcagatataaaattgtacttctaactatgcattgaataaatatttgcacgtatcttcactttgttctctataattattcacatggtgtcattactccaattagtattttaatgtatgataaatgataatatggggggggcaaatatagtgaagtacccttaaaaatacgaacgctagttagaaatgtatactaaaactaagagtaccattgaaaccttctaaaacatatcagttgtgatgagaaaatctcaagatatctacttagaggtggttgggcgtatgaactacgtttaatggtggtacctgtcctcatcct

SEQ ID NO: 532307 - DNA, 136 bp, Homo sapiens
acctcacagttgaaggacttgcttttcctaattcaggaagttctcttatagctcaggtatgaaacttccaggacacttagattagaaccacaagagtttacccccaagagaagagtgaggctgaggagagcaatgg

SEQ ID NO: 532308 - DNA, 846 bp, Homo sapiens
ggtttcttggtagtaattagggctttccggtccgtatctagtttttggggggccccgttttgcgccggtgtgggctggtcctcccctgttggcggttgcgtgagtggccccccggctgtggtcaccacgtgtgtttcgcggcccaagaacaggcgttcccccgggtgccacaaggtgggcggcgcccgccccgcatgggtgtcaactacagcgggaagtagtgtctgccttgggggggtcccacattatcggggggggccccagcgttgtggtttttgtacgcgccgcggggttgttcgcccgttgtactgttcgcacacgtggcgacggcagaagcagttccgccccccgcgtgctgggaagcagaggggtcgcggagcaccggccaggtctggttcgtctgtcgcgcaattatggaggggtgtgcaccccagtgagtgaaggtgttgcgcacgggccactttcctcagcccacgttggtgcctctccttgcccgcgggaattgtgagtgctccgagccgtgcggatctttgtggggttctccaccagggggtcaatatgtatatggggatgaaccacggggggttcgaccccgccgtctggtgacgtcggcgggggcgagactcattccgcacggtgttctttggcggggaactcacgttgtggcggggccgccgtgccctagctgttgtttgtctgtcccgcgtcccgtccggcggagggtgagagtgttgtcgtgtctccccgcctcccccggcttgtctggtggaagacgacgtgctctttttgggcccacgtgcgtgggcacgtttccatacagatttacaggggacaacccacaaaaca

SEQ ID NO: 532309 - DNA, 375 bp, Homo sapiens
  misc_feature (350)..(350): n is a, c, g, or t
  misc_feature (359)..(359): n is a, c, g, or t
acagactgtggcaatcccaaagttcaaaaaacaaagtcatgctcacacaattgtagtttgagctacaaataaaattgattgtaggccagtggtgccttagcacagagtccagggggcatgtgtctatataacaatgtagaccagtatctgccaaatgtgttcacagacccaagtctttgaggacacctctacaggcaaagagcctgtgtccagatggttctgggggatggccatatgctgtctgctcccctaaggaaaccgcattgccaaatgacgatttaacagcccttaggaatcccaggagcactgaggtcctgaggcaatccagcttttttcccaaataaatgtanttttgaccntggggggacttttttt

SEQ ID NO: 532310 - DNA, 1003 bp, Homo sapiens
gatctctctcgggtgagagtcttctgacacgtatgttgcgtctgcccgagaatcatcctcctgaagctcaatcatgtgctttgtgaatctggtcgcttcagacaaacctgaatctcagaacctggtgattgccttctgactgcgatgcgaggtgcctccatctcgctaagagcctctcgtgctgagacctgggcgacagacggcagcaatctgtgcctgcatttcactccgtcgctttcgacgcccacggagatgccatgaccactccgtgttgcttttccgcccaggtccggcgggtaccttggggggcaccggagccgcgggttcggcttgccttgtcccttccgtcctggtcctgttcttcgccagtaggtgtggttgcattctgctttcgagccaggcccactcctgtagccggccaagagctggcacgactactgtgatacaaggttcatggttcccccatgcaggcatcatccctgggggctcaattaccctaagattggcaagattgacggcagactttcaagaagcaaaattgtgtcgcccgtaggacatgagaatcagcgcatgcccattgggccccagttaacaggagaggtgtccctctttgcttcccttgatggaaagaaaaaagagaaactcattccattgctttggcgacgactctaggacaaacgataagttctatgcaccagttctgttggaggcgacgaccctctcacgtaacgggaagcgcgttcccttggcgtctccgcgacgcgccgggtctcacagggccggcactcactctgtaccttgcaccgcggcagtgcccttataattacaaagcgggcgtatccactgttttgttgccgtctaaggcgtcattattcccgcgcgcgcgtgcttccccttgcgagtccgccgagttcccgtttgtgagttggggcgtctgcaccatcgcgcggatattatctgtgacccgccaggtatcgcgtgctgatctctacactctttgtgc

SEQ ID NO: 532311 - DNA, 164 bp, Homo sapiens
gttagaataatacttctggagatcatgtcttaaagtagatagctgtaagcataaacatattaatgaccacgtcctatattctggatacatgtgtctgcttgtctttagctagttagttactagtggaaactagtgaataggtaaaagcaacatgaaatatagca

SEQ ID NO: 532312 - DNA, 237 bp, Homo sapiens
gagtctgtgggatcagctgatactttctgatgatcagagtcaattctgctgatgacaagagtacaagttcagggtaatgagggacttggaggtggagaggcctgattcaggtgaagtggtccaggtctgcaggagacccaaaggtcagtgggatgactctttctcttggaggcatggtgctggcacatggtgtgccattagtgcaggctgcagggttggtcggagggcgctcgatgg

SEQ ID NO: 532313 - DNA, 128 bp, Homo sapiens
  misc_feature (20)..(20): n is a, c, g, or t
attcagcaaatctcatgtcncatcaaaaagtcacatctccaattcagccacagtccctggaccctttcccgttaaacattcatacaaaaacatattcacctttttccttcagatagggataacacatt

SEQ ID NO: 532314 - DNA, 123 bp, Homo sapiens
ccggttgcagtgagccgagatcgtgtcattacactccagcctgggcaacaagagtgaaactctgcctcaaaaaaagaaaaattcctggaggacagagttcacgtcatatcttttatttcatta

SEQ ID NO: 532315 - DNA, 107 bp, Homo sapiens
cgtcgagccgcagcaactcggcgatttcatccaggctgaagcccggcggctgggccgatttcacgaatcgcacccgtgtcacgtccgccgcgccatagcggcgaatg

SEQ ID NO: 532316 - DNA, 644 bp, Homo sapiens
caggagtcggtgttctgcaggcatggactggaagtcgtagtacttttgaactgtagggacctaagacatcttttagtctaatccccttatctatccggaagaagaaatcatgattccaaggtgacatgagttgcttgctttaggtcacagtgatttcacattgggatacctcgatttctaatgagtaatagaatatttaataaatactctcgaatttggaattgctcctattccagtcacactggatattttcccaatttggtgaaactgatattttaacaactgttaaccattccatgtactaagatgcttatagtcaaactgtgcctcttaaacctatttttattgtgtatttaacaaattttgctataatgttaaaaacaacttataactcatcaaactgcattttaattttagtaaacacaaattacactgaaacgggagtgttccctggcccctctcacaggacgtgtgaccagggttcggttcgctgcctgtccaaaccccttacgggagggggatcacgcagagggacaggtgcaggagcccaagtgggtgtgtgctacagtgtgctcttttaagccttggcatctgtggatggcttgagtgttaactagctcagtgaccctcacctttctgccaaa

SEQ ID NO: 532317 - DNA, 272 bp, Homo sapiens
gtaccttggcgctctcaggcgtttcccatgaccagatgccagtcttgtgtcccaatgaagatactgatggatgctgggactgtcgtctcccttccaggaatgctgggcccccaggctggccagagaagaagactgtcaggaagggatcggagtctgtaaaaccagcatacaggttcggcttctatgttcacatctgtatcattctcttatatgaaataatatgaagatccctgcagtcttatggtgtaatgaaaaatcatacaaaacacagg

SEQ ID NO: 532318 - DNA, 240 bp, Homo sapiens
gatctcacaggtcccctctggcacgcaggtcaaggccactggggtcgggcaagcagggcaggcaaggcaggcaagggcagggcagggcaggcaacaagggcaaggcaagggcaggcaagtgcatggcatcaagagggcagtggcagcagcacaggcagtggcacagcaccacacaggcacaggcaagcgcgcagcgcaacagcacagcggcacagcacaggcgcagtgcgcagaggcaca

SEQ ID NO: 532319 - DNA, 198 bp, Homo sapiens
ccttgtgggggaggggtttggcccccccccccccccaaaaaagccttttccttttttccggggaattaggggcccggggggggaggcccccctcccccgggtttttgggttgggcgggggttttttggggggtccccggggggtttttttcccggccccccccctgggaattaaaccccccccgctttctttggggga

SEQ ID NO: 532320 - DNA, 711 bp, Homo sapiens
tctttcccctccctgccttcgggtcccgctttttctctctttcgtcgctctcattctttccctttcctccttgtctgcttctgactcccttcgatctcctctctccacctttccttctgggtgccctcacgctggcggtctcactggtggctctcccgttcctgtttcccttgtgatgttcttgcgcgcctgttgtagtgccctattcgtgtgttgcgggcccatactcgtgtcgttgctggtgcgtgttgctgctatgtcatcctgtcttgcctcgtctcagcgtgtgcacataggtgtctattttcatcatctgctttcctgcccctctcaatctctttcctgtgcggtgcatcactcctatccctcatgagttgtcttaatgagaccttagacggagattccagtgaaagcactttcttagatgccctttcttatcgacattgacttggtattactttctgacttccatgaaaacaaagtgcgggtggcaaataggccacggacatctatcctgagaactatgataaaccgcggaaactgtgggccattttttttttttttggctgggtagagaaatcacgataaaatcgcaggctgtctagcatggagatgactctcagaacaatgggagggtctcggcacttgatgggggattagctgcttggcagcctgccatgccactgagggaagtccattagagatgataac

SEQ ID NO: 532321 - DNA, 166 bp, Homo sapiens
aaaaaaccaacctgggttctgggggggacctttggttccttttcctccctacccccccccgcatggtccggggaaaaaaaattctatgccctttttggccctgtttttagaaaaggtcggaaattttttaccaaagattattattaattttgtgccggttttttga

SEQ ID NO: 532322 - DNA, 885 bp, Homo sapiens
ggccagagatccggtgtctgctcctgtcgccttcgtctcctaatccctagccactatgcgtgagtgcttctccatccactttggccagtgctggatgtccagattggcaatgcctgctggagagctctactgcctggaacacggtggatccagcaccgatggccagcatgccaagtgaccaagaccattgggggaggagatgactcctttcatagtaccttcttcagttgagactgggctgctggcaaggcaacgtgccccgggctgtgtgtgtagacttggaacccacatgtcattgatgaagttcgctactggcactctaccagcagcattcttccaccctgtatcacgctcatcacaggcaaggaagatgctgccaataactatgcccgaggtcatctacatccattggcaaggtgatcattgatcgcttgtgttggaccgcaatttcgcaagctggcgtgaccagttgcaccggtcttgcagggcttcttggttttccaacagctttggtgggggaacttggtgtctgggttcacctccctgctcatggaacgtctctcagttgattatggcatagaagtccccagctggagttctccatttacccccgcaaccccaggttgccacaaggctgtagttggagcctctacaaaattccattcgtcaacgagcgtaaatctaaccctgtgagcacttctggattgtggccttcattggttagacactcgagggccgtctactgaccatctgtgcagaaagccttcgataatcaagtcgcccaagctacaataacctgtaaacgcttattatccaaattgttgcctcatcgatggtcctgagatttgagggaaccgaatgtgactgaaaatccaaagacgtgcc

SEQ ID NO: 532323 - DNA, 850 bp, Homo sapiens
agggaagggaggaagggaaaccagaaagcagacaaagaaaaaagagctagcccaaaatcccaaatcaaaccaaaccaaacagaaagcagtggaggtgggggtcgctgttgattgaagatgtatataatatctccggtttataaaacctatttataacactttttacatatatgtacatagtatgtggctttttatgttgaccatcagcctcgtgttgagccttaaagaagtagctaaggaactttacatcctaacagtataatccagctcagtattcgtacgtagtagctgtttggttttacccagaaataagataactccatctcgcccctttccctttcatctgacaagaagatacctcccttccagttccactcattttagaaaaccaaagtgttgggtagaaaacccaaaatggtccaaaaagccctttttcttggtgggtggaacccaggtgcatccaaaagaaacaggcgtggcccggaaccttgtggttcacagctttcacggcgccaccccgggcataaaaatgggcccaatatgtgggaggcctttggcaaaaaaacacagggttttgtgggcattggggaatacatttggccctttaacagggtggcaggtctctttcggtcacacccatctttacacttgcacgcacatccggtggcccacccagtcttttggacacggggctctggggcattacccattccctttataatacgtatatcatttaaacagctccgtgggaattcccagttcacacattgtgcaccctcgagattacatgggcgcccgggacgacactctggggccatacacggcgtcaacggcgttggcacctgcagag

SEQ ID NO: 532324 - DNA, 823 bp, Homo sapiens
  misc_feature (7)..(7): n is a, c, g, or t
  misc_feature (9)..(9): n is a, c, g, or t
  misc_feature (14)..(15): n is a, c, g, or t
  misc_feature (74)..(74): n is a, c, g, or t
  misc_feature (144)..(144): n is a, c, g, or t
  misc_feature (801)..(801): n is a, c, g, or t
ccgcggnanccccnncgggctgggaaggaacttcgcgcaacgaggcgcgttataagtagagagaccgcgacggnagacacttgagagaaaaagcccaagtgtttttttatgcatcaacgcgggcccccgacagaaatacccccncgcaaggagtgagggaagacctggaaatcccgacggaaccacccaaagacggtgggccgagccatagaaagggacccgaggccttccggaatcggctgagaaaacgcggggccggggaaggaggacgggagaaacccctggcaacacaggagaggccaccccacgtccttcgcgaaccaaagggagccgggacgagggggggcccaacgaacaacgggcgcgcaagcggggggcggagacatagggcaacccaggccggaggcccaaaaaacaccccacacacgagccacgtaccccgcctgagggccgaaaacaccgaaccctccttgcaggaggcgcggccaaaagagaatccccccacgcgccggagtatagaagggaggaaggcaccaggcccaggcaaacccaatttatagaaaaggccaacaaaaccagacggaccaccccccaggagtcggaaataaaaggaaaaaaccaaaccggccgaagaccaggcaaccaacgaaataaaacacacgggggagggccgccacccgtggcgccgggacatgaaagacaggatcttcaacagggccctccgaaagcccaacacgcgcccacacgggacgccggccccaaaaggacacaaaccggcaccgccaccggcgaaggaccccnccggccacgcctgggccggccc

SEQ ID NO: 532325 - DNA, 799 bp, Homo sapiens
  misc_feature (616)..(616): n is a, c, g, or t
gggggcagagggtgtgcacaagggagccggaccgatgcgtgtcgattccctgaagcggccccgagtgccgggcccgcgccaacggcgtccgggtcagatcgtggacccgtcgtgtctcgctcgtgggtcgctcgcgggtagtggtgggtgagatgcccgtgcggccgtctgggggggctcggcgatactgcggatctgcaggctgggagtgtggactccaacgcacggtccgctcttgtctgcctttccgacatgtatgtcgtttcgcgcttcgcatcgcgggtagtgctgtaactcatcgctttttccatttgtcatcttgtgtcgtcctctgcgtggggttgttgggcactgagttggttgtagtccattagtggcagccatgcaagagattgggatagatccggcaacgtatgagtctgtagggctgacgaaatttctgccccagtgcaacgctccatatcggtgaagcgtatagtagcttatcatagagtagactttgtcctcgtcgcccgtttagacgtcagccttgacggacacctagtgatgcagacctagtcgaacggtggccgctcagcatttggtccgtctggagggcgggctagcatatcaagtnaaagtccaataatcagaagttgacttgttgttccgaacctttttaattcctcgacgcttaggaagtatacgtagacataattgggattcttaacaaacaattgggaaggaaccttgggaaacgcattgggggccgagaacagaattcacagcacctcgaaaggggtggaatggttccccttca

SEQ ID NO: 532326 - DNA, 904 bp, Homo sapiens
cgatgtgctttgtctcccagaggggaggtttgtgaaagttttttcctaaggaaatatgccccgtggacccccccacggttcggatttctctgaccggtgaccgccccatgagtgctttgtttagttacaaggttgccacaacgagtgtcctgaagggttgtcccaggaaaccttggaaaatctccggccacctgagtcccggaatgccatctggatgttatttaaagaaagaagtggctactttgttccaaatagagggaaaaggttgactttaaccggagtcccttgattaactgcagaggaaggcaaccaggatgggagatccacccatcgttccagtttactggacccagaactacggggtccacccatgataacccggggattcgcaccagccatttaaaggaaacccccttatgcgccgggatggttagtgtgcccggtccatttaagatccatgtggccccattgtgccatttccagattttccagaaatatttttgctatatagatattgggagtaattctatataattttggacctttaaatattaaggtttaaaatacccgtactcttaaattgattctgttataccgttgtcttttaaactttaaggtatttacagtatataaaatttaaaatttgccccattttttttaaaaaattgccacattttgattctccctgggggaaaattggagataaatttttttttttttgcctctggagtttaaagtttccctatggagataagttttgtgattcctgtaatagatgtgtatgttttctatttgagagtttaaacctttgagagttataaacctttagttttaataccacctatgtatatatacttctgtgttaatttttgctttgtccttaataaaattttaaaatattcca

SEQ ID NO: 532327 - DNA, 141 bp, Homo sapiens
  misc_feature (107)..(107): n is a, c, g, or t
tctagaggatcctcggcgagtgcactggctgtagtaaagctctacagagctgaacttggccagaacaaaaccttcaatgaacaaaatgcctcacaagccacaaatcntaacaaacaaaatctgctataccttatagttcta

SEQ ID NO: 532328 - DNA, 327 bp, Homo sapiens
cggcggtcgagtcttgagatcccccttgttcctgcttcttgaaaaggcccagaatgattcacgaggatggccttctgagtcgatcacgcaagaagatccattcagcagtagttacctacaaggaagacaccctactgaacaatacttgagaatcatgttgaagcttaacccatttgctgagaccatgcgccggaacaccgattcttcgccatggccaggaattcacaaagctccgcgtgtggcataggcagctgctgcatcatcggctctacaagccaaattcagactagaacggcggcgtgtcgcagtgcaagaagcctgtggtaa

SEQ ID NO: 532329 - DNA, 100 bp, Homo sapiens
gcggccgcctactactactactgctcgaattcaagcttctaacgatgtacggggacatggagcaggcccctgctgtggccctgccccctacccacaaaaa

SEQ ID NO: 532330 - DNA, 757 bp, Homo sapiens
  misc_feature (488)..(488): n is a, c, g, or t
gctttgctttgggctgtacgaatggccttggaagggatgagtcaagacggaggaagaaagagaggtgtccaggagggagaagaatcctgatgacggggatggggggccagttccgcccgggagagaactacagagtatttggacagtgtccgtccagtagcgtttatttcaggcggagaagaaaccatttccgagccggtggctacccgttccggttaggggtcccatctttgatgttgctctgggagcccccaagcattcaactccggtgtacgttgcctttgttgcccatgaaacgaagtagtctgatcagcacaagatggcaaagcgggattggatggccgcgccagtcaggcgttacccgttccccagaaatttgtaggaagaacccagatttgtcgggagaggaaagcctgtgcccagacccatcgttgttaccgtgctgatcggcctgagaattccaccactataagccggcatgtcaaatnacacacccaagttgcggttcatgcaccacggggcaaagaggggtcatcattagccgaagcagtgatgtgacctatcacgacgtgacgcgagcaatttcctcccagccagacgcgcggggcccgtactaccagggacaaaattcgctcacaccctgggtgtgtaacacgttagcacactttaggcacaacttcttgtccatggcccctgtaaggaccaccggcggtccagtcacacagaatgtgcacagatttcaattcatcgccaagaa

SEQ ID NO: 532331 - DNA, 910 bp, Homo sapiens
  misc_feature (46)..(46): n is a, c, g, or t
  misc_feature (419)..(419): n is a, c, g, or t
  misc_feature (627)..(627): n is a, c, g, or t
  misc_feature (643)..(643): n is a, c, g, or t
  misc_feature (667)..(667): n is a, c, g, or t
  misc_feature (687)..(687): n is a, c, g, or t
  misc_feature (695)..(695): n is a, c, g, or t
  misc_feature (705)..(705): n is a, c, g, or t
  misc_feature (708)..(708): n is a, c, g, or t
  misc_feature (735)..(735): n is a, c, g, or t
  misc_feature (738)..(738): n is a, c, g, or t
  misc_feature (743)..(743): n is a, c, g, or t
  misc_feature (766)..(766): n is a, c, g, or t
  misc_feature (774)..(774): n is a, c, g, or t
  misc_feature (795)..(795): n is a, c, g, or t
  misc_feature (805)..(805): n is a, c, g, or t
  misc_feature (819)..(819): n is a, c, g, or t
  misc_feature (821)..(821): n is a, c, g, or t
  misc_feature (904)..(904): n is a, c, g, or t
gcacagcagacacttttcttagctttccaatggcggcagcatcatngtccctctcctcctcgacctttgccggcaaggcggtgaagaatgtaccatctttggctctctttggagaggcccgagtcacaatgcgcaagactgcagcgaaggtgaagcaggtttcctttggcagcccatggtacggtgccgaccgtgtgctctacctcggcccactctctggtgagcccccgagctacctcactggtgagttcccaggcgactatgggtgggacactgccggactttcagctgaccccgagaccttcgccaagaaccgggagctggaggtgatccattgccgctgggccatgctcggggcacttggttgtgtcttccctgagtagctcgcccacaacggcgtcaacttcggtgaggctgtntggttcaaggccggctctcaaatctttagtgagggtggtctcgattacctcggcaaccccagcctcgtccacgcacaaagcatccttgctatttgggcatgccaggttgtgctcatgggtgcgtcgagggggaacgcgttgccggtggcccactgagtgagaacgtcgacccactctacccaggcggcagcatcgaccctctagggtnggctgacgaccctgangcattcgccgagctcaatgtgaangagatcaagaactgtcgctngcaatgtnctcaatgtcngcntctttgtcaagctatcgtcacggcaanggnccacncgagaacacgctgacacatcgcngacgccgncaacaacaatgcatgagcatntgcaacaacnttgtcgcagcaagnangagtctgagatgtctcgcaagaggcgtgtctgtgctgagtgtacaaagaaaatgcaaagcatcaaaaaaaattaaaaagggcnacggca

SEQ ID NO: 532332 - DNA, 642 bp, Homo sapiens
ggattgtgaataggtaggtggaagaggcaggtagagaaaagcagcacccataccccgaacacatacacatgcacgcacgcgcgcgcaaacacactgcatgcccagacacactcacgcgcgcgcaaacacacgcacgcgcgcgctcccctccaaacatatatatgcactcacgcgcgcccaaacaaacacacacttgctgatgtacgggaaatatgttattgtccttacatgtccactatatgatacatttccctgaatacgaaagaactaggtaaactaggcaaaaagaagtacccttaactaacctataactaataggaatgctatatacctgatttgccaactctgaaagtcagaatttttgtactaaattcatgtcgactccacagggacctcaaaaccataagctaagtgacactctgtatgtaaatccgtgcaggtaactacactcaggtagaaagatattaaagtaataatccaggcctaaatacataaacgcaataaataagaggagtaacttaggattcctgtaaagatgagaaatgactagagaatgactaagttatcataataacaacaggtaatcttccctctatgtagacactcttctaagagctttgcatgcccagtgtactcatgagg

SEQ ID NO: 532333 - DNA, 291 bp, Homo sapiens
  misc_feature (233)..(233): n is a, c, g, or t
atcgatcattctctgcgctagacaatatccaaagtattttaaaatccccgtctcatactactggcccgtctttttacaacatcaaattttaaaattttgttgggtttgtgcctgaagtaaaaaaaaaaagtaaaggataccacacttggaaaggaaaactgctgtgtcaggaacattctggccttcacttaacccacatatagtacgtaggcgtctggtccggggtcccagangcctcgaattctcgtaactcttggctcatagctgttacccgggaaccaccacaccaca

SEQ ID NO: 532334 - DNA, 407 bp, Homo sapiens
ggtacagagttcacagaatgtggcccgcctgcaaaaagttcctgtgccaaagtgaaaaccaagatgtgagctggaccttacccagggaagaaatatccaacaaggacgccacaagaaccctggccaaagactttgagccctgggagctcactgagttgagtcaacagagtggaagaatagggaggtgtgaagataaagaagtagcagctctggtaaggaagaaaaagaaaaatcctgaggataagggcagaagagagacttcaagaacggcaggtcctcgaaaaactacaaatagaactacaatgtgatccagcaatctcaataatgggcatttatccaaagaaaagaaaatcagtgtattgaaaagacagctgcacccctaagtttattgcaacactattgacaat

SEQ ID NO: 532335 - DNA, 214 bp, Homo sapiens
ctctagaggacccctgaggacaggcaccagcctttgccaggcactgctgcacaggcatagtctgaggcggtgtcaccactgcttcaccctgcagcacctggacaccggctggagcacaacgctccaccctgtccctctgagtctatacactgtcccttggccctggacccagggccatagggtggacccagagggagacacaatggcacgtggg

SEQ ID NO: 532336 - DNA, 877 bp, Homo sapiens
ccacaaagacatggaacactatacctattatcggcgcatgagcatggagtcctaggcacagctctaagcctccttattcgagccgagctaggccagccaggcaaccttctaggtaacagaacacatctacaacgtaatcgtcaacagcccatgcatatgtcactcacatcttcttcatagtaatacccatcataatcggaggcttggcaactgactagttcccctactaatcggtgacccccagcatatggcgtatcccacgaataaacaacatcagcttctgactcttacctccctctctcctactcatgctcgcatctgactatagtggaggacggagcaggaacaggttgaacagtctacacatccacttagcagggaactaatcccaccctggagacctccgataggactaacccaatctatcagcactgtacagcctccgcaggtgtcatccatctcatcccaggggccatacaattcacatgagacaagcaattctcacagaataaaacgccacatgcaataacccaaatcaccacaagcacaccacgtatcgacatgatacacaaaaacaaacaacaggaagacgcaaaaagaaaaacccacgcgaggaggccaagcaataccgcgaaacacaaacaaacgtataccacaagcggaccaaaaccacgaaacaacacaaaaaaaccacgccaatcaccgccaaaaacacaagcaccaacagggcaaaaagcacacacaacaaacagaaaaaagaccaaacaaactaagcataacacaaagacagaagccgcaaacacaagacacacaagacagaacacaaagccaaaaacacaaccagcaacacacagagcaaaaaagcacacacagacac

SEQ ID NO: 532337 - DNA, 160 bp, Homo sapiens
  misc_feature (96)..(96): n is a, c, g, or t
acttccaacgccgctctgatgcatcaacgccgctctgactctcaacgccgctctgactgcatccaacgccgctctgactgcatccaacgccgctcngactgcatccaacgccgctccggattcggggatctgaacccggagtggcggcgttggatgcagt

SEQ ID NO: 532338 - DNA, 134 bp, Homo sapiens
gcagaagaacaatgtattaaaacagtaaactcctttacaattccaaagaaaaataaaaaagaaaacatcaaatcaaaaagcacaagaagattatgaacagatacaagccaaacgtgctgctaagaaacaagaat

SEQ ID NO: 532339 - DNA, 257 bp, Homo sapiens
agcctgattacgctgctcacacaggtggatcgccacggcggcgcggtgcaggagccgctgcgccagtttggcgaacgcctgcagaccgcgcgcaaggcacggatgaaagacaaggtcggcaagctgacggtcaagatgaccggcgtgatggtggtgaccctgctgccggtgctgctgatcctgaccgccggcccgggctttctgggcgtgattcgcatgcttgcgcgcatgaacggaggacattgatgaccttgacg

SEQ ID NO: 532340 - DNA, 386 bp, Homo sapiens
  misc_feature (198)..(198): n is a, c, g, or t
  misc_feature (296)..(296): n is a, c, g, or t
tttttttatttttcaatttttatttttttgagatggcgtttcaccctgtcacccaggctggagtgcagtcgcacaatcctggctcactgcaacctccgcctcccgggttgacgccattctcctgcctccgcctcctgagtagctgggactacaggcccgtgcctctgcgcccagctaattttttgtattttttagtanagacggggtttcaccgtgttagccaggatggtttcgatctcctgacctcgtgatctgccctcctcggcctccctaagtgctgggattacaggcatganctgccgcactctgcccaagttccttatttttaatagaaaagaaaacaggaaaggaacacagtccatgtgagaaaggggttcatggttaaa

SEQ ID NO: 532341 - DNA, 377 bp, Homo sapiens
gttattgtagactattcagctgggtaactggtgtctggctgaggccatacttgagcgcagtgaggaaggatctccagcctgagtgtgccgtgggccccccagaatacataggggattcctgcaaaggcaagttttgaaatagagtagtacatactcacgaagacaagtctgcaagagtgtcgaggttttttttcgatatgatctggccctgatgccactggtgccaccttgtgcccctttcttgctgctagggggtctcatttgtctcaagagtgcttaagtacaccatcagttggcgaagggggcaggcaggatgctcaaggcctgcccagtcgggcccagcaaccaggctctttattagccaccgttggagacca

SEQ ID NO: 532342 - DNA, 163 bp, Homo sapiens
cagggagcagtcgcccgagatgcacaacgccgagatctacgaggcggctggggaaacgctggaagctgctcaaagacagcgacaagatccctttcattcgagaggcggaggggtgcgcctcaagcacatggtgactaccccgatacagtacggccaggaaaag

SEQ ID NO: 532343 - DNA, 152 bp, Homo sapiens
  misc_feature (53)..(53): n is a, c, g, or t
cagggcccgtctgtcctttgggggctgcttcgggcccccggtgctcggggccntgtgtggggcgagtaaaaacttccccagcctaaacgggggtgggttttgggtcagcttcttttccctcaattttgtttgcaataaatgctctatagcca

SEQ ID NO: 532344 - DNA, 134 bp, Homo sapiens
ttctgcaggtctcaacctcatctcctgcccgtctctggaagtcgtcttccaggccattatcttctgtgccttcctcctccatcttcagtcctttaacacatctcttggctgacttctggctggtggcgttccca

SEQ ID NO: 532345 - DNA, 147 bp, Homo sapiens
gcatcacattcagcctctgtatacaaggaccttgagataaaccaaactgactgcttaacgtaacccctcctattaaatcttgttatttgtcttgtgttgccatttcaaaaatggaacgatgcatctcaaagctcctcttcctatcac

SEQ ID NO: 532346 - DNA, 207 bp, Homo sapiens
  misc_feature (20)..(20): n is a, c, g, or t
  misc_feature (24)..(24): n is a, c, g, or t
  misc_feature (61)..(61): n is a, c, g, or t
  misc_feature (132)..(132): n is a, c, g, or t
  misc_feature (164)..(165): n is a, c, g, or t
tggcacagtgggaccaaggnaagncaggcaggccgcttgggcactgatgtaccggtggtgncaaaacatccctggaggagacctgaaatccgggtccagttaactctgcctttatacacacaacccctccanataactggtcaggaatgccactgattctactnnctttccaagtaaagagagtattccccaaaaaatgaaggaaac

SEQ ID NO: 532347 - DNA, 905 bp, Homo sapiens
gctaaagctgtggaccgtgtgggctcgccgtccctgggactaggtattcaggcggtcgctgcagattaccagtatataggtgcatatcccgaaggtcccgaccgctcatgcggaggcgtgttccgtgtggcagctgcacctaccaaggagctgcttggtcaagcataacccctatcgcagcaagcccctggcgttctcgcggacatctgctgctggaagctctacaaatgcctcagtgaacacgcggtgaagcagaagcatgattctgagccgctggggttgaaacgacggttcatgaaattttgtcactgaaggacgaaacaagggatcatggtatttggcaggagacacactgcccattgatggtatactgccatctcccgagatcatgtgtgaggaccgaaattttgccctatgtctatatccccgtctaagacggacctggtgtgcacgccgacaggctccaagtcgccccacctgtgtgataatggtcaagtccccagtgaggagataccaggaggcttacgatgacgtgcctggaggcatgtgcagtccctggtccctacccctatgaggggctccggtaggacctggagcacctgccgcctggaagctattgggctggcagtcagtgacgactggctgtcctcctagccacccaaatgacggtatctttcccagttcccccaatggcactgccttcttcccaggcagctctaacagcccttgcatgaagggtaatgctaactcattcttgtccaatcaagtgcccaattccgtgtagaacctaaagggctgttccaggaactgttgggtggggaacacgtcactgctgcgactaggagtgcgggaacaatcagcacaaagagccaggacgggcagtaaaagcagggaggtcgcaccgg

SEQ ID NO: 532348 - DNA, 679 bp, Homo sapiens
  misc_feature (43)..(43): n is a, c, g, or t
  misc_feature (93)..(93): n is a, c, g, or t
  misc_feature (95)..(95): n is a, c, g, or t
agcttcagagcctaatgctgtggtgtgacccaagccctgccanctactagaaatgtaccttgaacatactattttggctctttgggcctcagntnccctaactattaaccattaattggagggaaataaaaaaggaagttttttggaagttggaaagggggatttgacccttttaatttttaaaaccaaggtagaaattttgtggggccccaaaaaaggcgggggggatgggggaaaaaaattttggcggggaaagtggggtttttggggggagaaaaaggggttttttaaaaaccccccttggaacaccggggggggaaaaattggggaaccccaagaatgtggttaagggggggttttttcttccacacgggggggggcccccgcccccttttaaacactcttacaaaaaaaagaaaggggtgggaaaaaacccccctctttttttttgggggggggggggggattttttgaaacacacaagggggtctcccccgggggggggaaaccacggggggttttttataaacaaccttttttggggggcttttatatattgtttttgttagggggggcccccccgcggggaaaaaaaggggggggaccccgggggcgccccctcccccttttttttttttaaaaacccccaatagggggttttttccccaaaggggcgccc

SEQ ID NO: 532349 - DNA, 1119 bp, Homo sapiens
  misc_feature (629)..(629): n is a, c, g, or t
agcggggtgctggcgcgtggagcctcgcgcggcgcgtggtggtggtccgctccctcgtgtgcgcatgcctgtcgcgcggggtgccgtgaggctggctgtgcgatcgcctttctctcgcccgcgcggctctgcacgtgggcattggttccatcggcaggtgaccccacttcgcttgaggaatcagctaggagtaggccgtggaaggttggcgaacacagcatatgccgtattcgcaagaataactgccaccggagctcgcgcgtctctcgagctcgcattgtggctggtacaccagggtgctccatgggcaactgcaagatcgctggaacttctggttcaagccgggactctgggttggggttcctccctttttgacgtattccacctcgatgtgcgtccacggtttccttctagcgtatcaaatcggctggccctttcgtctccccagcatgtctctctcgtgtccagagggcgggatcctctgcatcgctgtcggtgggattttggagaacatccgggcgccgccaaaggtgcgctggccccttccttggtagttcgtggaccagtctttgttcaccggagcgaattcggggacacaaacaaggagtaggacagcgactcgtggagtntctctctatatgggtcgatcgcggtctctgactggaggctgcgggaaagaacgattactatcccgttttctctgtcgctctgccattcgaattgggacccgataatgtcctggcgtccatgaggccgctaggccaaatcggttttagatcttcgtccctaggggtggtttaatttttaaggggtcacacacctaagggttcccaacgacacgactctccttaaatggaattggcttttaaatcaacgccaacggaataccccaatcgtgttcggggcagttaattaaacaacgtggaatataaaaggtttggcaagctttagggtttataactttggcgggagataacacatttcttggttttaggcattaggttatcaggggcaaaatgtggttacttttggtacgagcaacaacttatacaaggttaggttaaagaaaatctttagttcaaatattcaagaatagttattttaagccaaagtaaggta

SEQ ID NO: 532350 - DNA, 871 bp, Homo sapiens
gctgctgtggggccgccggctgcggactttgctgcgtggccgccgtgtggctaggacgagcgctgtgtgcgggatggaaaaccaattctgtgtcctcggatggaccagcaggccagtatgggcacccagtgcgaatactccagaccttggtaggcttgtcgagtgcgatgcgactgcatctggttcagcgaccgcaagtacccgccgaggcacaaggaggagaccccatgcaactacgattatcgagcagcacaggaagaagcgtgcatgggtatctcatctttgcacaacatggagttccatggtccgagtaccatagagaatgcttttgtgacattggttgcaccggtccctgtactcagaaactaagaggtgttagatatcgagtgagtctgtatcttcccaagtgccccagacgaattgccttgtgcaaatactagctgcgttccacacaagcatgggtggtcatgacggctcaagacagcgtgcccagacagatgggaggaatttcacgttgcagcaccaatgcacgagaaaagggcactcaagctaatcgattcgcagggtagtatcctaggctatcagggtatgaccatcacgggaattgagacatggctagtcccaacccgtaggtggaacgaatttgcccacgaatcgggggcttccaagaggcctttcctgggtatggcttcctgtgagatgaccacggtctggagtgctcatgtgagtcgagacgaatccagtccgtgcccatgcttttgtgaatgctgggggttatcgtacgtcacgggcgttttcaattggttggttggaccagaggtggaagggttctatttccgccgactcgggcaagggcccgggggagccctgg

SEQ ID NO: 532351 - DNA, 138 bp, Homo sapiens
accctatctcagacagtgaaagtgaaatggaatgatttgcactcttggttctttggagccgtgtggtggaatccccttttccccatcttgttctttcagttcattaatgagcagaataaaaagagtgaaatggataaa

SEQ ID NO: 532352 - DNA, 226 bp, Homo sapiens
  misc_feature (32)..(32): n is a, c, g, or t
  misc_feature (72)..(72): n is a, c, g, or t
  misc_feature (101)..(101): n is a, c, g, or t
  misc_feature (121)..(121): n is a, c, g, or t
  misc_feature (127)..(127): n is a, c, g, or t
tgaaatgatctcactccatcaccccaggctgncgtgcagtggtgcagtcataactcactgcagcctcttaantcccaggctcaagcaatacttccccctcngcctccccagtagcaagtanaaaaanatgtagctgggcctggtgtcacaggtctgtggtcccagctgctcaggaagctgaggtgggagagtctcttgaccccaggcggtcagggctacagtgatc

SEQ ID NO: 532353 - DNA, 923 bp, Homo sapiens
ggcggtacccttcccgacgcccggggttcctccgacggttctctcgttgtagtccacggactggtcttcagataaccggattcgtctccgagtgtgcgagtcgtggagccgggatacacggcgctgaagaggctggactcggatttcgttgcactgagcaatgggtgatatccggaagagaattggtgattgtaggtgatggagcctgtggaaagacatgctagttcatagtcttcagtaaaggaccagtgtcccagagggtgtatgtgtccacaagttgtttgaaaacatatgtggcagatatcgaggtggatggaaagcaggtagagtgggctttgtgggataccagctggtgcatgaacagcattgatggatcgcctgagtgccgcctctcctaacccagcatactcgatgttgaatacgtgatgtgtcagaccagtctgacagccacggataggtatagacatgatatcccagaaaatagtgggaccgcgatgaacgtggagcatggtcgagttcgccagagtgtgtccattcatcctggtttggggagatcaagcaaggatcttcgagaaatggaatgagtcggcacaatgggggagcgtagccaatgatgaaatcgggaagccggtgaagactggaagaatggcagagacatgcgctaacacgaatcggggcattgggggtacatggacgtgttcagctaacgcccgaaaggattggaggtgacgaaaaggcgctctatgcaacatgggctacagaagacgctggtcctgctaccgcctacaagctggggcacagcatgcaaaggctctggggatgcccttggtttggcgaaaaaccattgtctgataggcagcaaggcccttaatgcggggtaaatacgggaaagtgccggtcatatcaattctacggtgtctata

SEQ ID NO: 532354 - DNA, 394 bp, Homo sapiens
ctccgaggtcatgaagaacttctcgccgggcgggaagatcaccgacaggtcgtcgaagaagcgggacttgaaggcatcgccaccaaaccagtacttggggatgcgcttgtcgaaaccaaaatccagcttttcgcgggggatgatggggtgcagggcttctggatgttttgccatattgtcactctctcctcgtgtctccgggatggaggaactgtacaaattgcccagggcagcaaacaggatgaggggtgacagcagggtttcctacacgacagccctaactcagtgtttttactaggttcaagcgctgttcaagacaaatgcaaaaggcctccgaagaggcctttgtgtgtgcgcttatgtgccctcgtgaacgcttgactcaggtggtgtg

SEQ ID NO: 532355 - DNA, 105 bp, Homo sapiens
tcccctttctggagccttttaccactccagcctagcccttacccccaattaggaggagcactggcccccaacaggcatcaccccggtacacccggtacatgcaag

SEQ ID NO: 532356 - DNA, 181 bp, Homo sapiens
ctgtgttctcaagcttcttctcccatccttcaactgtcagagacctagacacagtggacaatggcatactggaaactctacccacagtgagcatggcgagcacttagtctaagatggagcggagactgcttagtccacaaattctgagcactatgggtgtaacagcctgggcttgtatccc

SEQ ID NO: 532357 - DNA, 383 bp, Homo sapiens
taattttttttttctgactgaatatgagatgtggagcgtgcgatgtgtgcttattggtattaatagtgccaacagggtttgtgtttttcttataagggggggaatggtagagaaacttcaggccaggggtggtggtggtgcctgtagtcctagctttgggaagctgaagtggggcgagtgacttgagatcaggagttcgagaacggccgggccaaggtgaaaccccgtctctgctaaaaatagaaaaagttagccaggcgtggtggtggatgcctgtaattccagctacttgggagctgaggcccgggagacagaggttgcagtgagccgaggtgatggcattagactccagcctggggaacagggtgagattccatcgtaaa

SEQ ID NO: 532358 - DNA, 625 bp, Homo sapiens
ggagataaacatcatctcgactgtgaagggcaagatccagtgttctgcagcgagcaggcagatgatgcagaggagcgagctgagcgcctccaggcgagcaagttgaagggagaaaggcgggcccgggaacaggctgaggctgaggtggcctccttgaaccgtagagatccagctggttgacagaagagctggaccgacgctcaggaggcgcctgggccacagaccctgcaaaagctggaagaagctgaaaaagctgctgatgagagtgcagagaggtagtgaaggttcatatgaaataccgagcctttaggagatgaagaaaagatggaactccagggaaatccaaggtcgaaagcaacgctacaggcagcaatcgcccgaaagacggcagactcaggaacgcattgagaggcaagggggacaatcaggcagaacgtgaggcgaagaatccaatacagaaacaggaacgcaactacagagcacaacgccccgcaaggaacgcaaaccgcaggcgtagcacgccagacgaagcacgataccccgccagcgcgaagcaacacaaggcatgaaaccagacatgaagaacgtgcatgagacccaaaaagcccgcaagtcggcctgaaac

SEQ ID NO: 532359 - DNA, 455 bp, Homo sapiens
tgttgtggggcccgtgcaagtgagtttgtagatgactcagctatcaggatattagcagtaaagccgcctgaactggcagcagcatcacgaaacagtatgatgtagtgattggcatcaacacttctccagctcctccaatatggaatgcttgtggggttcgttttttcttccagccaggcagcaatgggatatggcattgtgaataatcggcttgtatgatttactactgggctccttaaagagcttgggacctgtgtactcggccacttgaggccagggaagatgccgccgacgcggtctcacagtcctcggtctgtgctcctgctttgggttacggctcagtatgggcaggcttccatcgattccactcgctgagaaggtgtgccccggaatgacgctctcggctactgtcgtcccgcagaggccacggacaggtggggctgactgagtcggct

SEQ ID NO: 532360 - DNA, 444 bp, Homo sapiens
aaaaaaagttattgcgccggcaatttaacggattataagcttgggggtggggagacgtagatgggtggggcgtgagggtgtaaaagcgagacgaaggaacttggtcaggagattggtgtgctgagatgtgttgtaaaaagggggttgcaatacttgcctgtgcacctatgtgtaacaggatatgctgtaaacccgcctacgccacccgccgatttaacgcttagccgcaatcgcgttggttacccaggagaccgcgggttaactaatagtagggggaggtggggggggaagctaccctcaccacgtgttacattcaggatttgctagtgacgcgcgtacgcctgacgaggttgaaatggttgcccgcctgcggcaactccacgcttggcgattacttgtacagtattggttagcctggtgggcacgcgtaaaagatagcaacaa

SEQ ID NO: 532361 - DNA, 88 bp, Homo sapiens
ctcttggggaagggtgggcctagtgcgggatcttatccggccgggtcgtctgggggatacgccgggcctttcagctcctgggacaccc

SEQ ID NO: 532362 - DNA, 413 bp, Homo sapiens
aatcgcacgcaactccactgtgtccctggctatggagctagagcttcagggaattagtgatgtatcagaggatagaagcgaaggaagtactcacggatttctcttcgtatacccctcataaagtgtgagcttactcagtgagtctgtatttgtctggatttcccagtgatagagatgccatttgtccaaggagtagctttttagaagaaaagtgtacaaatactctttctttcataagaaaaatctcagggaagtttcttggttcaggcaagaatggggatactcttccactctctaaaaatgcagatcatttactgtacctaaagacaaaggtaaggaagttggtttaggctctgaattctagagcctgaattctaggctcataattcccattctgaattttgaggttactt

SEQ ID NO: 532363 - DNA, 372 bp, Homo sapiens
aaaggtaggaagcagagacatcgagacactttgccaagctcacctatagggtctctgctgtgaagactgctcacaggagagtcagcatgtggtcaaggtgcaggatgaaaagtctctggaccaaagtcacttcctgttcttcttgcctcctttcctcccttcggctcttttcagcacagcctttaacattttcaacacttgtttctgtttttgataacttacatgcaccaggaaagggggcagggggccttagttccaatttctcttccactcttttctgaaacgttcctgccagcagtcagtcctgccgggaaagtttccagtctcagccggttccccacacccagggccgggcctcgggggaggccagtg

SEQ ID NO: 532364 - DNA, 262 bp, Homo sapiens
tatagaatttccgagcacaggtgcttaagtgaccttacatatcacaccctccaaatcccctgcaggccatctcagttgtggagaagctggaagaagatcagggaaacggaactgccttcttcctccccgtgtggttgcactgacaccagaacattcttgcttgttttgatgcaacctatgatccaatgtggtgttttttgcgcaggtttgtgcatctgtgtggcacctccatgctaaccaccctttggagtccttatgctgc

SEQ ID NO: 532365 - DNA, 279 bp, Homo sapiens
gatatagagagaaatatggagctagataaagaaatgggcaaagacagagtgaaagagagagagagacccatacatatactttttaaagcagataaaagcactgaacaagaggctaaagaaaaaattattatttttatcatttgattggctgctgctaacttttcagaagagattaatcatcatcagaaaaacattttgaagtcctatgccccatgctgttttcatactctctttaaagccatttagactgatagaatcctcgtattctaggagcttatg

SEQ ID NO: 532366 - DNA, 144 bp, Homo sapiens
cagagggtatctaaatattcagcatacctcatcggaacagtctggcttttggtgtcatcatagcaatttgttcaacttcaccctgtaaaattaaaaatctattatggtccaagtcaattccatggcttcgaagaagatttccaa

SEQ ID NO: 532367 - DNA, 839 bp, Homo sapiens
tcggcagagagccttctatcgcactttgggacaaggagaacaccactgtgccttagcgcccaaacgggtttcttttcgcccacagtacggaggaaacttcgttgtgcgtggttctccctcactgtcctggtaagaggtaattcgcgaatctggctccggtggtaggctttacttgtgaactgtcgtccgtacctcggcgccacattttacctgcggcggtctcgctccccacccaccgtcctcgtgttaatatgtgtgagactgatgttcgagtagccccctcttcggcgacaggtccacaccctggctctctcccgcgtgttctcccccatggggtctacttcatgacattttggtgtatatggcgctcgctccccttgggtgcctcggatatgggagaacacaatcgtgcccttcttcactattgtgtgagcttcgatgcccccttttatgtggttgatccgctcccgcgcgcgctcctccttgcggtcctcgaaccacctatgtgtgagccggtacagcccccctctctcctcgctctccgagtagttcccgatagcgtctgtaatgcgccgcctttctctcctacggcggtgctcaatatgaactcgtccacatataattacctcactagactaccctcaccgctctaatatacactggcgatattatctacatgctcttctagattgtgagcgcctcccccccctgagggttttttttctctcccccgcctgttggatcagtaagttcagtgctgctctcctgccgactttcattttgccccttccccacgtggtcttatcaaaatacaagtgcgtcgtttttaacaattaaca

SEQ ID NO: 532368 - DNA, 373 bp, Homo sapiens
tacgagcgggtagtttacaccgtcaagacgggcgtctgtcactcagctccagttcctgcaaacggctggcagatttgcgccaactgcggggccagttgtgccaggcgcgccttggcagccgactcctgttcccagctggtagccttggcacgctcgatcatggccaacatcgaatcactgagcaattcgggataagactgaaactccttggccaatgagcgggcaccttcgcaatcgttgatcagctggtgatcatcgaatactccgtcgaatgcctcgggcaacacgacttcactgacaagaggccccaacttggctaccgcttgctcaatcgcctgggctactaacggctgcacgtcagaccagcgagagg

SEQ ID NO: 532369 - DNA, 326 bp, Homo sapiens
  misc_feature (192)..(192): n is a, c, g, or t
  misc_feature (227)..(227): n is a, c, g, or t
cggccgcatcggtctttattccttctttcttctctttcccgaatctgctgctgcaaagcctcttggtaaaacttaagtagctgtggggggaggtttcaatttatcttcaaaaatcaatcctgaatttatcacttgatcacttgtaatcttcagttcattctgtccaaccgtattcacaacaggttgtgctanttggtgggtgacaggagcactaacataagctgcangctgtacgggggtgattcctgaaccataataagcaagactgggatcgaaagtattcctggacccataaaaatagtatgcatcatcataaggagttcgat

SEQ ID NO: 532370 - DNA, 218 bp, Homo sapiens
tgtagaattagaattatacattcatatttaagcagccagcctggcaatttttttagtgttcttcagaattaacgagacttgtatcatctgtaaagggccatctctgtgttctgccaccatataagcagaagttgtatatacaagagaaagtgatgattttaaaaaaggatgtaaacagaggttatgggaaaaaaaatgcctcaaatatattcctcgtt

SEQ ID NO: 532371 - DNA, 394 bp, Homo sapiens
tcacccacggggaaaatcgtgcgcccggcctcgtccaccgccagaagacgccgctacacaatggagtctcgctctgtcgaccaggctggagtgcaatggtgcgatctcggctcactgcaatctctgcctcccggtgagaggtgaagccagctggacttcctgggtctagtggggacttggagaacttttctgtctagctaaagatttgtaaatgcaccaatcagtgctgtgtctagctaaagtttgtaaacgtaccaatcagcactctgtaaaaatgggccaatcagcactctgtaaaatggaccaatcagcactctgtaaaatggaccagtcagcaggatgtgggcggggtcaaataaaggaataaaaagctggtagccgagccggcagtggc

SEQ ID NO: 532372 - DNA, 116 bp, Homo sapiens
gtgtacgtgccctgtttgctgatctactcatcctaaggtacatttgcttccaggtacatgttgtgagtatactacaatgtgcatatatctattccatgtctgctttgtctgttggg

SEQ ID NO: 532373 - DNA, 83 bp, Homo sapiens
tttaggtgagaaattattttatcatatttagaatcaaaatacccttaaattttacattacataaagggatacaaacacagatc

SEQ ID NO: 532374 - DNA, 105 bp, Homo sapiens
caaggtggcacaccgccaccagtgcccagccctggaaaggggacccgtggaacagctggtccgcatttcccatcgagactgggccaaagggtgaagatcagggct

SEQ ID NO: 532375 - DNA, 1063 bp, Homo sapiens
  misc_feature (1063)..(1063): n is a, c, g, or t
ggcgcctcagacctcgtgtaccactgcgagcggggaggagtgcaggaaagaaggacgcggcagtctggggagcaccctaggcagcaatgtacgttgggcccgggtctttcgcacagtgtgggagtgtgactgcgcttggtgaaaggcaggagcgccagcggctcgggctgctcttggctatacgagaggagtccgttatgcggctcgtcgaggggcgacacgacccatgaagcaagatgtgcgagtacaagagcatgtatgaagatactgtttgacgcgagcttgtcttccatcgcggaatataaggactctggaaatcataggaatataaacacagtctttcctaatacttgatgcgtgaggtttactcgaggcgctattggctgcttacagttcgagtcgcagctacttgtatccaggtaaaccacgtttgccattaccttggacactgttggatctatagatcccttgcatatgcgtacaaacgaatttatttgcccgcttacaacttttggagtctactctggaccttggcgtgaccgtgcactggcgcggatcttggacttgacggcctccaagagttcaatttcgtgagtcggtgtgcgcatacggtagctaaccatagtataccaccaaattgcatgcaatggcgggcccggtatatgagtgcctattccctgaatactggtgaacaggttgagcactcggtctctggaaaatttcggatgcacggcatctttaggggtctccctttgagaaccacgcgcaaagcgcctagttcgcgcaccagtgctcgactgaatttagctgcgcgcactcttcaatgagaactgccgcaaacagtaccacgacacctgacgccctcccgtaccaccttggggccggggggccagaagttcacttccaaaacttcacactttgggtacctatccaggtcgccccccagtccggtcgcacagatgtcgctcggggcgacttcttcgcagcatatagggtcgcccgacgagcaatccacctgcacttcatacgagccattacacactaaagggtaggcaaggaaacn

SEQ ID NO: 532376 - DNA, 268 bp, Homo sapiens
ttttttcagtatttttagtatagacggggtttcaccgtgctttgcccgggtggggctctgtctcgttctcctgacctcgtgatgtgccggcctctgcctcccaaagtgtttgtggattactggtttgagccaccatgctcggccatccagctactcttagaagcataatatttccagttatcctcctttcccatcctttgaaatttcatgtttctattctgtgcgcgttgttcaagcatgctatgccactctagcttcccatatgttc

SEQ ID NO: 532377 - DNA, 712 bp, Homo sapiens
  misc_feature (712)..(712): n is a, c, g, or t
gtctggcctatttttgttttcatcaaaaatgtcaggctgcacagtggcgccatcctgaaatcccagcactttgggaggctgaggcaggtggatcacctgaggtcaggagtttgagaccatcctggccaacatggtgaaaccccgtctctacaaaattacaaaaattagctgggcttagcagtgggggtctgtgatcccgtctacttgggtgtctgaggcagagaatggcttgaacctgggagacggaggctgcagtgaagcaagattgcaccactgcactccagcctgggtgacagagagagactccgccaaaaaaaaaaaaaatcacagaaaaaaacaacaaaacttgttggggacggcacgggcgccctcagaaagcggtttttcgacaacaattggtgttgtgagcagcagcggaggcccacatgaggagactgacgttgaaacaacgtgggacaacaagggggtgtatccacaaaagggagaacacccggggacaaaaagacaaagagtgcggagtggggtatctctcgcagccaagtaaataaaaacgcgccggggagtaaaaccaggacacgtccttgtgtgaacacaagctccacagatgtggcgacctctcaagaggaggcaacaaaacggggggacattatacaaacgcgaggaggtccaccgaagagagacgcgcgagaagtatcaaatttagacagcccgn

SEQ ID NO: 532378 - DNA, 230 bp, Homo sapiens
  misc_feature (123)..(123): n is a, c, g, or t
aacccaatgagcatgagtcaaaatcttaaataataaaaaaaagtctggccgggcgcgtggttcacacctgttatacagcactttgggaagccgagacaggcggatcatctgaggtcaggagtntgggaccagcctggccagcatggtgaaaccccgtctccactaaaaacacaaaaatcagccgggcgttgtggcacgcacctgtagtcccagctcattgggttccgatg

SEQ ID NO: 532379 - DNA, 983 bp, Homo sapiens
taaaaggttgaggagtttattagggaaatatgagaggcttaaacaccccaattgacagaaaaaaaatgtctgaaatgtgtcccttacaacccaagttgggggcctggccttgacctcctccaattctccaccaggaacactggtgtgggtttagccacaagcttctcctcgtggcagccccatttgcccggcgctctgagtatgctctttgaccaggacttgccccgcactttcccaccaataggttggggacgcgcagacatcatcatgtgttctcactagataccttgtgcaacagcgcacttgacgcaacttttacgggaaaaggtttgtgaacagaacgagcagaacacgcaaaagcaattactcagtgctgatcggagcgacctttcagcatatagagttccccaggccctatcggcgggcgtgcgtgcagtgtgtctccctcacatgtcacctgtttgcacaagtctagccagtgtcttctaaccacgtgttctacgtgcacacaaggcggtaacaaagtgccccctacagcgctgcgtttctcacacacgcgcgtttcccccatcgtgaacactgtgtctgtctcccgcagcatctatcctacaacccagccagcccccaggatgtgcgcatgaagcccccctatgtgggccaccaaccttttttgtaactcacgaccggtatacacaaccaactagatctataagacgcccccgttgtgtacgcccttcaatctctacgggggacgaacagcgcgcatcgcgccgcctgacaagcgccttgccgtggggagcctttttccccctgtgttgcgccccttgtgttcttggtcgtacaaccgcgatccttcccccacgctgcactggcatcggaccactgctactatgggtgaatgtgttctacccctttgttgtcatcccccggggccttcatgtgtacccctatttcccccgagcaggggggccgtcaacatttct

SEQ ID NO: 532380 - DNA, 266 bp, Homo sapiens
tggccaaggcccacgcagccacatcctgggggctccagcaacaccacagtgtcacactcaggtcaggcattgtgcatgctcccacacatcaacccatctcagccaatcatcttggcagcttgcagcaatcagcatttagtgtggcttcatttacttcgttgccttcgttcccgccatcctatttccaagcagcagcacacttcatctttgtgcacacacagctcatcgtcatcatcatcaccaccaccaccaccaccaccaccacc

SEQ ID NO: 532381 - DNA, 852 bp, Homo sapiens
  misc_feature (658)..(658): n is a, c, g, or t
gtaggctaagcataggcgctttgaaactcgccatgtatccagtcgaggtaggcgctgaaacgtgagacggagctgtgacgagcagtctcacacagcctatggtacgagggtgtctccggctgagcagtccattacgtgggggagctggactccgagaatcctcgcgtgtgctcaaccagatctatcctcctcgtgatcgttcctattgcaggagttgtggtagcatgcgtggcggacggactatcccctgtcaacacggtcattcccatctagtggacaactctgatactgcttggtttcgacgtagtggaacgctaggccttcagacccggtctccgagagggccctgagaattgagaccctcggggagtgaagggctgacaacaaatacaaccgactactggggagggttggccgaggggtaggagaggtggcaccgcagtggcgaggagctttgtgtaggtccattagcggtatagcaggccgatggttgggcgtccgagtcgagatgatagacagtacggcatctgtcagacaggggagcagcatgcaggcacctggataggtgcgggaagcatgggtacgctccgtgtggtgcatcatcatgaggtaagctcaagacccactttattctcggtggagccggttccatcccganaggtggggaggcgagtcgacctgacggtgtgattcgtgggcaccgattcaagaatcttctttggaactcctgaggagtggcttctgtctagcctctgagtggatcactacactactcgtgcgggtgggaggaccatgtcctagaaacctgtcttgagtggggaacatgatctctggttgcggcgaaagctggta

SEQ ID NO: 532382 - DNA, 168 bp, Homo sapiens
actagtcacggttggctgctgcaacacagacaacacccaagactagaaacaacagacaccatcttccgttacttgtcttacgcttcctataaacacttgcaacaaactttcctagttaaaaattctctcttcaagacacagcgtactaccagccaaccgtggactagt

SEQ ID NO: 532383 - DNA, 434 bp, Homo sapiens
  misc_feature (212)..(212): n is a, c, g, or t
  misc_feature (217)..(217): n is a, c, g, or t
  misc_feature (292)..(292): n is a, c, g, or t
  misc_feature (294)..(294): n is a, c, g, or t
aaatttttttaaggaaaagaaaataccatagaatgggtggcttaaataacagaaacaaatttttcacagttctggaggcttaaagtccaagatcaaggtgcagacaaagtaggtgtcatgctgaggcctcttctcttgtaggtggccaccactttgctgtgtgctcagatgacctctttgtgtgtgagtgtgagtgtgtgtgcacgcatgcngccantgggggaaatgctggccagttctccagcattctcttcttataagggcattcatcccattgtaagggctctgctangntgacctcatctaatcctaaataccgtgcccctcaaagtaactccaaataccatcacattggggttaggcctcaacatatatgaatttggggaggacacaattcagtccatatcgagaaagaactgcactaagaacttatc

SEQ ID NO: 532384 - DNA, 1205 bp, Homo sapiens
  misc_feature (513)..(513): n is a, c, g, or t
  misc_feature (744)..(744): n is a, c, g, or t
cctgggcctaaaagcgcggagagtttttgtgcgcccaaccccgccacaggcgctcccgccctttcccttatagaaacctcttgggagccacagaagcgccccggagagagtgaggaatgcaatcacagagagagggtgttgtgtgagagtggttctccccccgggagaggtataacactttttggtctgtgccacacaggcctttcgaaaagagggccgcgccgcagaggcaatatataagtttccccccccagagaggatatttctccgccccacacagggccccaacttccctctgggagagagactcctctctcggggccgtctgtttctcatgagacactctcttggcgagcccgttttaaataccccggcgggacacacacctgcggtctctttgttctctgccccccgcgagagagagttataagtctccgcgcgccctcacgcgagaagatgagagagcccacacccgagcggaaaaatgagagagagaggggagactctctcggnggcgtctcccgcgcacacagcgcgcgagagagaggcgcgagagagtcttgagaggcgcagatatagaaagggaaatggggagcacacagcaacccgcgagaccctcgtctcaacagagagttctttcgcgagagagaaacaccctcgggtgtctctctcacagccccctccgagagagacacacacggcgcctctctcacgcttattagggagaacgctctcttcgcggcngcgcgcacaattgtctctcatctcacacgcgtgttttatgccctcgtctctcgaatttataataaggagaaaatacccccacaaaaatatctcgcccctttaaaataattgaaattcccgccatacggctcggagacaaagtgatggtgaaaaaagttgccagatgtggggacccacattttctttgtgtgtaaactgtctagcactcgttgtgtgtgagtcactcggagtcactaatgcccctctgtgtttctttgggtagaaaaaagggagttccacgtttttgggaaactctcggcagggttgctgttgcggggtgttcaagtcccacagactagtgaaggcgtttgtataataacccccgcccccccaacatccgtcaatagagaacgctggcaccaaactggagggtttttgttttgggctttattattacggtatttttgttttgttaaggatta

SEQ ID NO: 532385 - DNA, 391 bp, Homo sapiens
tgctgtgtaccagctgcactgtctcctgaagatactactaaatccctggacttgtttctcccttaacttggcatgcaatcctaatgttccatgatcagcctgattgaccagtgtctgaatgttcctgataggtgagataaaaacagacacactgttttctccatatactagtctcaatactttattcatcctttgtcagccagaatgtgacatggccccaagatagccaatcacgtgacgtgtctgcagtatgtgttatctttccacatagtacactaccgactgatcatgcaaaaacaggaagggaagcattaagttataagccacattagttatcaaaaaataatatatactttatatgtcttgtatccccactgaggatttgctccct

SEQ ID NO: 532386 - DNA, 457 bp, Homo sapiens
aactatgttttagagatcaaataatgtattctacaactatatacatacaaacctgtctaaaccctgagcaaagaaagaactgtattgtgatgcagggttcgtgatacggtgatatgttagtacttgataggccaaagactaataatcaaggagtagaaacacacgatgcaatgtagcaaatcacagacgctatcattaacatgtgagatcaaaaaggcgatacagaacaaagtggtaaaacgaagatcagaaataaatgatatccatacaagcataatagtaaagtagagaaaatcgtggataatacacagataagaaaagacaatagagagttaatgcgagaacagaatgaagataataatagaacataagaataataacatgaagaatccatcaagaggaaacaagcaacaaagaacaaagaaaaaggagaactaagcgcacacaaacagcaaac

SEQ ID NO: 532387 - DNA, 103 bp, Homo sapiens
cgagctcggtacctgacggcgttgaagtcataatttcagtacagttcggaacttgcgaaagactatgaaattatttacacaccctgccaccgtagccatattg

SEQ ID NO: 532388 - DNA, 162 bp, Homo sapiens
ttacatggagcagcccttaaaaatgtctcacgtggaggcaggcacggtggcttatgcctgtaatcccagcattttgggaggcgaagcaggtggatggcttgagtatatatacttcgggagcaccgtggccaacatggtgaaaccctgtctctacaaaaagtg

SEQ ID NO: 532389 - DNA, 130 bp, Homo sapiens
  misc_feature (80)..(80): n is a, c, g, or t
tagaggatcgggaaagagtgatagcttagataacgaagtaactagctatactaaccagtgtgtcatttcgtgcatgcacngggcacacgattaaccaagtcatagaagcggcgtaagagtgtttagatca

SEQ ID NO: 532390 - DNA, 951 bp, Homo sapiens
tggggcttccaaaaaagtgaaaatgataataaataagtgtaaaaagatgtcaacaacacaccctttaagccaaaaaaaaaaatacatcaggagggacagtcacaattgattaaactgacaaggaggcgtgagtggcgttgggacccaacagggccacgggagggacacgcagggctgtaacatgggtgtagagggcccccctcccagcgccgggagcatgggccagggatctcggacatagggctgtggggtacgcacgctgctgcgatttctcccaccccgggaccaaagcacgttagctcctcctgtgcccaaggcccaacgaccatgctctcgtggccccttgcaccctaacacaggtacctatcgggaccgctggctgtctgcctctcaggggcacatgagcaaccgagtcgcaggcgggcacccatcttgtgccctgctatgctgccctgggggtgagacagcccccatagcttggggccacccatttctccccactcttgggcctggggggtcccccacccattgggattcccttacaccaaagaggcctcctcggattgcccccgcgatagtaggaactcctaggatccttactcaacatttgttccacctctggcggcttggtcccaatccctcccggcgcccttctttgggccttctcccgcgcccattcctgttcctggggacccttatcattgcgtcgaatccacgctttgggcagccgtttacactaatgtccctctcgccacattgcggacatgcgtcccagcggccagtgtcagcctgttacacccatgcgcactggctgcgtaacgcacaatgacgaaccgttggctcctgaacacactctctcttggtggtgtcccccgtgttctcaacacaccccctctgggtcccgcttaccggcgccattatcctgcgagccaacccggattaattggcagc

SEQ ID NO: 532391 - DNA, 3774 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3698)..(3698): n is a, c, g, or t
  misc_feature (3706)..(3706): n is a, c, g, or t
  misc_feature (3710)..(3710): n is a, c, g, or t
  misc_feature (3713)..(3714): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532392 - DNA, 712 bp, Homo sapiens
  misc_feature (458)..(458): n is a, c, g, or t
  misc_feature (460)..(460): n is a, c, g, or t
  misc_feature (502)..(502): n is a, c, g, or t
  misc_feature (504)..(504): n is a, c, g, or t
  misc_feature (531)..(531): n is a, c, g, or t
  misc_feature (548)..(548): n is a, c, g, or t
  misc_feature (628)..(628): n is a, c, g, or t
  misc_feature (639)..(639): n is a, c, g, or t
  misc_feature (682)..(682): n is a, c, g, or t
  misc_feature (695)..(695): n is a, c, g, or t
agcggggctgttgctgtctccggctccttcgctaacgattgcaggagaaataatgaggatgtaattattacagccctgcgcggagggctggggggcggcggacgcgggctcctctgcctgcgcgcccaggtggggctgggctgggctgggctgggctgggctggactggacgcctctccccgcccggccctccctcagcgcgcggcgtgtgcggtgcccgaggcttcggagcaggctggacctgggaacccggggaggggcctggaggagagatagctgggcgaggtgggcgccggcgagaaggcggagcccccggacagcgtaggttcgcaggtggagagcggacgcgggggcgagggtgcgcggcgggtctgcgatgcgcgtcggaaactcgcggcccccggtcccggccctgcgcgcttggagcccgggtccttccagcccctgcgcgacgccgncnccgccgccgccggtgaatggcgatcccggccacggcctggantnggaaattcgtgacttgtcggcggcccnggtcttctatcgattanagataaagcgatcagcagtgaatttatccttcgtgtggatgaactcggccagccgggctgtggggggttgggaactgtanatattctccanagcgccgcgttctcccgtcttcccggactcgaggctggaggcngctccggcgacgngaacgggggtacccccc

SEQ ID NO: 532393 - DNA, 436 bp, Homo sapiens
  misc_feature (10)..(10): n is a, c, g, or t
  misc_feature (40)..(40): n is a, c, g, or t
  misc_feature (42)..(42): n is a, c, g, or t
  misc_feature (67)..(67): n is a, c, g, or t
  misc_feature (103)..(103): n is a, c, g, or t
  misc_feature (129)..(129): n is a, c, g, or t
  misc_feature (134)..(134): n is a, c, g, or t
  misc_feature (140)..(141): n is a, c, g, or t
  misc_feature (206)..(206): n is a, c, g, or t
  misc_feature (251)..(251): n is a, c, g, or t
  misc_feature (277)..(277): n is a, c, g, or t
  misc_feature (290)..(290): n is a, c, g, or t
gggagggggngggaaggagaagcagagcgaagaaaacaangnagggagaaggaaggaacggggaaancaaaaaaaaggggggaaagcaagaagcaaaaaagangaagagcggggaggaaaaggaaagcnagcangggcanngatggggggcaagaggaaagaagagacccgagcacaaaaaacactggccgggggccccaaacagngaggagagagggggagagaaagttgcgcacggagaataagggcangaggaagaaggagcaggggagcgccnggagaggcgcgcngggaggagcgcccgcccaacagcagggcggcggcggggaggaggcagcagggagcgcgggccgcgggccggcccgccgagcgcccgatgatgcgcccgcggcccgcgccggggagactccgggctgcgcccaggccccgcgcgctc

SEQ ID NO: 532394 - DNA, 3862 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3786)..(3786): n is a, c, g, or t
  misc_feature (3794)..(3794): n is a, c, g, or t
  misc_feature (3798)..(3798): n is a, c, g, or t
  misc_feature (3801)..(3802): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532395 - DNA, 645 bp, Homo sapiens
tatggtcgtaaatacagtacagtcagaaagtgtctctttgcagactcattttatagtcaatttagttcagataaatataggaaactacttcagataattggacaaataagaatttcagtgtgtcactacctataattaagtagcagcacaccacaaccacagcaagtaaacactaatctcctctactgcctttttggggtcttttccagtcacaggagctaatttacagggataccactgggtttcaaccaatctctgaaagttcctttattatgagttttgaaatttaactaatgcatcacctacaattctgttggctagttttattcttactcttcactaattagttttaaatacaatatgtaatgttttcaaattttataaacataggtgttgtactaaaatgattaatggcatttgaaatacaacaaatgggttagatgttaaccaaaacaatgggattaagagtattttagaaagcgattttttgttaactagaaaagctaacggattcacaatgaatacagatacaatatttttaaccctgctctattattacatcagtagtatagtaagtgcataacgtatcgaagagaagaaatttcaggaaaaaatttcaaaacttaagttgtgcgtcaacacaga

SEQ ID NO: 532396 - DNA, 443 bp, Homo sapiens
aaagcagatgtggggtgacggctgtttcttctattcaagccatgcaccttactcttgttggtaaaatcactggcatgttctcacatattcataatttagaacttcttcatatgctctagtctccagagtccctccgttgtaaggttgatcaagctgtatgtgtattacaagcccgcccagttaaagagggtgcccatagagcagttaacagtgccactggtgttccaactgtttagaattgatcagggaccatgaaaagaagcttgtgcttcaccgaagaaaaatatctaatcatcgtataactttaatattatggaaaaccaacattgccatttataaaataaataattaaaggaaaggaatctttgaaccttatgtcccgagcaaatgccaggtctagcttacataatgctagtcctattttacttattgatttaaaaaca

SEQ ID NO: 532397 - DNA, 3722 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3646)..(3646): n is a, c, g, or t
  misc_feature (3654)..(3654): n is a, c, g, or t
  misc_feature (3658)..(3658): n is a, c, g, or t
  misc_feature (3661)..(3662): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaacctcctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532398 - DNA, 2962 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaatggctcagccaacttcctccacctcccgtgggaagtcgggtgccgagctcgattg

SEQ ID NO: 532399 - DNA, 3796 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3720)..(3720): n is a, c, g, or t
  misc_feature (3728)..(3728): n is a, c, g, or t
  misc_feature (3732)..(3732): n is a, c, g, or t
  misc_feature (3735)..(3736): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccactcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532400 - DNA, 260 bp, Homo sapiens
gctcggtacccctcctaacattgagctgattgatggaaggtagaggaaagtaataaacctttattcacagaactacaaaaccctttctggctgctgcctccttccctctctggagatagatggggtcgttactattatgaaatatacagcagaggagtgtttttctagtaatccctctagtactcatctacatcttgactacttcttgataaagatatcaccctctagatagaacctgtcatcaagacaagcaggccaca

SEQ ID NO: 532401 - DNA, 828 bp, Homo sapiens
tgcagtgcagtggcacgatcttggctcacggcaaccttggcctcccaggttcacgccattctcctgcctcagcctcccgagtagctgggactacaggcacctgccaccacgcccggctaattttgtattttttagtagagatggggtttcaccatgttaggcaggatgctctccatctttgacctcgtgatctgcccgtctcggcctcccaaagtgctgggattacaggcctgagccactgcatccagcctttgtctgacttttaagccaggttacagttcattcacaaggactcaaatatagaagtacggagtccatcacaggccatatttagttgctttaacacctggctaaggagacaatgagccgagaagctgcaggcagcctccacagatcagaagcagccccagctgacagcaagcaagaaacgggacctcagtcaaacagacgcaaggcaacaaatgaccaacatccctaatgagacggacagggattctgccccaaactcctcacagaaggcagccctgccacatcttgatttgggccttgtgagaccctaagcagagagcccagccatgtggtgcagaatttctgacccataacactggtgagctaatgagttgttgattacgatgctaagcatgtgaccatttatcactcggtaattgggtaactgttaccaaaaagcatgcaaatctatgcgaccaaattagaaaactccgacggacaaccacagaaggagtgaacaccctagtatgacctctaacatgactttgtatattgcgaatagctccaatatgtcggaggtaattttttcccactagttta

SEQ ID NO: 532402 - DNA, 2842 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactcttacctgacaacaccacagcatcagcctccttgaataatctacggccgtccacagcagctcgcgctaagttgggccggct

SEQ ID NO: 532403 - DNA, 1147 bp, Homo sapiens
  misc_feature (1)..(1): n is a, c, g, or t
ntttgttcctttcgttttgtctctcgtgttcgttgttctgtttgttttgtgcgggtgtgtgttgtattggtgttactatatggttgttgtttgttgtgtgcggggggagggggggagaagagcagagcgacgaggggggggggagggtgggggcggcgaaagaagagagaggagtggttcatgttggattgtttctcgatcaaatttttcttcccctcccgggtgttttttcttgttggtgatagtgttttaaacggtgttagaatttgttttcgctcctccccgttttcctcacatagtggcgcgctttcgttttattttaatgatgggggtctttcgccgctttaggttgtttaatttaaaaaagttggtgcgtgtggttaaaagtaaaattatggccgccggcttcttcttttacaaaaggggtgttttccccccgtcacgggggtggtttaaaaagccctcgctgaattcttctgctccccccgggggtaagacttgggcgccactttttaaaacccccttcgtttccccgcctctttctctaatccgctccgccgcccccagttgggaaacaacttttacatgggggaaattgttatagagggcgtgcgccccctttctggtgtgggataaataaacaatacgttgtgctagcgggaggacacctcgtggtaagccaccaattcctcccgcgaatgcccgccagatattaacgaacatttgaagcaaagtattcgagtacaacattcgagaagcgttcaataccacctcctctttctctagatgatacaaatgccatttacttcttgacctccctgccaatattatggtagccacgacagggtactacagaccccactccttttggctccctcactaggcttcatagggccaaactgttctccacacccgtctgaatagtaaatatgttgagcaagaatatgaaccaccacagagatataggaaagtaggaaaatattgtacttccacgaagtttctacgagagaagaaaatggaatcactcacggctgtatgctccactcattgttgggacactatatatacaaagcaaacaggaaaaatatatataacgccccacaacttggagaggaaaatagcccgcctcatcaatagatacaaaaaa

SEQ ID NO: 532404 - DNA, 2819 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccgagccctgagctgcagctagcacctgacgttagcagctcgcgcctgaggtagcagctcgcacaagagaaacagatgcccaggt

SEQ ID NO: 532405 - DNA, 3865 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (2295)..(2295): n is a, c, g, or t
  misc_feature (3789)..(3789): n is a, c, g, or t
  misc_feature (3797)..(3797): n is a, c, g, or t
  misc_feature (3801)..(3801): n is a, c, g, or t
  misc_feature (3804)..(3805): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgagnaatcaacaacagtccacagcagcccaggtgcaactggaacagcactcttccctacccgctctgcaacctcagttcttgttggagaacctacaacgtcacccatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532406 - DNA, 3619 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (511)..(511): n is a, c, g, or t
  misc_feature (3543)..(3543): n is a, c, g, or t
  misc_feature (3551)..(3551): n is a, c, g, or t
  misc_feature (3555)..(3555): n is a, c, g, or t
  misc_feature (3558)..(3559): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaagtggaacaacaccctcatctgcccactccacaacctcaggtcgtggagaatctacaacctcacgcatcagtccaggctcaactgaaanaacaacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532407 - DNA, 165 bp, Homo sapiens
cgcagtggtgtgctgagtgcaggcatgccgggatgagccatgtgcgggggccgcagctgggcggcagaggcggaggtgcctggtggccggggcgcggagtgggccggggggctccggcggggctgctctcccccagcccccgccgtgctccccccgggctgggct

SEQ ID NO: 532408 - DNA, 115 bp, Homo sapiens
cagccttgagaaccagactcccaactatgtacaatgaaaacttactttcaatcttcctgacatcaaattttccatccggcctgcttcttctcacatgacaaaaactagcccccat

SEQ ID NO: 532409 - DNA, 239 bp, Homo sapiens
ctcacctccagcagatctgcaagtgtggggtgaagaaaggtgaatctgtgtgaggatggggttagctgcagctgtggtgatgggctgagcgggggcggggggtgctggaggctgagggtgtagctggcgattagctaaggagggcgatggaagaggttgccagttcggagccgcctcaagagttccagccacagcaactagccgctcccgatgggtgcccttcatgaggctgctgttct

SEQ ID NO: 532410 - DNA, 3535 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3459)..(3459): n is a, c, g, or t
  misc_feature (3467)..(3467): n is a, c, g, or t
  misc_feature (3471)..(3471): n is a, c, g, or t
  misc_feature (3474)..(3475): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532411 - DNA, 431 bp, Homo sapiens
gtcaagtcaacatgctctggctcatatagcagagcctcggcctccacatctagctcgcccctctccgtcgccttgctcgccgatctgctgcagtacccaccgcagccggagataatgggcatcgaggcggtcggatccattgtccatcgcctgagctgagcttctctgctgccactggtgccatggcaacgacagatcctaaaagcatggaagtggaggtgctggttggtcgcattacaattaaggttcatcatggccgggatatataacctgagattgacaccggcctacacacagcagatttcaactacatctccataataaattttcgtatgtgcaattcagatggatcatgtactgtatgattgtggtggttacttgtgactgccggtggagtcaactacgatattatttcgagtttgtgtgtctat

SEQ ID NO: 532412 - DNA, 158 bp, Homo sapiens
tactacaatgtaaataactcacgtatagtggggaggggagttccaagtgtgccctcctctcttactcctgcctggattatttaaaaagccatgtgtggaaaccactatttaataaaagtaatagaatctgcaaagttggacggagcgagaattcgtgg

SEQ ID NO: 532413 - DNA, 238 bp, Homo sapiens
gtcgacgggtggttagggcacaggctgaaattagcttttgctgagaggaggaaggagagggagtctatgagagagagttcagctgaagaatgggagaccctgaatgcaagctaatatggacgttggctgggaggcagccagattagcctagttggttaagataaatcattagacttcccaggtattgaggcaaaacttgaaaataaattatggtctctctgtgtcgttgtcgacgcgg

SEQ ID NO: 532414 - DNA, 443 bp, Homo sapiens
  misc_feature (14)..(14): n is a, c, g, or t
  misc_feature (22)..(22): n is a, c, g, or t
  misc_feature (87)..(87): n is a, c, g, or t
cctacctttctccnggaagtcncccattggagctccatcaagactgaccgtgtcttacatcagttcagagaggtcccagcagacccnggagcacagatgggtcagcctactcagttctcccactgggctccctgttttcagaatggtctgtgtgtggagaagactcctaagtgccctgggaataggtgggctgtgggtgaagcggatgaaggcgatacagagcgaggacgtggcctgaaaccgagagcagcattctcccttccctgcttccatccgttcctggtctgcgtcccagccctggtacgtaaggctgtcccagaatccctgtaaattcacttttctgttaaatgattccagatcattcggttatgtgcaaccaaaagtcctcacccatacgtcatcttacagcattaaagcttcaggcgacttgggtatgttttaaa

SEQ ID NO: 532415 - DNA, 583 bp, Homo sapiens
gatgaaacataaagtggcaggcagatacaagtatcacatccccttccccacaagggactgtgaatatgggattaatgtccttgccattacctaggtggtctacagccctatcactaacattttacatcgtttctcagtagggatttgggcatgctaacttactgtatagaaagtttcaactttatcctcacgcgccatgtgatagaaaatgccttgccatctcaagagatggtgcatagggcggggccagggtgcatgtggctaccacgccgtgtcaatcccgagcacgttctggggacgggccgaggcaacgtggatcatgtcgaggtcaccgagttctgacgatcagcctggccaatatggtgaaaccccgtcttctacgaataatacaagagaattagctgggggatggtggcatgctaccgtagtcaccattgatatcgtcgggaagcgagaggtaggagaatcacttgagcctgggacgctgaagttgcagtgagcccgagatcgcatccacgtgctactccagcctgggtaacaagaagtgagactctgtctaaagagaccaagattgttctccaag

SEQ ID NO: 532416 - DNA, 171 bp, Homo sapiens
  misc_feature (41)..(41): n is a, c, g, or t
  misc_feature (82)..(82): n is a, c, g, or t
  misc_feature (106)..(106): n is a, c, g, or t
  misc_feature (125)..(125): n is a, c, g, or t
  misc_feature (154)..(154): n is a, c, g, or t
  misc_feature (167)..(167): n is a, c, g, or t
tactccattcgccattccataagtatgcctgctatgagganttctcctactttcaaatcatttgaggagagggttgagacanctgtcacaagcctcaagacgaaantaggcggtacgacccctantggaggcagtttttagggaggtcctcagnttccacgggcccnttcc

SEQ ID NO: 532417 - DNA, 285 bp, Homo sapiens
attttttacatattgccaattgtgacttagccaagtgtctttattcaaagactaataaagccttcacagcttccgaaacaccgcgctagatctggtagccgcggacaatttggattccttactccagtagggaaacgattcaacaactagcagcgtttcacgacagcctattaaagagcttctatgtatagtgtagatggttcatttgaaatggcaaatttctttttcggcaaaataaatgggcctggcaaacttggtttttaaaagaaaattaaaacttcattc

SEQ ID NO: 532418 - DNA, 113 bp, Homo sapiens
ttggggctcccccccggggggggcccctttaaaaaaattggatcccccggggtgcaggaatttggcccaaaaataaatcacccacccccccagaagggaaaccttggggggcc

SEQ ID NO: 532419 - DNA, 258 bp, Homo sapiens
cagcaatcgcagctcggtaccctttttttttaagcacaggcaaacacatttcttgcagcagccagtggggtgcgcccaagccctgtgctttggcaaccgccatccacagcgccccttcacaaccagcccgtgtgcaggtcaggtgcaaggcagccccacttccccacatgcagcaccactgcaaggctcaaccagctccccttaggcactccccaggagcaaggggcatcctctagcagtcgcacctgccaggctatg

SEQ ID NO: 532420 - DNA, 169 bp, Homo sapiens
  misc_feature (16)..(16): n is a, c, g, or t
gccggccagcggacangcaagagacagaaatcaaagaaataaccaaaaagaaacatagagattttttttttttggagacggagtctcgcccggtcgcccaggcgggagtgcaagggtgtgatctcggctcacggcaagctccgcctccggggttcacgacattctccgg

SEQ ID NO: 532421 - DNA, 616 bp, Homo sapiens
gccaaactctttggttcccgcaacactctgggggacaaaacaaaagggtgcacacgccccccggccccaaaacaggactttgggtgccaaaaggcaacgaggggctcacaagtaaatacgcccgcggtcgaggatgtccccgcgatgtccccgtgcgggcgtgagctggattctttataacaaccatgtgtcaaaccgccgccgatgtatccacgccagggtgctcgcgacacgtccccctgtatatgtggctgtttactttttaaacagacagtaccgccgctggcccccacagggggtatgtgaaaccaggtacgtccaatggtgggacgttcaccaacaaagacctttgcagctaccaggttaaatgtccctcaagagaccaccccaccttgagcacgttatcgcccgccgtagaaaagaccgccctatagagttcaggcggggctggaattccccttgtttagaaagggggtggcaacgaacacgggctcgatgttcttcggcgtttgaaatagcaaaacaacaaggggcgctactcaccgggaaggaaaaacagaggcgaaaaggtccaaaaaaaaagaaacaagcaaaattccgccccgccacaaatcaa

SEQ ID NO: 532422 - DNA, 221 bp, Homo sapiens
gctgccatgaggagacttgttgaaataacacggggggatgggaaggagcttacggtggccagcctggtgcagtgtgagcgtgagaataaacaggctgggcgcagcggctcacgcctgcaatcccagcactttaggaggccaaggtggtaggatcacttgaggctaggagttcaagaccagcctgggcaacatggtcgaaaccctgtctctacaaaacaaga

SEQ ID NO: 532423 - DNA, 118 bp, Homo sapiens
taacaatcactggataccgaagtaaactgatatactgaattccatagtacataacattcaatattttaccacttctgtttagcgaacgtgtatacttattttctgttcggtttaatga

SEQ ID NO: 532424 - DNA, 178 bp, Homo sapiens
tgtttcagttttgatgttttctattaaccatttatctaacttactaatattctgttctattgattctaacctatacaatttattcagtcatttaaaccaatggttgtattttttccagttataggatttctatatgattacttttaatgattccggacccattatttgataatatttt

SEQ ID NO: 532425 - DNA, 113 bp, Homo sapiens
tgtagttgagcaggtgtaggtgggagcatacctggtaccctggggtcgggggagactctggggtgcccagtgacgggaaagagggcatgctagtcattgctgtgcactgcatg

SEQ ID NO: 532426 - DNA, 654 bp, Homo sapiens
ggtggcacccatacatgcctgcccatatgcgatgcaccacatacagccacttcctggaaccgctgaatgacttcacggagcgatcgctacacagcacattttgcacgcgccacgcagccccgacttgctcgaaactcaacttgagctggctggtggtccctggatcctggagcccttcagttaggattactccctctttcttgcgctatatttgatagttggaagaaatatactgacagttatggtgcaatctttatgcggggaaagtaaagcctcacgaatgcccacagcctttctttcaaagactttgactctgacacctcttaagagataagattaaaggcccctggatggtgttgctgtgtagatgatgtggagagaagagggggaccaaaaatagggcctagctcccccaaaagtagaaaaacctgcagcgatcaccctcatgaggggcccctgcctgtaccgtcgcgcccctcttctgcccttctgccagtgtgtattgtagaaatgagatgttgtatggcgcatccccttatacgaggccgtccctgtcgatggggcagatggttctaaaaaaatgtcaataaatgaccaggataagtgccctcctacggccacgcaagtaacatgagaagatggaatctgagagtg

SEQ ID NO: 532427 - DNA, 373 bp, Homo sapiens
  misc_feature (204)..(204): n is a, c, g, or t
gcggtatctagaggatcccgaaaccctaataacgccgcacaaaaaacttttaattcataaaagaaactacagtacacaggaagacagtattactattcaaaataactactaacctcctgacctctctacctctccatgggcaaaaattattgctgcatgagtaaaaacacgcagtaatcaacctctccagcttctccccattgnacacactgctttctaagaatgagtgccactcattcatagcaatttctggcctattgacacatgactttggaatattaaaaatgtagtttcaaccataacaatttttgggagagaagcctttagcgtatgggacaaatggcatataattataaaactaaaatacaatatc

SEQ ID NO: 532428 - DNA, 178 bp, Homo sapiens
cgcttgtaccctctcggtctatcggggttatcgattatagaacaggctcctctaggtggatgtgaagcaccgccaagtcctttgagttttaggcagttgcgagtagtactctggcgaatagtttggttatgtaactatttgggtttaggatcaggtatagggaggaattataacccag

SEQ ID NO: 532429 - DNA, 3704 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3628)..(3628): n is a, c, g, or t
  misc_feature (3636)..(3636): n is a, c, g, or t
  misc_feature (3640)..(3640): n is a, c, g, or t
  misc_feature (3643)..(3644): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532430 - DNA, 819 bp, Homo sapiens
ttttggacgccatgggcaattgggaaacaaaggggtcccctactcgggaaatgggcacaacatgtagggaagggagtggaatggtagaattgccgcagttcagacctgggagaaggaaagaggaaaggatctacacgtagattcccagcattctcttgagcgacctttttccgttgggcgcaaattctttaggacataaagaagattctgagcctttgaccgcctgggaccggtatcattccagtcgttatctggacttattggaccggtgtcctcccctccgtgattcgttaattcaccgtttgcttttcatgtgcataagttgactcatttgtttcctgttagcatttgaaaccaccatattagccccccataagtcctgaccaaatgacttttaataaggagggggaaggtcccatgtcccaccctcctatgaaatttttggcctgattcgaccagtctgacccccacataagagaagtagttatgttctgtaaagaagaggttgataaaaacccttagcctggtgttttgtgacttagaagttttaagtagtcgttcttatatctaagcctttattaattttggtaaggaccatactatacgtttctgatgtcacctttactgttaagaggtgcccgggatctggtgacccgtcacttccggatttgtgtgaatcagatcatctaaatataatataaattagagactggtacttgtatttcctgatttaaaaccaagtacgtctgttttactattgaagtaagagtactttataatggataccaaaatgtatatttaatatcccgtagagcctga

SEQ ID NO: 532431 - DNA, 3340 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3264)..(3264): n is a, c, g, or t
  misc_feature (3272)..(3272): n is a, c, g, or t
  misc_feature (3276)..(3276): n is a, c, g, or t
  misc_feature (3279)..(3280): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532432 - DNA, 637 bp, Homo sapiens
atgaatgccatctctgtgctggcagtgccttctttccatgtccatttccatgtgagttcaatcctgccctgtcaccacagatgatcacccccatgtgccccggtgtctaggcccttgatcccccaccgtccaccatccatggttgcttgaccaccatcaccagtaggtgagataccatactaaaggtggtgagacgactatttgaccctgagacagtgcttacttagcaggagacattgaattgcattactaacaaaactgctatgacataacaccatgaatcggacgcaccttgaatgtcccctgtgcattgcgcaacctgtatgacacattacgcgatgtggccaatgtgacataaatgagactgtcgacactgacacaccgttgcggacggtaggaagcatatggcacggctgatcgcgacatatagacagagcaatggaatcatctataccccataccactgtgattagtccctaccaagttgaagacattcacaatcagcttatacactctatagcctagtgccgcacaccgggtataaatcattacacaagtgtgtgcccatttgggttatgcaatcgacacgcgttaccatccccgctcttggcccgcacatctggaaacccctcatttg

SEQ ID NO: 532433 - DNA, 3026 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccacaggaacctacaacttcccacagcagccaaggctcaacagaggcaacactgtcccctggcagtaccacagcctcatcccttggtcaacaatctacaaccttccacagcagcccaggcgacaccgcgagacgggttttccgagacgagacgattagatcctcagagcgtcctggaggaatgctagaacgactacaggtagacattgggtcgatacacaaaacactgacgcccttccagttccacatggcatatgccatatcaaggaagtatgtagtactttgcagatgcgcgagaggtttcacagtcacgaacctgtacctgcacggtaccaagagcagccccgtatgtgaagcatgctacaactgtacgcgcagctctgaacttgagtg

SEQ ID NO: 532434 - DNA, 129 bp, Homo sapiens
ctcgtttgtgcggacctggtaccttttttgtgaagcggcactgaggagattccggcgttcgccatggccgaggaaaagcccaaggaaggagttaagacttagacaacgatcatattaattttaggtggc

SEQ ID NO: 532435 - DNA, 3272 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3196)..(3196): n is a, c, g, or t
  misc_feature (3204)..(3204): n is a, c, g, or t
  misc_feature (3208)..(3208): n is a, c, g, or t
  misc_feature (3211)..(3212): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgtcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532436 - DNA, 150 bp, Homo sapiens
cgttcatgccggagaaccaagcggcatccctgggtaggaccaggccgcgtgcgttcggcttttcttcgaggagacgcttgatgtccgcggccggcaacgctggccttcgcatcacgtatcctgccgatctcgcgccgctgtggcatggag

SEQ ID NO: 532437 - DNA, 301 bp, Homo sapiens
  misc_feature (1)..(1): n is a, c, g, or t
  misc_feature (137)..(137): n is a, c, g, or t
  misc_feature (171)..(171): n is a, c, g, or t
  misc_feature (174)..(175): n is a, c, g, or t
  misc_feature (181)..(181): n is a, c, g, or t
  misc_feature (184)..(184): n is a, c, g, or t
  misc_feature (188)..(188): n is a, c, g, or t
  misc_feature (194)..(194): n is a, c, g, or t
  misc_feature (200)..(200): n is a, c, g, or t
  misc_feature (216)..(216): n is a, c, g, or t
  misc_feature (233)..(233): n is a, c, g, or t
  misc_feature (241)..(242): n is a, c, g, or t
  misc_feature (246)..(246): n is a, c, g, or t
  misc_feature (248)..(249): n is a, c, g, or t
  misc_feature (253)..(254): n is a, c, g, or t
  misc_feature (256)..(256): n is a, c, g, or t
  misc_feature (259)..(259): n is a, c, g, or t
  misc_feature (261)..(264): n is a, c, g, or t
  misc_feature (272)..(272): n is a, c, g, or t
  misc_feature (274)..(274): n is a, c, g, or t
  misc_feature (279)..(279): n is a, c, g, or t
  misc_feature (282)..(282): n is a, c, g, or t
  misc_feature (289)..(289): n is a, c, g, or t
  misc_feature (292)..(292): n is a, c, g, or t
ngggtaagtagacttgaaggttttttattttttaatgaagaaacaatttatcctgtgtttgataccagatgagactgtcagggtcacatactccttaagcctacacatcaattccaggtgaagtgcttcaggctttnctcattctgacacttttataagggccctctatgncanngttggnaanactntttttnccttancgccgtgcatgtttgngcattatataaatcgtngtacattnntttntnntttnntnttntnnnnttttattntnttttncanctttttnttntatttttat

SEQ ID NO: 532438 - DNA, 2632 bp, Homo sapiens
  misc_feature (36)..(36): n is a, c, g, or t
  misc_feature (135)..(135): n is a, c, g, or t
  misc_feature (2556)..(2556): n is a, c, g, or t
  misc_feature (2564)..(2564): n is a, c, g, or t
  misc_feature (2568)..(2568): n is a, c, g, or t
  misc_feature (2571)..(2572): n is a, c, g, or t
cggtgcatgatgtgatctggatctgagctggtctcnggtctggcgtcgttactaagtgacacaggctcaacagtaaacaccagtatggaggtaatacaacttctgcatccacacccagttcaagcgaccttttancacctttagtgactatggggtgtcagtcacatttatcacgggctcaactgcaacaaaacacttccttgacagctccacaaactcaggccacagtgaggaatcaacagtatcccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccgaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532439 - DNA, 592 bp, Homo sapiens
agcggaaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccacgctcaccttcctaagtcccctgtgggcctgacatgacctccgtggtcattcccatctcctcccatattcccacgtgggaatctccccatgcgcctacgtctcccagcagacccgtgggacttatgatcacactggaggccctcatgcttcctcagagatgccagccccaaccccgaggaatccgactgaaaaatttggttaccattcctgggacacctgggattccaggctggagaagcagcccctgggggccagagcaagttcttggcttcaccagcaaggatttacaaggacaagctgagtccacaggaaagacatcccgtgtatgcgcccaaggaagctgaacgaccaggattccagctcagacgttggagcctttggcttgaagacttaatgggacaattaacaacgcccaaatttattaccaaaacctacagaaac

SEQ ID NO: 532440 - DNA, 470 bp, Homo sapiens
  misc_feature (423)..(423): n is a, c, g, or t
ttttaaaaatcaacaagagatctgaattaacagttctccaaagaagatacacaaaaggccaatgagcacatgaaaaggttctcaacatcactagccatcaggggaaagcaaatgagattcttcaattaagatatcacttaacagctcgctggtaataggatatataatcaaaggtgataattatcaaggtgttgggtgaggaatgcagagaaaattgtgaacacctcagtgcacgtgttgagtggcataccctacagtgaatataaaagacaaaatgtcatacacaaataaactgtgtgcagcagaatgtgtctttagcagacatatatttgatagatagcctcaaagatgtgaaacaggccgctagatttcctatcaacataaacaagtgcccatcccccgaaaagcgtcggcactatgctncatacaggaggagaatagttagttccacgcaccacaaataataagaa

SEQ ID NO: 532441 - DNA, 2564 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagccaggggacagatgtctgtgtcatttgaacctggctgctgtgggaagttgttgattcctgactggaaacctgatgcgggtgtgct

SEQ ID NO: 532442 - DNA, 3272 bp, Homo sapiens; identical to SEQ ID NO: 532435
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (3196)..(3196): n is a, c, g, or t
  misc_feature (3204)..(3204): n is a, c, g, or t
  misc_feature (3208)..(3208): n is a, c, g, or t
  misc_feature (3211)..(3212): n is a, c, g, or t

SEQ ID NO: 532443 - DNA, 977 bp, Homo sapiens
ttcaatatctagaatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttcttgttcctgctttctctttcagtattaaactctcctttgatattattgtggcttttatttcagtgccatacatgttattgttttcaacctagaaacctttatccctgcttatctgaaacttcccaacttccctgttctttaagacttttttttttttttttttttggaaaaagagtctcgcttctgtcggcccaggttggagggcaggggcacgatctcagctcactgaaagctccaactccggggttaacggccattctcctgcctcagccttccaagtaggtggggactacagggtgcccgccaccggtgccccggcgttaatttttagggtattttaagtacaagaaaggggttctcaccatgtaacgccggggatgggtctggatctcttgacctcatgatccacccacctcagctcccaaagtggtggggatacagggcgtagagccattgcgcccggggcaagacctttttttaaacaaacaaaaaaaaacaaagctccactgtcttttactttcgcccaaggtgtggttctcaacattacacagaagacagtggggtcaacaatatcacggagaggacagcagacgagggacaagagagggactcccacaatgtttccaagagggctctcaactgtagcgcacaacaatttccggcctagctcaaacgtggttcaaggtgaccaaccaccgtgcgagttggtgttaaattaattgtaccccgtgtagacctttgtcttatccctattaatgaaccccttcgttaagaggtcgtccaaccatagggttgatacccagggcacaaaaggctg

SEQ ID NO: 532444 - DNA, 145 bp, Homo sapiens
ctgatgcactaaatgctgagctcgtaccaaggcatagttgcatccagcgaaaatatgattcaacccacatgcaattttagattttctagtagccataaagttagaaaaaacagatgaaattaattttaataatttaacccagata

SEQ ID NO: 532445 - DNA, 2785 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (2709)..(2709): n is a, c, g, or t
  misc_feature (2717)..(2717): n is a, c, g, or t
  misc_feature (2721)..(2721): n is a, c, g, or t
  misc_feature (2724)..(2725): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaacaacagtcttacctgccggctctacaccctcagttcttgttggagactcgacgccctcacccatcagttcaggctcaatggaaaccacagcgttacccggcagtaccacaacaccaggcctcagtgagaaatctaccactttctacagtagccccagatcaccagaaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532446 - DNA, 703 bp, Homo sapiens
atattatactagcatttaccatctcacttctaggaatactagtatatcgctcacacctcatgtcctccctactatgcctagaaggaataatactatcgctgttcattatagctactctcataaccctcgaacacccagctccctcttagccaatatggtgcctattgccatactagtctttgcgcgcctgcgaagcagcggtgggcctagccctagtagtctcaatcgtccaacacatatgggcctagacgtacgtacataaccgtaaagccgtactccaatgcgtaagagctaatcgtcccaagcaatgtatattagctaccactgacatgacgttgtccaaaaaacacataatttgaatcaacgacgaagcacccgacagcgcgtaagttattagcatcatccctctactattgttttaaccaagatcaacaggacaagcctatttagctgttccccaagcgctttgtcgctccgatccctctaacaagcctccttgcctaatacgtaagcattggtcctgactcctgtccctcacaatcagtggcaagccaagcgccacgttatccagtgaaccacgtatcactgaaaaaaatctatctctctgatggctgaatctcgcctagcaacatctccttaattataacattcagagcacaggaactaatcatattgatatcgtcttcgagaccacattattccg

SEQ ID NO: 532447 - DNA, 2538 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (2462)..(2462): n is a, c, g, or t
  misc_feature (2470)..(2470): n is a, c, g, or t
  misc_feature (2474)..(2474): n is a, c, g, or t
  misc_feature (2477)..(2478): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacctcctagcaccgcaacagcccctgttgaagaatctacaacctaccaccgcagcccaggctcgactccaacaacacacttccctgccagctccacaacttcgggccacagtgagaaatcaacaatattccacagcagcccagatgcaagtggaacaacaccctcatctgcccactccacaacctcaggtcgtggagaatctacaacctcacgcatcagtccaggctcaactgaaataacaacgttacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532448 - DNA, 231 bp, Homo sapiens
gttccacagaacagtaatattttgtgacaataggtacaatagaggtcttctgtcatttacctcgtaaggcaggctggaggggaaataatcattaagcctttgagtacggcagatatatggctgtaggtccattttcatggtcattcttatgtcaatactgcacactgagatgaagggaaataatgaatttactttcgtgcatgtcatgactaactgtggagagtatcaagc

SEQ ID NO: 532449 - DNA, 480 bp, Homo sapiens
  misc_feature (27)..(27): n is a, c, g, or t
  misc_feature (126)..(126): n is a, c, g, or t
  misc_feature (128)..(128): n is a, c, g, or t
  misc_feature (132)..(133): n is a, c, g, or t
  misc_feature (138)..(138): n is a, c, g, or t
cctaaactttataataggaaaaggggnaattgtgagttataatggttttaccaaaggttactggccaagtttcattatctctgcaagggaaataaaaagggggacgcccctctggttgtttttttntntttnnttttnttaaacaaagtcttcctctgctgcccaggctggagagcaagactttgtttaaaaaaaaaaaaaaaattgtctagtttccctcacagacttaatgctgtgacaaaagaacaattcatacagaggggctaacaagccaaaccagcagccttcagtgggagggaacttggaaagttggaatgttcaaggaaaatgacaaaatacaagtttacaaaaattgttttttcaaaaaatgctcaaatggccaggcacagtggctcatgcctgtattcccaacacttgggaggctgaggtgggtggatcacttgagtctaggagttcgagaccagcctgggtgacgtggca

SEQ ID NO: 532450 - DNA, 2214 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagccctggacttcagggagaatctaccgccttccagacccacccagcctcaactcacacgacgccttcacccgcaatgtgctattgaaacttctaaaactagg

SEQ ID NO: 532451 - DNA, 1197 bp, Homo sapiens
  misc_feature (49)..(49): n is a, c, g, or t
  misc_feature (55)..(55): n is a, c, g, or t
gctctaacgtcgtggtgccgccttcccttcttgtacccaaggttataanggactngtctttctcttaggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccacccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaaaatgccattcccacttgccccagagaagctactcggcaaactagccagggtctgttcttgtggaccagagccagcctagtcattatttgctgtcgggtttccagtttcaccggtgtagggtgagggatgatgtcaaatttagctcctcaaaggaatcaggcctagtactcaattttaggaggggcaagacagggaggaggccgcttcatcccagactctcttctagggcttcccaccatcagcccctcccacttgagactggtcttctgggaggcaatcaggccaccatgcctggtcagcaccgaattcaagccatgccgaggaatctgcctagcctgccaggttcagttcttttgaggtcgcctcttcagggacacgagtgtgtctctctgattgggcttctagctcaaacagcctgatgttcgtgtccctgctcatagggggagctttggacgcaggaccagtctggccgagggtcggtacgggtcccacgtctgcacattgtggaggggacactctgtatgccatgggtcccttactaaagaggttgagtgaatttgc

SEQ ID NO: 532452 - DNA, 288 bp, Homo sapiens
ttgtgcagctaggcttattatgtggggcagaaaggttgttgacaactgccagtcagggagaaggtgttctgtctgctgctagagaaaaatctgaagttcagaatctacttccatgacactataactgaggaagagaaagagagaatatattgtattcttggacaggctgtgtgtcggccggctggggatacaggatgaagatataacacttcagataactgagaggtgaagacaacgaagaagatacatggttgatgtaatcctaggcgtcagttgaaatcaagctgc

SEQ ID NO: 532453 - DNA, 1258 bp, Homo sapiens
gacggagttaagtgtttattgagtatctattataaatgaagcagacttatgcttccagatgagatggagtaacaaggatgaggtttatgctactgcctgaaacaaccaaatatttgggcaaaaatatataaaattacggttttcaagacactggatttcagacaacgaaggataaggacagtgatccctgagatgggaacaagtgaggcacgtcccacaccgccccaggctcctgccttgatagatttttaggttgtagtataggcagaaagaacccaggtgggacccaggattcaaactggattagaatttgcaaggcagagttccacaggggagacagctgcacacagagaagaactacagtgatttatttgtagaggtcactcaactattcagcagagtacagatcagcatatttgtgtgagaaaactaccagaggttgggaaaagaaccacctgaaaggattagtgagaacccagtacttgttcggtgctgtgaacagtggctgttcccaccaaccagatgggacagattcataatccataggggcactggcttcctaatcagaaatggctcaggcgtggagaataattagctctggtttaaaataactgttcctgcctaaacttttgaaaaggcggaactgacagatcaaactatttccaggtacttaattgattcccaacaaatttcaagacctgaattgcgaattggcctaacaaagaaaatcacatggcagacatcaatcaaaatttccggaccgcaagaaaccagacaaggtttttatgggaagaaaaccttcaatggcctaacctgaatgcccaattgttaaatggcatcaaggccgtaatccgtttgttccaaaggttctctgcctcaaaatttttaaaggcccatctacccttggttgctaccaattttcccccagattttaatcttaaacatggtcctctattaaatagccgcaagtttctctacaatctacatatattatcaacagttatttacttactctctctgcacttcctagttccagacataatttctgcgtctcttatcatcatccatttaactcactccccttcggtcctcaccatgcggcttcgtctaatattcgtcgatcctcttactccctcctctatcacattctcacttcactcctccttcggccattcatcttctctaccttcatactctcggtggtacctgtctagctagctccaccctagtcccctcttctgactcacctctcgctccc

SEQ ID NO: 532454 - DNA, 397 bp, Homo sapiens
  misc_feature (12)..(12): n is a, c, g, or t
  misc_feature (19)..(19): n is a, c, g, or t
  misc_feature (25)..(25): n is a, c, g, or t
  misc_feature (189)..(189): n is a, c, g, or t
  misc_feature (304)..(304): n is a, c, g, or t
  misc_feature (318)..(318): n is a, c, g, or t
ttggcctcagangcatgtnatcttnttctcccttttgccctttgaagcatgtgatctttgtgacctactccctgttcatacaccccctccccttttgaaatccttaataaaaacttgctggttttgtggctcggggcctcacggtcctgctgatatgtgacatcacccccggaggcccagctgtaaatncctctctttgtactctttctctttatttctcagaccagccgacacttagggaaaatagaacctacgctgaaattttggggggcaggttcttcttgctaggtatgtaatttttttncatttacttaattnccattcttttaatgtaatttttcaccacaatccagactctcagtaatccctttccctggttttgttttaaagatttact

SEQ ID NO: 532455 - DNA, 353 bp, Homo sapiens
ctcacatgcgcatgatactgggtcgtgtgtgaagacggcccatctttcttgccagagattgaggcactgtgggagcaagggagatcctggagttcagacaggtgttgggggcagcctgtattttaccctaggggcaggtctgcatgagtgaccccgacagttgcacgtggtaaacacatttgcagtcccacatcatcatcctaggaagatgggaactaggagtcccacccacacgtgcattcagacacgcatgctgtgtagggggctgcttctcaggaggccaggcccttctgagcggaaccgtcctggagagagcctgccctcgtttccaggctgcagccttcagataaaat

SEQ ID NO: 532456 - DNA, 349 bp, Homo sapiens
taacacacagaaggaaacaggcctggctgggcgcggtggctcacgcctgtaatcccagcactttgggaggccgaggccggtggatcacctgaggtcaggagatcgagaccagcctggccaacgtggtgaaaccccgtctctactaaaaatacaaaaaatgatccaggcatggtggcacatgcctgtcgttccagctactagggaggctgaggcaggagagtcacttgaacaagactgaaattccgtcttgattttttttttttttgcactctgttacccaggctgcagcgtggtgagctgagatcacaccactgcactccagcctgggtgacagagcgagactctgtcc

SEQ ID NO: 532457 - DNA, 260 bp, Homo sapiens
cacccgggagggaaaatttttttaaaacaaccaaaaagtggcacatgtccggcagtgggagatttgctgtatataagtgccctgctttgtattttggaatctctgcatcactcattgaagtgctctgaagagaagctgctctgtgttcattgactggtttgtgtcctgttgaaacttgctgaatgtaaggcaggctactatgcgttataatctaatcacaatttgtcaatatggtcttggcaatcatctgtgcattactc

SEQ ID NO: 532458 - DNA, 234 bp, Homo sapiens
cttacaggatctaatgctgctccctcttcactccaggccgtaattccttgatggcacttatttcctaccaccaacaggaactacacatgctctctgcttttaaactgtgtacacttccttgcctagtacattccttgctagggaaagcctttcctgacccccagaccaggtcaaactctacatgatcttcttggacacaattgcagtttgtattgttacatactctaaaatcca

SEQ ID NO: 532459 - DNA, 394 bp, Homo sapiens
tactactactaaattcgcggccgcgtcgacggatggctgtaagagcggaaccataagcggccgttaccgaagaaaacggatatgtacacaggaatcacagtaatccccccgcgaagccaagcaatccccccaatcccaactaagctcaccccccaacaaaaacaacaccgagcgccccccaatgacccaccccaccgaggccttccgcgccgcctaccgcacaagcatcaccccccactacaacccatggctccacgccggtttcgtcctcggctacggcctgctctgcatcaccctgttctggtcaaccacccaacaaatccaccccctggaatggctgaccatccccttcaccctgatcttcttcaacctgtgcgtcgacgcggccgcgaat

SEQ ID NO: 532460 - DNA, 1066 bp, Homo sapiens
  misc_feature (624)..(624): n is a, c, g, or t
ctcgcccagaacgctgaatattattcgaccgggattggaagaggaaacggaagaactggcggagcccggggagccgagccgaccaaatcagactacctgaaggagggaggtgggaagtcggatcggataccgagtatattacatactccagaagataatcccccttggcttgggatctcggattgtgggactgagcgtttagcatagtcacaacttactcctgaaatacatgcgaacaccttattgagacacagtttattgtccagatgcctgcatcgagttgcaggcaatagaactcgtcctgtgagagagagagatgtgccctcgagtaacactagcaagaatacgcataccgtggtggcaggcgattatgtagcctcgtagtgaaggaagtgcacttcgcctttcataacgaaatatagcattgtgatcctcgggtgggtttacggcatgcttccaatgctctatgcgagtccggcgtagagaatggacccttacccataaaagtcacctatgcatgtcacgcatttcactagaatagtctctatacatacacgcaggaatcgggacgttgttttcaatcggaggtagccataaccgtatggcacggcgtacacacctctnatgaagctaacggctgattccgtgtacaggttacgacgggaaaaccgggaactaggggaccgggcacggcatttgtcgtccagcaagatatgcatcctggggcattaggttgtgcaagtgactctggggacagtctgacttggagacgagtgtggaggtgaaaatagctctgatgtgtgcgacgactgaatgagagatgcaaggttgaacgtatcctgggaatgttttgaacttcgggtggtcagattactaccactgaacgaaaaagtactagaactgtttgacctgaatttagaagaacaagcttgcctttaagggagatcgaatgcgtgagaaatgttccaaggttgcagaagggggtaaaggatggggggggagaaccgtgcgggagataaaaaaccctgtgtcggacaccggggggggcccggggaggaaatccaga

SEQ ID NO: 532461 - DNA, 791 bp, Homo sapiens
gtcggtgggcccccaaattggcttgcccccccctcccccagccctgcgggccctgcctaccgtgtttcacacccagctggcccatggcagtcccactggcctgcatcgagtgtgatatcaccaacgtcaaggagctgtatggcaagatctgccgaagtgcctatcccgccatgcacaactgcctgatgtgtgatgttctagcaccctgaacacccacaaatgtggacgatggacaagctcctggtgtggggccagagtcggtgcttggagtgacttcatcttcgcccactgtgaattgggcatgctccaacggcagagctgcgagttgttgttcaaagtgtcgcgagcgatcgcactctgcggctcaccattcacttgacacactgggtacattgtcttacgccttcatcacagcgcactcacaggcgacgtggccagcgttgactcgaccaccagtccaccttcattcagctgttggtagccgggcaattgactctggaggagcccagctcaagcttggcgcaatgatgccccttggcatttgggcttagccctgtgcaccttagcagttggtttggcccctgggctatggcttcaaagcgaagtcctgctccccatcagcgcccggtaacccttttcaccgccagaaatccttctacgggagagccatcgccacatgtgcacattcgacagactgactcaacaccagacgtccttcagctaggatttggcctccccctggctcttggcccacgcgcttggccattggccgaggagacccttcggctcca

SEQ ID NO: 532462 - DNA, 878 bp, Homo sapiens
gcgccggcaagacagcacagacagattgacctatggggtgtcgcgagtgtgagagggaagcgccgcgggctgtatttctagacctgcccttcgcctggttcgtggcgcctttgtgaccccgggccctgccgcctgcaggtcggaaatttgcgctgtgctcctgtgctacggcctgtggctggaatgccttgtctgctgcccaactggctggcaagatgaagctctccctggtggcccgcgatgctggttgtgctcaagcgcggcgcgggccgaggaggaggacaacgaaggagcgacgttggagcacgggtggctccgggcattcgaccccgggggggaccccactataccttcagtggcggtcggcgatgtcccaagaacggggccgggtggggagaatcatccgccaaacggattcaagggacaagcacggaatcaaagcgcccgtcccttatggtgcgcctatccacctccgtgaagggggaacacggtcctgattggggcagaggcccgcccaaagaacaccaggttcaccattccaagacccggaggaacaagggtccttgtggacggcccaagggggtatcatcggccgcacggtggaattggacccgttctgtgccaggcaggacatcaaggttctggccggtacacgggtgggttgaaacacgaaacactagaccatacttcccggtggatactggggggtgcgcaacccaagagaattggcccctgaagaaaatttctgccagggtcccactaaagtgaaagaaccgtgaagcttattgggaaagaggtccccatgcgttgtcagtgtcccgcctattttagtgtgcccaggccagacaccaagaggtggaatatgcgacacatgttgg

SEQ ID NO: 532463 - DNA, 239 bp, Homo sapiens
ggcctggtccgcattagtgaacggcgctagcggcattaagtgaacggaatcgggaagcataaagggagagaactttttcatgccattaaacaagactttggttttttattcacttatgagttctacagaagaagctcaaagatcaacaagactatcttgtaatatctttaatctacccaatactctgtatcatgcagtgaggtcagtctgttcaaggcgttcacttaatgccgctagcg

SEQ ID NO: 532464 - DNA, 105 bp, Homo sapiens
  misc_feature (10)..(10): n is a, c, g, or t
  misc_feature (68)..(68): n is a, c, g, or t
  misc_feature (101)..(101): n is a, c, g, or t
caagcaccanatctgggtgggggtcgtccccagaggccccgatggagcccagttgagctccgcgtttnacagacggttttccgaggagtgcttatcctccntggg

SEQ ID NO: 532465 - DNA, 155 bp, Homo sapiens
gtctgactactggtagtgtatggagtgtcagcattgctgatccttctctgatatctcctgtcatggttcccctactacaacatgctgaagtgtggcttcctggttgtggtgcatcgggccctagccacttctagatggggctgaactagctctac

SEQ ID NO: 532466 - DNA, 474 bp, Homo sapiens
taggaattcggcacgagaggacacccactgcacatgactctcagacgggcttagacgcactatgtatcggagtgtcggatatgcggagtgacagatgactgcccggcgcacacatatatatgagccgctatggcactgagcctgtaattagtgaccacggacatatactagtgaggactatatgactgtacacttctgcgctatatgtgattaactctgaaacatactgtctttaggggagaccgaagtcttacactcgctgagaaccatgacgagactgtcctaagagacacactatgagagagggcacatcgcggtatagtatctctagacatctgggaagagattatatagtatttgagggacatgagctatacgagcgctgtgagagtagctgtgatgagccaagtatagagatactatggtcacaacttagaatttaggccacagtaaccctcttccctgttgggtttg

SEQ ID NO: 532467 - DNA, 211 bp, Homo sapiens
ctccaatggttccttccaccgcagtcagaacatagacctccttctgtgaggtcaccgtgtactccaggtcactgtgtaggggggcaacactgtaggcacctttgtcatcagtaaagagtgtgatcagcggtgaacttggccccccccccactgatgacaaactcgactctttccacctcggggtgggtcttggcttctaataaacaaacag

SEQ ID NO: 532468 - DNA, 219 bp, Homo sapiens
tgttgtactccatcgtggaggttgtactccaccggtagtttgtactccaccggcaggttgtactccaccggcaggttgtactccaccgtgcaggttgtactccaccgtgcaggttgtactcctctgccctccagcagttggctggtaggtggcgatctcgcatgtccaaggccagatttcacactcattgagctcctgtggtactcaccgcagcaattc

SEQ ID NO: 532469 - DNA, 145 bp, Homo sapiens
aaccccggttttttttaaagcccccccccccccctggccccctggggggtaggtttccccttttccttttggtcccgcccaaggagggggtgctttttagggcgggggctttttttccctttaaaaaaccccctgccccgtggga

SEQ ID NO: 532470 - DNA, 266 bp, Homo sapiens
gactgcatctgtgcctcacgcctcctaaatagtagagctgtgttttcagtcttttttgacgcgtttgcaactccaggtttgacatggtaagtttagattcattctgacatttacagattttacatcctacttcataagatgcccatagccttaatccattacagccgctgcctcatccatctctgcttatagccttgatctattacagtagccacctcgtccatctctgctcatagcctaaactaatagaagccagagggaagaaa

SEQ ID NO: 532471 - DNA, 208 bp, Homo sapiens
atacactctaatgcaaaacactgtctctctaatttctataggtaacctgccatctgcattcaaatttagctcacttactgatgagtttcttttggccatgacgaggtcttgtgtctcctgtggtttggaaccttgggagtcgggggtgggaaagagtctgctgacatttgtgaactgtgcctatgtcaagtgggcacacattatggag

SEQ ID NO: 532472 - DNA, 127 bp, Homo sapiens
gatgaagcgctcgagatctactatccagaggcacaacctcagagtttatctagaactcatcacttgtggagagcttaccaagtcaaggaactctgtattgaacagctgcagtttccctacttcccta

SEQ ID NO: 532473 - DNA, 737 bp, Homo sapiens
actacagatcttgctgaaagagaccagttggtactaattatgagcatttattcaaacaaaagtttttgaaatattacaactggggatttaaaaaatgcagcttagaatctgatggttgttttcttctgtgatgttgtatggtaggtataggagaatcgagttttggctctggattgtccaggctggaatgcaatggccacaatctcggctcactgcaacctcgtgccttcggggttcaagcgattctccgtgccttagcctcccgagtagctgggattacaggcgccgtgccaccacgtccggctaatttttgggtatttgggagctagagaacggggttttcaccataatggtcaggcgtgtcttcaaactccgtgatctcagggtgatccacccatctcggccttccaaagtgctgggattactggcgtgagccaccggaacccgggcctttgactgttaacttatataaagcactgtaatttggtagctgatgacaaaaggcagccaaagtgttttggataaattcagtggcaactgtatttaggtctttggaaataactctgaaaactttcaggacaacatagatttcaacctgatagcacaccacacacagtgagctgtgggctttttaaattctgaagcctggtacaggtaggagttcctaagattcaagtgtttaaaataattctatctatgaaattgaaggatgaaagcagatctctgactgacatgta

SEQ ID NO: 532474 - DNA, 227 bp, Homo sapiens
cggatggcattgagtttgatggcactgcctcctcctcactctggtctccagacaggaaggtatcccagtgacacgcggggggcactgtgcggcgcaccgctggacggtcgccatggcaatctcctcatgagacaacttctgagtgcaagcatgccctgtggtgaccattgttgggcttcagaaagtgtgcctttccaggcacgatgtaggtggacactcaagagcct

SEQ ID NO: 532475 - DNA, 2239 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (2121)..(2121): n is a, c, g, or t
  misc_feature (2125)..(2125): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagcctgactncagngagaactttctccatcacagaccatcccaacctcaatcacaccacgtcatcactacccaggcccatatcctacaacttctataatagcggtaccagctcaattcgatcatgtca

SEQ ID NO: 532476 - DNA, 379 bp, Homo sapiens
  misc_feature (149)..(149): n is a, c, g, or t
tgagcaggggaagcacgctgcttgaggctcgtggacggagtcctagcagcaatcgtccaagctgacaagcccttgcgcctgcctctccagggagtgtctacaacatttgggggggtattggtaacctgtatcctgttggccggagtggnagacctgggtgggtttctcgaaaaccccacgggtgattggggtaggtgcaacgcgttagacgtccgagttcgaagggtatgacagacgggagaggtcacacaatctgttcgtattaatgtctactatgagaggctgttgaagatgatagcgtcttttcgcttgtgggagaacaaattgttgggtgtctttcctaaaatgttccaatgaaatgtgtgcgattcaagaggat

SEQ ID NO: 532477 - DNA, 2098 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcctctcatgcacacccgagagcactaatgggagaaaacaaactcagccagccccaatgcg

SEQ ID NO: 532478 - DNA, 2279 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaacttagacaataactcttttacgcactcctttttagttatccccacctgcccagttcccttattaggccgagacactttaactaaattatctgcttccctgactactcctggactacagctgcatctcattgccgcccttattcctaatccaaagcctcctttgcgtcctcctcttgtatccccccaccttaacccacaagtataagatacctctactccctccttggcgaccgatcatgcaccccttaccatctcattaaaacctaatcacccttaccccgctcaacaccaatatcccatcccacagcatgctttaaaaggattaaagcctgttatcacttgcctgctacagcatgggctccttaaac

SEQ ID NO: 532479 - DNA, 1868 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaacgccaggcctcagtgagaaatctaccactttccacagtagccccagatcaccagccacaacactctcacctgccagcacgacaagctcaggcgtcagtgaagaatccaccacctccccaaccaggttctactcactcaacagtgtcacctgccagcaccaccacgccaggcctcagtgaggaatctaccaccacctcccgtagccaaccaggttctactcactcacagtgtcatcactccaacgcaccggccagccatca

SEQ ID NO: 532480 - DNA, 118 bp, Homo sapiens
ttgctgtagtcccggtactcttgaagctgaactgagcccaggaaatcaaggctgcagtgggccgagattgagccactgcacttcagagctgggcacaacagaagtgagaacttgtctc

SEQ ID NO: 532481 - DNA, 2310 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (2234)..(2234): n is a, c, g, or t
  misc_feature (2242)..(2242): n is a, c, g, or t
  misc_feature (2246)..(2246): n is a, c, g, or t
  misc_feature (2249)..(2250): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggccccacagacacaacattgtccccagtcaggaatcaacaactttccatagtagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532482 - DNA, 712 bp, Homo sapiens
tggcacgaggggctcactgtaatccccttctcccaggttcaagcgattctcatgcctcagcctcctgagtagctgggattataagcatgtgccaccacacctggctaatttttgtattttttagtagagactgggtttcaccatgttggctgggctggtctcgaacgcctgacctccacctttcttggcctcccaaagtgctgggattaccgtcatgagccactgcacctagccttcatagagaggtttttgccatcaggccacactggcccgattccctctgtttcccagcttctcatgtttttccatatggcactttagctttctttcttgtgaggccagcggggtaagcacggacctgctctgtaagctcccccaaaaccttagagtgaggggagagcagtcatggcttcagctcttactctaattagagaggatcaaaggagaggggccggaaaaaggccaaataaaatatagcccctttaatgtagaatttgtccagtttgaagaaaaccatttctgtcacattgttttaacttgagtttgaggtcccttctatgtttccttatggttagaattagtcagctcagtactcttattaatgttgctaagcaccagatacctttggatgtcttggacccacagagagttagctctaaagcataattgaaaacttttgtctgagttttttgcagttttcagttagcaacta

SEQ ID NO: 532483 - DNA, 746 bp, Homo sapiens
aggtcaagctgggtactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttg

SEQ ID NO: 532484 - DNA, 220 bp, Homo sapiens
gccctggtttcctcctcgaggagtcgcatgtcgcctgcctattcatgtgaaatggtgggtccgtggttcctctccagcactcgatgtcgcctgactcttcatgtgaaatggtggcgtccgaggttcctctccagcattcgcatgtcgcctgactcttcatgtgaaatggtgaagtccgggggtcctctccaggactcgcattttgcctgactcttccatg

SEQ ID NO: 532485 - DNA, 1641 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacaatagtcctacctgcccgctccacaacctcagttcttcttggagaatctacgacctcacccatcagttcaggctcaatggaaacgacagcgttacccggcagtaccacaaccgcaatgtgctattgaaacttctaaaactagg

SEQ ID NO: 532486 - DNA, 798 bp, Homo sapiens
  misc_feature (798)..(798): n is a, c, g, or t
aggtcaagctgggtactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttggcagacttgctgtgattaccatgcaggtagccatattttggagctgaccagn

SEQ ID NO: 532487 - DNA, 342 bp, Homo sapiens
  misc_feature (1)..(1): n is a, c, g, or t
ngggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggataacagaaaacccaaaatcaggaggagaaggctgggtttggtggctcatgactgtaatcccagcactgtgggaggctgaggagggcagatcacctgaggtcaggagttcgagaccagcctgtgcaatatggtgaaaccccttctctaccaaaaatac

SEQ ID NO: 532488 - DNA, 533 bp, Homo sapiens
atctagaggattcggagaggcgagaagaggactggtgtgtgtgaagagatgacgatgcactcacctgagcagtcacgagagaaatcagaaacagtcgctacagaagagattgtggagtgtggaaaagcttcggattcggagaggctggcctgaagctgcagaaggacctggagtttgtgctgaaggacaagctggagccacagagtgcagagttcctggcccaggaggagcggttcgcagcagtcctgaaggaatacgagctcaagtgtcgggtacgtgcctgctctgtctgccttttagtctcatgtccaggctctgggtctccacacgcaggtggtccacagtaacgcaggagtgtctgctccagggagagcctctgtttgcgggcatgcttgaccatggtcttgccacactcctagacttagggttccctggctctcgttgccacctatcctgaaggccgcctctgtgtgtccagggaccatgcagggcattgttgtcttcctgtggtcatgtttagctttcctgggcca

SEQ ID NO: 532489 - DNA, 1422 bp, Homo sapiens
  misc_feature (1346)..(1346): n is a, c, g, or t
  misc_feature (1354)..(1354): n is a, c, g, or t
  misc_feature (1358)..(1358): n is a, c, g, or t
  misc_feature (1361)..(1362): n is a, c, g, or t
aggatctgatcagtgcattgtgatcacgtgcattgtgatcacgtgcattgtgatcacgtgcattgtgatccagtgcattgtgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532490 - DNA, 1928 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (1852)..(1852): n is a, c, g, or t
  misc_feature (1860)..(1860): n is a, c, g, or t
  misc_feature (1864)..(1864): n is a, c, g, or t
  misc_feature (1867)..(1868): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgtgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532491 - DNA, 1578 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccacttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgggctcaactgcaacaacacacttccctgacagctccacaacctcaggccgtagtgaggaatcaacagcatcccacagcagccaagacgcaacgggaacatacaaatggaatcacacccttacctgcccattttactacctcaggccgcattgctactaccacccccggtacatgcaag

SEQ ID NO: 532492 - DNA, 144 bp, Homo sapiens
agaggacccttcagacagcggacccctccccgcatagagctacagtgcttcattcaggacgtcttgcttccctcacatgctgtggtgctttcctaccagagtagagttcgcaaactccaagactgaagtacacaaagagggggt

SEQ ID NO: 532493 - DNA, 1373 bp, Homo sapiens
  misc_feature (1297)..(1297): n is a, c, g, or t
  misc_feature (1305)..(1305): n is a, c, g, or t
  misc_feature (1309)..(1309): n is a, c, g, or t
  misc_feature (1312)..(1313): n is a, c, g, or t
aggtgctctagaggatgctatcacgtgcatgtgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532494 - DNA, 266 bp, Homo sapiens
  misc_feature (33)..(33): n is a, c, g, or t
  misc_feature (35)..(35): n is a, c, g, or t
  misc_feature (61)..(61): n is a, c, g, or t
  misc_feature (82)..(82): n is a, c, g, or t
  misc_feature (142)..(142): n is a, c, g, or t
cccagcattttgggaacccaaggtggggggatncncttgaccccaggagttccgagaccancctgggacaacatgagtgagnccacatctcctacaaaaaatttcaaaaatgcacccaggccatggtggtgccacacctgtnagtctctgctattcaggcaggctgagggcgggattcattgtttgagccccaggagaacagattgcagtgagctatgatggcaccactgcatggcagcctgggtgacaaagggagactcagtctc

SEQ ID NO: 532495 - DNA, 273 bp, Homo sapiens
  misc_feature (36)..(37): n is a, c, g, or t
tacctttcatatgctctggctactctataatgcatnngaaggtagcaaaacaattccaaggggctacttattacctaaagaataggtagtgaaatttagccattgtcttttaggtaggaagttcctgtttttagaccttgaggccatccctcttaaactatcctcctagattataaatcctttagagcagagatgccatcctattttgtttggcacatatcactctagagcctttgtactatacaaagtcctttaaaaggactttatatattt

SEQ ID NO: 532496 - DNA, 199 bp, Homo sapiens
tgctggtcgtgggtgtatggtgatggcacagcacgaaaggcaaaccagagctcagcaaaacaggtcatcagccagtggtcattcgacaacgaatgtcataccgtagaaaagatggcgtgtttctttattttgaagctactgcaggagtcatagtgaacaataaaggcgagctgcaaggttctgccattccaggacccgt

SEQ ID NO: 532497 - DNA, 284 bp, Homo sapiens
caccaacatgcccagcaactccagcacagcagcaatacgggtggggaaggggcaagagcaagacaagttatatcattaaggaaacactaactactatcttatacctaatcttcaatacacacaatttaaacaactaccagctgctgttacaccactttacacaattcctatgtactggagcaataacaagatctcaataccattatatgtttaaacattgcaacacggtctctcatgagagaccgtgccacacatagcaacacggtctctcagggtaccgagct

SEQ ID NO: 532498 - DNA, 189 bp, Homo sapiens
gatcacttgagcccaggagttcaaggctgcagagagccatgatcttgtcactatatttcagcctaggcaacagagcgaaaactggtcttaaaaaacaaaacaaaacaaaactttttttaaaggtttattgctgtgttgtttttcagcaaaaccaaacgctagtcaggctgacgtagcatttgacacgta

SEQ ID NO: 532499 - DNA, 198 bp, Homo sapiens
cagtgattacgttgtttcggtacttcgcccgccgagcgccgctcggctgcaccgcgctcgcaccgagtttcacggctcgtgctaagctagcagccgtcgtcgtctccctacagtcgcgatcgtgattatctaccgggacctcatcagccacgatgagatgtactcctacatctagaagatccgggatatcgcggacgg

SEQ ID NO: 532500 - DNA, 189 bp, Homo sapiens
ctgtcaagaactttctactgctgagcttggcaaggtcaagcctgtgttgcagtgcgggcaagctggcccagcctggagctggcgctgtgcagcactcaccccgtggcagtgtgcggccctcagttgtcagtggccccatcctcactgcttgttgtcatatgctccagtcttgtgttttgtactatatca

SEQ ID NO: 532501 - DNA, 152 bp, Homo sapiens
gcgcattgcagcgcttcacggcaatgatgtaacaaaggtattcacaaaggtgacgaattatcaaatttgcggaggcaccagagagttgcggataacaaaagattagatggtattcaatctcagctgattgatgccagtcagagggcgaccca

SEQ ID NO: 532502 - DNA, 710 bp, Homo sapiens
tggccaaatcataagtgcgaaaagaagatacgcccaacggggtagatagtagtcaaggggcatcgtctccgatccagaggaaagagatcaggaggcagaaggcgaggccacagtcagcgaggccctgcaggcccctccgaaccgtcaccacggtggccgtggaggagacaataccactcattcaacggggaggagcccaaaccacatgacccacagactcggcaccccgacgccagagatacctggagcgacggcagcatcaaagaggctagtccacctggcgaaaccacgcggagcccggaaggcttgcggggctccgacctgggctggcttccgtcctcatgccagtggagggacgagataggggcccctagctggggtagagctgagggacgccacgtgccattcccatgggccagtgagggcccggggctctgttctgctgtggctgagctccccagagtcatgaggaggagcgccagttgcccctaggctcactagaccacacacacagccctcctgggccagcccatgagggcccattctagaccgccagctgtctgcgcgtctgactctttgtggtgcctcagcaggacaaggccaccgggcactgcctcacagccaaggctggatctgggttggctccagtgtggtgtttagtgatccacatcaggaagtgattttctaaactggattgattcggctctacc

SEQ ID NO: 532503 - DNA, 342 bp, Homo sapiens
ggccagtgtgcccagcgcgctccacgccctctctataagtacatccgaagagcagagatcgtcgaataccgcccttaagtgatgttgccatgtatcttgacaccgtgccaaagcttccatcacgggaaaatgagaaacactgggtaccaagtgataactcagaggtttctcggttgtgggatacctctctgtatatcagaatgtcgttggcttccgaaatcttaaactacgctcattttacgcactttgtagcttctgcttttatgcttcctctgtcgtcttcactgcacgatgtctttctgttgctctttgttgcggctgtggatcgtggggatcctctag

SEQ ID NO: 532504 - DNA, 167 bp, Homo sapiens
  misc_feature (22)..(22): n is a, c, g, or t
gagccaaacaccggtagaggcnggggaggtgggtactacacaaccgtctccagccttggtctgacgtggactgtcctgcagcgaccatgccccgtaaaggcacccagcctccactgcccggccgcagagaggaagggccgccgcgccgtcccctgacgactagcagc

SEQ ID NO: 532505 - DNA, 825 bp, Homo sapiens
atagtgtctctagtgccgcccctttcagaggttggacgctggctgtggtgtttcgcatagtaggcctgtgggaccccgttgtgttccccacgatgtggtttatcataaaattccctcccgatggaattgtgtctgcgagactgtctcctatggttgtttctcctctcgagtgtttgccgcaatcgcggtctgtcgtatggctcgtaataggggccgctcgtggcggtagttagttctccgttgtccctccgtgtgttcacgagatagccgctgtaccctactgggtgtgttgtcccgcggcgactgtcgctcgggtgtttgggactttattgtgcaagcctcgtcctatggagcttgttgtgggccacgtttttgaatgtgctcccgggcgagtctccctcacttattgtttgcacaccccgcgctgtttgtctgtgcccatgacatgcctcgtgagtcactctcgtccttgtggctggacaggactgaacattctgtgtccctacgacaagtgtggctggtggggtggttgactttggtgagtatgtcgctctcagctccgccgtcacctgattgtgtgaggacactagtgcgctcgtgactcttgctgcctcactgttatcgagcgtgttgtccgtcctgttctgtccgagatactcgccccagatagtagtggtcgcccaccattggtggtaaggatcttctatggatgaggaacacatctgcgggggaaactcctttctggactactggttctctgtggtggaacaatatgtggtgttcaagaaatcggcgtctcatgcctccggcgcccacatatacaag

SEQ ID NO: 532506 - DNA, 679 bp, Homo sapiens
tggccggggttaggtgattttgcaatcgtgttccaccgcacccggccttcattcactttctttagaggcctccaaggtgattattctcctagctcatatctccttgatgtgcatgagggagcactgggtctaatttttgggggctgagaaggctagaaggtgaggtcagcttttcccaggagtcctaaaaaattctggttccttacattgcgggtgtggtagaaagggtgtcatagttctgaaaataggcagttgcctgaagcaccagacctgtctcattccttattagatgtctatctcaaataacagactttgaaaaatattgtgtttatcatcttgacttttccatgcctgtctcgggaaaataactttttctcgacctcttttactctattgccctgcacagactctacctggttcaatttcctatctctcagctcatagtgtctattccccgtgttgcctggtttgtcatctgccctcacttttctggaattgaaatatattgccagtctggggaccgtggatgataccaacctggattcctccattccttctggcagacaggctcctcttgcatggccacttttatccctaccttgcttactggcttgtgtcgcgttcattatgttatgactgccgtttaccattctcgttgaaatctttcccctgtgtacaa

SEQ ID NO: 532507 - DNA, 496 bp, Homo sapiens
ggcacgaggttaaggacgtactcgtcttggtgagagcgtgagctgctgagatttgggagtctgcgctaggcccgcttggagttctgagccgatgggagagttcactcatgtttgcacccgcggtgatgcgtgcttttcgcaagaactagagtctcggctatggagtccccatgctgttgctgattgttggagggtcctttggtctttgggaggtgtctctgatccgatatgatgctgcgtagagttagatggatcctgcgcctgcaaaaattccgaaagagaatacaatatctttagggtcggtaatatcgagtcaatcaaaggcttccagtttgatgactggaagaatattccaggactcgggccttgggcagttcgtgacctccttcaaggcagtggtccagaaggccctgagatttagtccacttcactctgttgtctttaattctccctttttccttttttgaatacaaaatcctttaatgggcaaaaaaaa

SEQ ID NO: 532508 - DNA, 233 bp, Homo sapiens
ttgtatgaagagtattattatacatgcgtgctatataaagtcatctatagtcattgacaaccagaggcacactagtccaatgtataaacttaggtgccggacagtgctacagacatatagatttactaaatatgaatcagtgacccacaaagttacatttacatattattcaccagcctcaaaagtaatataactgaaaacaaactttcacaattgggtactacgctttggca

SEQ ID NO: 532509 - DNA, 1958 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (511)..(511): n is a, c, g, or t
  misc_feature (1882)..(1882): n is a, c, g, or t
  misc_feature (1890)..(1890): n is a, c, g, or t
  misc_feature (1894)..(1894): n is a, c, g, or t
  misc_feature (1897)..(1898): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaagtggaacaacaccctcatctgcccactccacaacctcaggtcgtggagaatctacaacctcacgcatcagtccaggctcaactgaaanaacacgttacccggcagtaccacaacaccaggcctcagtgagaaatctaccactttctacagtagccccagatcaccagaaccacaacactctcacctgctagtatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532510 - DNA, 215 bp, Homo sapiens
  misc_feature (163)..(163): n is a, c, g, or t
  misc_feature (186)..(186): n is a, c, g, or t
agctggtgaaaaagaagaaacaattccctccatgatatagattagaagaggtcaaggataaagatggaaagccactcctggccaagaagagtctaaggaacaggcttccacccgatgagtgaagacttccttctggtatgctttgtctgagcgacttctctgngtccacacaaatgcttcatctcnttaaatttgaagatgccaagcttgcatgc

SEQ ID NO: 532511 - DNA, 1887 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (437)..(437): n is a, c, g, or t
  misc_feature (1811)..(1811): n is a, c, g, or t
  misc_feature (1819)..(1819): n is a, c, g, or t
  misc_feature (1823)..(1823): n is a, c, g, or t
  misc_feature (1826)..(1827): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtggtagcgcagtgatctacaacctcacgcatcagtccaggctcaaatgaaataacaacgtnacctggcagtaccacaacaccaggcctcagtgaggcatctaccaccttctacagcagccccagatcaccaccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaacactctcacctgcccgctccaccacctctggcctcgttggagaatccacaccctcacgcctcagtccaagctcaaccgaaacaacaactttacccggcagtcccacaacaccaagcctcagtgagaaatcaaccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532512 - DNA, 1363 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (1287)..(1287): n is a, c, g, or t
  misc_feature (1295)..(1295): n is a, c, g, or t
  misc_feature (1299)..(1299): n is a, c, g, or t
  misc_feature (1302)..(1303): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccaccacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532513 - DNA, 135 bp, Homo sapiens
tcatcaagaaacaactttgatcaagattacggggtggacgtacgtctgtgatgatggattaacattacatattcacaagctttaccaattcatggaaaggattcctctaggattttggtggatctcttgaagcac

SEQ ID NO: 532514 - DNA, 1798 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (1722)..(1722): n is a, c, g, or t
  misc_feature (1730)..(1730): n is a, c, g, or t
  misc_feature (1734)..(1734): n is a, c, g, or t
  misc_feature (1737)..(1738): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggcccaccttctacactagccccagatcaccagatgcaacactctcacctgcaaccacaacaagctcaggcgtcagcgaagaatccagcacatcccacagtcaaccaggctcaacgcacacaacagcgttccctgacagcaccaccacctcaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532515 - DNA, 192 bp, Homo sapiens
tatcggccccatcagaaagggcatttgaaggggagaagaacatgctattgccatattccacaacatcccctgtctgtgtttatgctcaggtcatacatattgctgacaactattcttgatattcatgggaatgtgggaaatctctactggactgagtcatttaagctagaaagagctcctatgatactcttt

SEQ ID NO: 532516 - DNA, 1121 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacagcaggcctgagtgagaaatctaccaccttctacagtagccccagatcaccggacacaacactctcacctgccagcacgacaagctcaggcgtcagtgaagaatccaccacctcccacagccgaccaggctcaacgcacacaacagcattccctggcagtaccaccatgccaggcgtcagtcaggaatctacagcttcccacagcagcccaggctccacagacacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaagctcaaaggacacttcgcctgcaccttctggtaccacatcagcctttgttaaactatctacaacttatcacagcagcccgagctcaactcccaaacccactccaccttactaccagacaaccttaaaa

SEQ ID NO: 532517 - DNA, 1363 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (1287)..(1287): n is a, c, g, or t
  misc_feature (1295)..(1295): n is a, c, g, or t
  misc_feature (1299)..(1299): n is a, c, g, or t
  misc_feature (1302)..(1303): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaacaacagtcttacctgccggctctacaccctcagttcttgttggagactcgacgccctcacccatcagttcaggctcaatggaaaccacagcgttacccggcagtaccacaacaccaggcctcagtgagaaatctaccactttctacagtagccccagatcaccagaaacactctcacctgccagcacgacaagctcaggcgtcagtgaagaatccaccacctcccacagccgaccaggctcaacgcacacaacagcattccctgacagcaccaccacgccaggcctcagtcaggaacctacaacttcccacagcagccaaggctcaacagaggcaacactgtcccctggcagtaccacagcctcatcccttggtcaacaatctacaaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatccacaacctaccacagccgcccgagctcaactccaacaacacacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532518 - DNA, 300 bp, Homo sapiens
  misc_feature (64)..(64): n is a, c, g, or t
  misc_feature (83)..(83): n is a, c, g, or t
  misc_feature (87)..(87): n is a, c, g, or t
  misc_feature (102)..(102): n is a, c, g, or t
  misc_feature (116)..(116): n is a, c, g, or t
  misc_feature (123)..(123): n is a, c, g, or t
  misc_feature (153)..(153): n is a, c, g, or t
  misc_feature (171)..(171): n is a, c, g, or t
  misc_feature (176)..(176): n is a, c, g, or t
  misc_feature (182)..(182): n is a, c, g, or t
  misc_feature (184)..(184): n is a, c, g, or t
  misc_feature (189)..(189): n is a, c, g, or t
  misc_feature (195)..(195): n is a, c, g, or t
  misc_feature (203)..(203): n is a, c, g, or t
  misc_feature (213)..(213): n is a, c, g, or t
  misc_feature (218)..(218): n is a, c, g, or t
  misc_feature (221)..(221): n is a, c, g, or t
  misc_feature (227)..(227): n is a, c, g, or t
  misc_feature (229)..(229): n is a, c, g, or t
  misc_feature (231)..(231): n is a, c, g, or t
  misc_feature (237)..(237): n is a, c, g, or t
  misc_feature (240)..(240): n is a, c, g, or t
  misc_feature (260)..(260): n is a, c, g, or t
  misc_feature (263)..(263): n is a, c, g, or t
  misc_feature (267)..(268): n is a, c, g, or t
  misc_feature (272)..(272): n is a, c, g, or t
  misc_feature (276)..(276): n is a, c, g, or t
  misc_feature (280)..(280): n is a, c, g, or t
  misc_feature (282)..(283): n is a, c, g, or t
  misc_feature (285)..(285): n is a, c, g, or t
  misc_feature (296)..(296): n is a, c, g, or t
  misc_feature (300)..(300): n is a, c, g, or t
aaagtaccccataccgttgacgcgctgtggcagacctgtgggtgcggtctcccctccccaaatnccacctcttcctgctcccncccncttttggcccctacncagtagttccattntgggctncagtaatataaggacctgttctggacacancactgggccccctggggntttantagggnanccccntccctncaggagtnaggcatggtnacagnagncccctntntncccccnagncatctgagcattggtgtgcnttnaggnncttnatcntccnannanaaattccattngtgn

SEQ ID NO: 532519 - DNA, 245 bp, Homo sapiens
ttgcttggttggatggactgagggcccgggagggaagttgcctggaaactccaccatcagcatcagagcgccagatttaccgtgggatcacctccatacaggtaaacctagaagagcctccccacaaacagtctttgtgaggatgcctgactgaacttgcagctagaattcaaaaccgcttgtattcccctgtcttcgagtcttcggggctgtctgtcctgccttggagtggctccgttcgtgca

SEQ ID NO: 532520 - DNA, 142 bp, Homo sapiens
acccccagaatctgggcgctgtggtggtgccttctggagaagagcagagatacacgtgccatgtgcagcacgaggggctgccggagcccctcaccctgagatggggtggaaaaggagggagctgctctcaggctgcgtccag

SEQ ID NO: 532521 - DNA, 360 bp, Homo sapiens
tccaagagggggaaaaaatcccccgggtcccctccggcccaaggggaaggggtgaaggagggccccccccaaattttccttttcccccggaaacccccggccccccaaaaaggggacagttttttttaaaaaatttaaatggcccccccccttgccggggcggtttttcccccccgggaagttttttaaaaagaaaaaaccccggttcccccctggggaaaaaaaaatttttaaacccttccttgtttcccgttgggcccggcccccccccgggtttttgggaattggggcaaaaaaaccccagaaaccccccccccgggttttttaaaaaaaaaaaaaaaccccccctgggggttggga

SEQ ID NO: 532522 - DNA, 636 bp, Homo sapiens
  misc_feature (560)..(560): n is a, c, g, or t
  misc_feature (568)..(568): n is a, c, g, or t
  misc_feature (572)..(572): n is a, c, g, or t
  misc_feature (575)..(576): n is a, c, g, or t
aggtgctctagaggatgctatcacgtgcatgacaacactgtcccctggcagtaccacagcatcatcccttggtccagaatctactaccttccacagcggcccaggctccactgaaacaacactcttacctgacaacaccacagcctcaggcctccttgaagcatctacgcccgtccacagcagcactggatcgccacacacaacactgtcccctgccggctctacaacccgtcagggagaatctaccaccttccagagctggccaaactcgaaggacactacccctgcacctcctactaccacatcagcctttgttgagctatctacaacctcccacggcagcccgagctcaactccaacaacccaccacttttctgccagttccacaaccttgggccgtagtgaggaatcaacaacagtccacagcagcccaggtgcaactggaacagcactcttccctacccgctctgcaacctcagttcttgttggagaacctacaacgtcacccatcagttcaggctcaacggaaacaacagcgttacctggcagtaccacaacancaggcctnagtnagnnatctaccaccttctacagcagcccccccgctgctgaaatgcgggatccttagagtcaccc

SEQ ID NO: 532523 - DNA, 758 bp, Homo sapiens
gcatttatgaagaattagcaataagttcttagaaaatgaagcaaatggaaaaaaaaaaaaaaaaaaaaaaaaaaattaaaaaggcagtttgggcaaacagttaaagtgtttgggcaggtgggtaaaaggattctgggccccagggggcggggttaacgggatgaccccccgcaccttgggggttttttaaattttaaatgccagtaaaattgtccgccaggcctctaagaaactcttggggaacatacttggatatattatactctaggaggcttgatctggaggtaaaataccctccttttgtgtttcataaggggggtaaagccgaaacacaggtggtaattaacattccgggtgttttcagaagagattatataacaataactacctttggggcatggacaaactccgggtacattaaaaacaagggcaaaaaaaaaactctttggtgtgtcagataaattcccctttaaaatgtgggggacaatattatgatgcctcgttcgtttattccccttgtttgttacccccaaaaagaaaagttggggagatacaaaatagggagttgagggagttgtatgaaaccccatgatggggggcacataatttttccccccattacccaagtaaaatattccataattagggggtttactaaagcacaatcaatcactgttaaccgataatttgaatcctcatctcccatggacagaagaatattgcccgcaggagggagaatataaaccaaaaagccagga

SEQ ID NO: 532524 - DNA, 260 bp, Homo sapiens
gtcccccaactagagatgtatggtgcttcggcgtgtgaatgcacacgccgaataaccacacctcaggtgatcacaaccgcctcggactcccagcttctcttggaattttaaagctgtttgtagttatcagagctaatgctgctttagacagcttctctctgtacctcttggttaagcttcctgaagtttgtctccattacaggctttagcaaacagccagcccttcgtgtctctgagttgttgtttatgctggttaatcc

SEQ ID NO: 532525 - DNA, 1162 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (1044)..(1044): n is a, c, g, or t
  misc_feature (1048)..(1048): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaacaacagtcttacctgccggctctacaccctcagttcttgttggagactcgacgccctcacccatcagttcaggctcaatggaaaccacagcgttacccggcagtaccacaacaccaggcctcagtgagaaatctaccactttctacagtagccccagatcaccagaaacactctcacctgccagcacgacaagctcaggcgtcagtgaagaatccaccacctcccacagccgaccaggctcaacgcacacaacagcattccctgacagcaccaccacgccaggcctcagtcggcattctacaacttcccacagcagcccaggctcaacggatacaacactgttacctgccagcaccaccacctcaggccccagtcaggaatcaacaacttcccacagcagcccaggttcaactgacacagcactgtcccctggcagtaccacagccttatcctttggtcaagaatctacaaccttccacagcagcccaggctccactcacacaacactcttccctgacagcaccacaagctcaggcatcgttgaagcatctacacgcgtccacagcagcactggctcaccacgcacaacactgtcccctgccagctccacaagcctgactncagngagaactttctccatcacagaccatcccaacctcaatcacaccacgtcatcactacccaggcccatatcctacaacttctataatagcggtaccagctcaattcgatcatgtca

SEQ ID NO: 532526 - DNA, 818 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (437)..(437): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtggtagcgcagtgatctacaacctcacgcatcagtccaggctcaaatgaaataacaacgtnacctggcagtaccacaacaccaggcctcagtgaggcatctaccaccttctacagcagccccagatcaccaccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccggcattctacaacttcccacagcagcccaggctcaacggatacaacactgtacctgcctggtgtccgcctatggcacgggactcgaagggggcaccacaggtatccagtcggaattctttataaccaccacccgagatccagggctcaatggtc

SEQ ID NO: 532527 - DNA, 703 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (305)..(305): n is a, c, g, or t
  misc_feature (437)..(437): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatcnacaacctaccacagccgcccgagctcaactccaacaacacacttttctgccagttccacaaccttgggccgtggtagcgcagtgatctacaacctcacgcatcagtccaggctcaaatgaaataacaacgtnacctggcagtaccacaacaccaggcctcagtgaggcatctaccaccttctacagcagccccagatcaccaaccacaacactctcacctgccagcatgacaagcctaggcgtcggtgaagaatccaccacctcccgtagccaaccaggttctactcactcaacagtgtcacctgccagcaccaccacgccaggcctcagtgaggaatctaccaccgtccacaagccagcagcccaggagtcgacgcggccgcgaatttagtagtagt

SEQ ID NO: 532528 - DNA, 431 bp, Homo sapiens
gagcaggatgaataagaccaggaggctgaggagtatgcctgtgttcaggaagctgattgtgaggacctgagaggggcagtctgggggtggccatacctcctcacagtatctatgactgttgctgtcacagaccccaatgttccaggcattggcgttcgagcattcgtgtgccccacaggagatccgacacgctgggcatcggatggtctatacacatcgaggccaggagcgatagggctgtgctcagggagagtcaggaggggctgggccagatcgactgacgctaggtccaggtgctacaccaagatgcagttcagctcagtcccattcacatctattgtctcccagagtagatcccggatggagcccagcagaggctgggtcctacctgtctggcactggagctgcccacaaatggcatctctagagta

SEQ ID NO: 532529 - DNA, 354 bp, Homo sapiens
cagatcaagttatctctctcactagccccataagctcttctccgagtaccatgagaagcggatgctggtgtctggacggaggcccgtgatgtaaaatgcccaggtgtatcttttggtcttagctcttgcttgtgtgaaagggcagggctgaggtgttcctcccttagctgagtggggactgtagtgaggagtgctgggtgctggggtacacaggcgatgttgtgggctcaggggagggaggacagctcccgactgtggtcagtcctcatgtctggtggtttccaaaagccagttctcatacccctgcatcagaatcctctggggagcttaaaatacagatcccaggatatctgc

SEQ ID NO: 532530 - DNA, 206 bp, Homo sapiens
ggcgggaaacttttaaaaattttgtttgaacccccttaaaaccccttgggaatttttacccccctttggggggtttccgggccctttccccagggggttgtttttttggggtaagggaaaaaaaagggggggttttttttaaaaatccccctttggggggggggggggtttttaaaaaaaaaaaaaaggcccccccctttttttta

SEQ ID NO: 532531 - DNA, 336 bp, Homo sapiens
gaaaaaaattttttcccggggtgggttttaaggggtggggcggggcccggtcccccgttccccaggtttgggaaaaaaggtttttttaatttcttcccccgggtttttttttaaattaaaaaacgggggccgggggaaaaaatttggccgggggggccccccccccccggcccccttttttttaagcccccccggttttcgggggtgggggccctttttgggaacccccaaaccccattttttttgggccggggtttttttttgggggttttaaaaaggggaattttttcctttttttttgggccccaaaggggcccccgggggttgggggggcta

SEQ ID NO: 532532 - DNA, 102 bp, Homo sapiens
  misc_feature (16)..(16): n is a, c, g, or t
  misc_feature (69)..(69): n is a, c, g, or t
ggccaacccacccctncctagcaccgctcctgccccggggccggatgcgcgctggctgctgccgcgctncgggcaaaggtggaggggtgggggggcgtcact

SEQ ID NO: 532533 - DNA, 1119 bp, Homo sapiens
gctcacgcgggtacgcaatgatcgctgtgattgtgtctatgagatgtatagtcatggtctacctgtatagtatatgtgctgttaagcactctatggtgtaatgacaaacaactatgagacatttcaatacccatgaatgcgttggtcatgggcagtggtgacttgatgtgcacgcgcatagagtaggcggagtaccacaagtgatcgcgtcttgttgcttgggcagttggctcgttgagagtagctggacacgtcttgtatatctgcgttgcacgcagagcaaagtatggaagtaccgatggagacatagcgtagacacgtagcaccataatcggagaaggttgcacaaggattgttgcgagagtgacaacgttagcgagtaagagaatgcgtggttgtgtattgaacaatgtttgctccgtcatagcacaggtccaagtgcacacttgccttcaaaacacagggagctaattaacacaagagcctttggagagcgtacgtatgagcgatatgaaacagatcggttggcgacctggactccattgactttgagacattacctaatgagtattgacagacaaaacttcatattccgccagtgtagacgtaaacactatcgcacgaggtggtgctatctggcaaaaatttgagataaaagcacttcagtgataagttggtaaatttgagacaagttttgcatagcaaaattggataccgatcatacgcactttcgaaatgccaatcgcgccattttgggtacgttacagatcatatagatagaccacatggtgtgcagaactttaaaaacagcgaacaagagagatagccaatcgagcactccaatctgacacagggcactaaaagatggtgggccattgaataatagcaaaacgtcataggggccatataccacgagccgtatcagagaagcgaaaccacaccagtgatacgactgaatgacacatcaactagcacccgtaggtgttgcaggcggcgaaacgacatataccactaaataggcaaacaaggtggaaaggaccgatataacacgtataaagtgaaaacacctgtggtattgcaaattcaatagacagcactgtgcaatgagacccactccat

SEQ ID NO: 532534 - DNA, 191 bp, Homo sapiens
aaggatcctttgggtgccttcaaagcagatctggagcgtgagggattacagtgacgcattgagaagctgctcacagccattgcggttatcaaacagtcccgggttggcacatgatgagcgttgccgtgttctcatcttctactcttaaggactggcttcactgggacttgagaggggtaccgaagctcgaa

SEQ ID NO: 532535 - DNA, 624 bp, Homo sapiens
agctgtgcgtagatgctgtcgcctgtaatcccagatactcaggagactcagacaggagaatcccttgaacccaggaggcggaggttgcagtgagccgcgatcgtgccattgcacttcagtctaggcaacaagagtgaaactccgtctcaaaactttatgtgcatggaccagaggctgactctggagcccacactgttgcgttccggactgctgatgaattcaccattgtgtggcgagagtatatatgctgattgtgtgctattcctcgctgctatttgctcaatgcaccttctattttatacttaaaagaacctaaagtggtttaccaactgcacttataggcgagtgctgagtgtttggttgtacctgggcactccccgcacagaacatgtgttttctataataaaaatgaaaaaaacctgaggcggggctccgacccaaattctccttaagtggggcctattataagtaaatggacgcggaaaacaacggcttgattgtggtaaccctggctgtaccaaattaaaatgctttgggaacatacccctttcgcccgcttgcgggatttgcgggcccgacaagatgacctttccacgtgtgcacactggggggcgtggcttttgg

SEQ ID NO: 532536 - DNA, 482 bp, Homo sapiens
  misc_feature (114)..(114): n is a, c, g, or t
  misc_feature (117)..(117): n is a, c, g, or t
cagtcgtgaagagggactctattgcacatgagtttctccggcaagtaccaactgcagagccaggaaaactttgaagccttcatgaaggcaatcggtctgccggaagagctcatncanaaggggaaggatatcaagggggtgtcggaaatcgtgcaaaatggaaagcctttaaggttaaccataaccgttgggtccaaagggatccaaaccgaattcacggtggggaaggaatgtaacctgaaaacattgccagggaaaaaggtcagaacaggggttaaattggaaggggccattaaacgggggacaactttcaaaaccataaagtttggaaccgaactcaacgggaccttatatcccattcccatgacattgggggaaattgcttttaaaagattcaccagaggattttaaccaggcttgaatttaaaataatttaagggggtaaaataaaggtattaaagggaccttgtttttaaaaaaaa

SEQ ID NO: 532537 - DNA, 362 bp, Homo sapiens
gacttgagtgtgagaagtgtgatgagacttcagagatcaatagtccaactctcggccgggcgcagtggctcacgtctgtaatcccagcactttgggaggccaaggcaagtggatcacctgaggttaagagctcaagaccagcctggccaacatggcaaaaccccgtctctactaaaaatacaaaaattagctgggtgtggtggtgcgggcctgtattcccagtttctcaggaggctaaaggaggagaaccacttgaacctggtaggcagaggttgcaatgagccgagatggcgccaccacactccagcctaggcaacagcagagtaagactctgtctcaaaaaaacaaaaacctttttatac

SEQ ID NO: 532538 - DNA, 748 bp, Homo sapiens
agcggagggttggagccagcgaccgtcggtagacagcatggctctcctcaatattgtcctacccctagcttcatggcagggctgtgaagcagggctgcatgatgtggtcaccgacggaatctggggccgtcctacagatgggcatagcacgcagagcataagtgttgatcacacttgaattcctataagcatgaaaccctatcgtatatagggacgtagccagatacaggctcacagggtccctgggtattgaccggagcaggggtataataaagcaaaatggttggtgcacggacatatcacggaactggattttggattgctcgggcccatctgtgacgacttgcgacatgcgaaacacataaagaaatttgtcattattcatggattggggacactcggcaaaagccactaagagctgatgaatgtacaaactcccaggcttataaccacttaaagcgacacactttcctaacactcaaatggtggcatccgaagcagacaataaaaacccaacatatgagcatagcgtgtggatccaggcctaatactcggggaagtagctcagattagggagcgggaggaacggcggcacctccaatggatcttggtataatattcagccggggcgttgaacttctaggagcattcgaaggacaaaccgggaaaatcaccctggtaaaaaggcgcgcgaaaatcgaatctaaggaacaaaaaataaaaacaacttaaaagacgataaaccaac

SEQ ID NO: 532539 - DNA, 235 bp, Homo sapiens
ggccggtaccgatagaatccaggcgggggcaggataacaaaacctacctggggcaggcagctgattttctccagtgagatatagttatgaacagtcagcagacagcactcctggcagctggaactttgggtttggttctgtcagggaggaatgaggcattatgagctcctgcagtcctggccacggcttcacaaagagccccatagtgatgcaacatagttcagcagatatgctg

SEQ ID NO: 532540 - DNA, 92 bp, Homo sapiens
atttcatgaaacactcttgtacttatgtttataagagagcactgggtagccaagtgatcttctacttcccgagttagtaaacatctgtacta

SEQ ID NO: 532541 - DNA, 622 bp, Homo sapiens
  misc_feature (86)..(86): n is a, c, g, or t
  misc_feature (200)..(200): n is a, c, g, or t
cccagggtaagcccgacctcggacacacggaaggttccgcgccaagtcactctgcgaggaggacaacggccgggaggagcggcggncgaacctcatcagctcggagcccgtcagctgagggtgtcgacccaatcgttcatcgaagtgctcacgacgttgccagtgtggaccgtcccgaggccgttcacatatcgagaagncaacagtgccttgttgtggtcgttgagattctgctcgaagacgccgcctacgaagatcggatcggcccaccctctgcctgcttcgtgtgccaggtgagcggcgcggttgacgacgtcgcccatgtagacgacatcgttgattccgctgccgctgaatcccgccttgatcatgagcactcggccgtagtcgacgccgatgccgatcttcagggggtcgatccccttcttcgcgtagtggtggttgaggagcttgatgagtgtgttcgcctgataggcaatgccaaacacatcgtcgatgtgcgtcttctgcgtggtcttgtacacagcccagacgcagtccccaacgatattcacttcccgaacgtacagatcggagttcagcaccgccaccatctcagagatgaacgcgcgatatatcttcg

SEQ ID NO: 532542 - DNA, 265 bp, Homo sapiens
  misc_feature (197)..(197): n is a, c, g, or t
ccgggcatgcacaatggatgccctccaggagatgacggcactgctccccagcttctctgccagggcgcaggggtccttgacctcctcgtagcagtttgcttgaatttcatgcttgatccctagtcagcttcttcttagatggcgtccttggaaggtggcataacatcatttgtgctctataagggggcgcagactcngggggccccagaagataaacaccatgatcctcctatcttgctctcgcttggtctacatagtgttgcat

SEQ ID NO: 532543 - DNA, 237 bp, Homo sapiens
tccttagcgagacttctataaatatataggaatatgagacgcacagcccagaactgtacgtgatgtgacagactctgccatacgtgcgtgagctgtcttgcgaggacagctcagtctcagggctcagggaagatttccagcagaagtagtggggcataggctctaaaagattgagggtctagccaggctgcaagcaagcagactgctgtacaagcatgaagggaagagtggagcttt

SEQ ID NO: 532544 - DNA, 280 bp, Homo sapiens
tttccccgttggaccagatctccccacaccccgatgcaggtgtctcatagccataaggccaagggagtggcagaactggaccgcctcatctggattaacaagcaaactcctatgctaaggcttggagcaccgagagaatttgtgtctattggccaagaactaagccaggaagacatgggccatccctccgctttagggaagcatattttaaacctgaacgtcgaacttctgctttggcctcaccagtgaaaacttgtagtctttattacctaaagttcgc

SEQ ID NO: 532545 - DNA, 773 bp, Homo sapiens
  misc_feature (6)..(6): n is a, c, g, or t
  misc_feature (347)..(348): n is a, c, g, or t
ccttanccccctcgcccccccccaccccggggaataaagtttcatttctgttctttaaaaaaaaacggggggcttgggaaggccgacctaaaacacacgcccccccttttggcacacagggttttgggaccccatcagggccttacccgaaaaatttttggcaaagtgggggtggcgttttttaaaaggccccacaaaaaaacccatttttcacactgggcaaaggccattttggggtttcctggagacccataagagcgggggtaaaagccccccttatggtggccccaaaaaaaaatattcccccccgaccagaggaagttttttggtaaattggttttccaaannctgtcctccaaaaagaaggtggttggtttttaaaaaaaaaagtgtttgtggaaaaaaagccagagggaaaattccttttttaaattcccgttttgcccctttttttgataaaaaagggccatattcccccttttgggccccatgtatctcagtaccccatggagctgggctaagtaaataggaattggtttcacgcctgaggcaattagaccctttggaagatgggcataccctgtctcccctggacttaagggtcgggctttaattcccagggctcttttctccccccggtatccaggttccctcccaaagaagcccccagttttcatggggggcacccagtcttttttctccccagcggactaaactttttttcgggaccagttaatttttccacctactaatagaataaaggcggttttcta

SEQ ID NO: 532546 - DNA, 822 bp, Homo sapiens
aagccatctttgcattgttcctcatccgcctccttgctcgccgagccgcctccgcgcgcgctcctccgccgccgggactccggcagctttatcgccagagtccctgaactctcgctttctttttaatcccctgcatcggatcaccggcgtgccccaccattgtcagacgcagccgtagacaccagctccgaaatcaccaccaaaggacttaaaggagaagaacggaccgtcgtggaacgaggcagaaaaatggaaggagaccgcccctgctaacgggaatgctaatgaggacaatggggacgcaggagtgctgaccaatgaggtagacgaagaaagaggaacaacggttggggccgcaacgaggaggaggaagaaggcacggtgctggctgacggaaagaggatgcacgcatcacagatgaggaagctgagtcagctaccggggcaagcggggcagctgaagatgactgaggatcaccgattgtcgcataccaagaaggcagaagaccgacgaggatgactagacagcaaaacacggaaatgtcaacctacaaaaaaaaaaaggcccggcgtgtacctaattttcacccttcaatttcccggtctcagaactcttagcggtggtccccctccgagtatagaagacgcccgcccgcccaccgtgtgttagttgccccccggaaaatacacggcggctttcagcgaagccaaccagaccatgagtatttgcgccggcgcggacaaaagcaccacactccaagcccggttttcttaacatcttacaggaatggggggtgcactcccactcttttggcttgtcgca

SEQ ID NO: 532547 - DNA, 323 bp, Homo sapiens
ggctcggcctgtgtgtagcaacaataggaaggtcccaggttgtagagaccagttgagacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaatcaatctgcccttctttacctacaactatcttggtaaatggctttaccacctgcaaaactgaccctagg

SEQ ID NO: 532548 - DNA, 702 bp, Homo sapiens
aggcgcgacacacccgcggtcagattgatcaggatcacgacctgaaacacacctttggcagaagaccacgtgcagcaagcgtgacagaggtagatcgcaaagcgttattggggcataagaacggcagtattacgagccactattccaccccggtgttgcagcatctgattgaggctgcgaacaaagtgttggcaactgactctcgcgagccagtgctgaccgttttgaggaggaaatcgagatgatcccccgcaaagtgcctacgtatgaaaaagccgaacaggttcgagttcggctaagtcattgaaaaatatggtcgggacggagtgattcgaacacccgccccctaacaccccgtgtacgcggacacctctacaggccgctaaacacaaggcttcgcgcctggcgctcgctgcaacgatgcccaagagtgcggaaccgtaactcacgaagtctcttgtaaagtcactgagcctatttaggctccctctggcgtcctgcagacctaacacaaaattcaaacacgagagaaaaagcccgcacgcggcgggcttaacatcagcaacgcaacttggtcgttatctttgcgcctggctctcaggatccgccagtgccctattggtaatcggcatcagatccttcgccataaattcagaacccttcgcagacaggtgatcgtcctcccggtacatcatctggccg

SEQ ID NO: 532549 - DNA, 833 bp, Homo sapiens
  misc_feature (21)..(21): n is a, c, g, or t
  misc_feature (33)..(33): n is a, c, g, or t
  misc_feature (35)..(35): n is a, c, g, or t
  misc_feature (310)..(310): n is a, c, g, or t
  misc_feature (318)..(318): n is a, c, g, or t
  misc_feature (323)..(323): n is a, c, g, or t
  misc_feature (325)..(326): n is a, c, g, or t
  misc_feature (332)..(332): n is a, c, g, or t
  misc_feature (336)..(337): n is a, c, g, or t
  misc_feature (352)..(352): n is a, c, g, or t
  misc_feature (355)..(356): n is a, c, g, or t
  misc_feature (367)..(368): n is a, c, g, or t
  misc_feature (377)..(377): n is a, c, g, or t
  misc_feature (391)..(391): n is a, c, g, or t
  misc_feature (407)..(407): n is a, c, g, or t
  misc_feature (418)..(418): n is a, c, g, or t
  misc_feature (421)..(421): n is a, c, g, or t
  misc_feature (511)..(511): n is a, c, g, or t
tgagtcggtacctcagagctncctgatggtaanancattcccttggttcacaatctactaccttccacagcagcccaggcgacactgaaaccacactcttacctgacgacaccataacctcaggcctcgtggaggcatctacacccacccacagcagcactggctcgctacacacaacactgacccctgccagctccacaagcgctggccttcaggaagaatctaccactttccagagctggccaagctcaagtgacacaacaccttcacctcccggcaccacagcagcccctgttgaagtatctacaanctaccacngcagncnnggctcnactnnaacaacacacttccntgnnagctccacaanntcaggccanagtgaggaatcaanagcatcccacagcagnccagatgcaanggnaagtggaacaacaccctcatctgcccactccacaacctcaggtcgtggagaatctacaacctcacgcatcagtccaggctcaactgaaanaacactgcccgctccacaacctcaggcctcgttgaagaatctacgacctaccacagcagcccgggctcaactcaaacaatgcacttccctgaaagcgacacaacttcaggccgtggtgaagaatcaacaacttcccacagcagcacaacacacacaatatcttcagctcctagcaccacatctgcccttgttgaagaacctaccagctaccacagcagcccgctgcaacaacacacttccctgacagctccacaacctcaggccgtagtgaggaatcaatcagcatccacacagcaagccatgatcgactacaggcgacagt

SEQ ID NO: 532550 - DNA, 121 bp, Homo sapiens
aacgctggtcctcagctttccacatactcccacaacacagtaatggggtgagctcacaaccaccattcagtcaagtgaggtgacactccagctgaggcacatcgttggggtaccgagctcg

SEQ ID NO: 532551 - DNA, 226 bp, Homo sapiens
gaggcaggaggattacttgagcccagggaggtcgaggctgcagtgagctgtgatcacgtcactgcactccagcctgggtaacaaagtgagaccctggactcaaaaataaaaaaataaaaaagaatcatcatagtgatgacaaaggaattacagggcagggggtaagattcatgtaccctctgaggccaaacccctgctgggagtcaagggctgcctgttgctgagg

SEQ ID NO: 532552 - DNA, 303 bp, Homo sapiens
  misc_feature (1)..(1): n is a, c, g, or t
  misc_feature (48)..(48): n is a, c, g, or t
  misc_feature (51)..(51): n is a, c, g, or t
nttgcaggaattcggcacgagaaaaagtaaaggagacccaggcaccangtncacgcctgtaatcccaacactttgggaggccgaggtgggtggatcacctaaggtcaggagttcgagaccagcctgaccaacatggtgaaaccccgtctctactaaaaatataaaaaattaccaggcgcctgtaatcccagctactcaggaggctgagataggagaattgcttgaacccaggaggcagaggttgcagtgagccaatcgagccactgaactccagcctgggcaacaagagcaaaactccgtctc

SEQ ID NO: 532553 - DNA, 762 bp, Homo sapiens
  misc_feature (450)..(450): n is a, c, g, or t
  misc_feature (457)..(458): n is a, c, g, or t
  misc_feature (610)..(610): n is a, c, g, or t
ggtccagagccaccgctctgccctgcaggatccctccatccggctcctgtcatcccctacattttgtcctagcaaaacgtggtagaatcactcggctgctcattccttctggaggacgcactgtctcggctccatatgccttccatgtctatcctggacccttgatgaatcatgatcctactcttccttactgatagttctgagcatctccctccatggtaatcctgcacttgtctgagagacagcacgcctggtctgtccttcactccgcgagctcctatagcgcttggctgttagttcaccaatctggcgtcatgaccagctggtggaaactcagctcagggttctgatgttcctgtgctgtctagtagtgctggtaagcctataaccaaacgttagcttgctatacgtggaatccgcgtgattacccgatttgactaccaagacacntgagtgnntcactggagttgctaagaaaccccgcaactatttaacctctgagtgctcattcctatccccgagaactgggtgccctagccgttcgagcgttctggtcgaaagggggaggtgcctccctcatagtgtgcttgttgcgttgtgtcgtgacacncagcttgtgtttcgcaagttggagagcgggacgggccaggaggcggtgtgatcgtggacgtgctcgtccgggagactgacggatgacatgcataggctacagtctactagtttagagaaaagtaaatggcagactggaccaaccctttccaa

SEQ ID NO: 532554 - DNA, 331 bp, Homo sapiens
  misc_feature (68)..(68): n is a, c, g, or t
  misc_feature (71)..(71): n is a, c, g, or t
  misc_feature (75)..(75): n is a, c, g, or t
  misc_feature (77)..(77): n is a, c, g, or t
gcgaggactgagcatcgagcagctgactacactggcagagaaactcttgggacctggtgtgaattatncanggcngncagatcacgggatcagtagattgagaccatcctgactaacacgatgaaaacctgtctctactaaaaaaacaaaaaatacaaaaaatgagccgggcatgttggaatgtgcctgtaatcccaggtactagggaggctgaggcaggagaatcgcttgaacctgggaggcggaggttgcagtgagccgagatcgcgccattgcactgcagcctgagcgacaggatgagactctgtctcaaaaaaatgtataaataaat

SEQ ID NO: 532555 - DNA, 414 bp, Homo sapiens
gtttttgttctgcttctcagtctgcacagttaaaaaaaaaaaaaaaaaaagaattagttgccaacatttaaacagaaataggttgcacataaaaatctgatttctgatttctcttaaaaattccaaagatctggccagggacagtgggtgttgcttgtaatcccagcactttgagaggctgaagcaggtggacttcttgagcccagtaattcgacactagcctggacaacatagcgagaccctgtctctataaaaaatggaaaacttagctaggtgtggtgttgcgtgcctctggtctcagctagtcaggaagctaaggtgggaagattgcctgagcccaggaggatgaggctgcagtgagccaaggtcacgccactgcactctagcctgggtgacagtgtgaaaccctgtctc

SEQ ID NO: 532556 - DNA, 100 bp, Homo sapiens
gaccatgacagaggcacacacgtctctcggcccggtggcccacggcccggcagaaatgcagcgccagctgatcttgctcccgaagcgggatgacggccgt

SEQ ID NO: 532557 - DNA, 455 bp, Homo sapiens
  misc_feature (54)..(54): n is a, c, g, or t
  misc_feature (134)..(134): n is a, c, g, or t
  misc_feature (182)..(182): n is a, c, g, or t
  misc_feature (197)..(197): n is a, c, g, or t
  misc_feature (205)..(205): n is a, c, g, or t
  misc_feature (207)..(207): n is a, c, g, or t
  misc_feature (210)..(210): n is a, c, g, or t
  misc_feature (212)..(212): n is a, c, g, or t
  misc_feature (233)..(233): n is a, c, g, or t
  misc_feature (235)..(235): n is a, c, g, or t
  misc_feature (307)..(307): n is a, c, g, or t
  misc_feature (455)..(455): n is a, c, g, or t
agcggctggaagagtacacctgtgacctgccccaggaaccccagggccagccanttgcagctgggcaccggctggctgacccaggggggcagtggagttccaggacgtggtgttggcgtaccggccagggctgncgaatgccctggatggagtgaccttctgcgtgcagccctggagagaanttgggcatcgtgganttcacagntncgncntctcttccctgttgtatgcgntnttccggctgctagagcccagttcaggtcgacgtgctgctggacggcgtggacaccagccagctggagctgcncaagctcagatcccaagttggctatcatcccccaggaagccctttttgttcagtgggactgttcgggaaaacctggacccccagggcctacataaggacagggccttgtggcaggccctgaaagcagtgccacctgagtgaaggtgan

SEQ ID NO: 532558 - DNA, 927 bp, Homo sapiens
tgttcggtgagagacgggcgagcagtcagccatgaatcttatcttggctttggatcttcagaatgagaatcagtaaccagacgacgcatgactctacctgagtgagcacggtgttttggacaatggactggttgagcccatccctattataaaaatgtctcagagcaaccgggagctggtggttgaactttctctcctactaagctttccacagaaaggataccagctggacgtcagtttaggtgatgtggaagcagaatcaggactcgagggccctagcataaggaactgaatctgagatggagacccgcgcagtgcgcaatctaatggcaacccaatcactggcacctgatcagcacagtcccgccggtgaatggtagccattggtcacagcaacagtgtggatgtcccggtgaggtgatccccatggtgcggctacgttacaagtcgaagacgctgtaggggatgcaggcggacgagttcttaagctgcggtaccggcggcgcaattcagtgatctgacatcccaggctctcagcattcactcccagggcacaagcatatcagagcttgaatcgaggtaatgaatgaacttcttccggtgatggggtaccctggggtcgcatttgtggacttcatgtccgttctgccgggcattgtggcgtgtggaatggcgtccactggtggtcatgcggtcttgggtgcgtccgctcgccgcttgggatgcgccgtgtgtgcctgtggatcggctatggtcgttgcatgccggagtcgggggctggggttcctcgggggggaaccttttggagccttgtctggcgtggagccgaagggcaggaacctccccgtggtctgcgggtctgtggcggggtttgggggccctcgcggatggcatgcacttcgccccctttgtccttccggggggtgc

SEQ ID NO: 532559 - DNA, 337 bp, Homo sapiens
agcttctgcatcttcactccctctctcctcatctggtcgcatctcgtcatcagtggcagagcggcagccaggcaacaggttgcaacagtctcacctcccttcaacagggccatcctccccccctggcagcctccgtcacactcaaccatcttctccttgccactcagccagtgtctccctctcatcttcagggcccatccaatttccatccacaacaattatcaatcataacaacccctgcgatacacccaatcatcccaaagaccctctctcgtctagatccgtcctcaattcacagcagtcctcacgtcttgcattgcacatctattggggctcc

SEQ ID NO: 532560 - DNA, 116 bp, Homo sapiens
  misc_feature (101)..(101): n is a, c, g, or t
gcattttcaagctaaagaaactggtttattttacagctttattaagatataatttacttaccatatgtctcctattcaaagtatctaactcaattattttnagtatattcatagag

SEQ ID NO: 532561 - DNA, 633 bp, Homo sapiens
tcttatcacataggttctggctatgtctttgcaccagccaccagcgccaacgacagtgagatatccagtgatgcgctgacggatgattccatgtccatgacgaacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccgggcgtaggccgctatagccctcgctcccgctccccggaccaccaccaccaccaccattcgcagtaccactccctgctcccgcccggtggcaagctgcctcccgcggccgct

SEQ ID NO: 532562 - DNA, 248 bp, Homo sapiens
  misc_feature (5)..(5): n is a, c, g, or t
  misc_feature (8)..(8): n is a, c, g, or t
  misc_feature (100)..(100): n is a, c, g, or t
  misc_feature (106)..(106): n is a, c, g, or t
agtangangtttgtcctgcccatctggaacgacagcagcttcagacagagagcacggctcctgcctcaggctccctgccgccactgcagccctgtggtangcccgntggtagtgtgcgaagagcagaggcaggggcacgggggcggggagtccatactccgagcagggagggtcccacgctcctgaagctcagtggctttcttttccggcccccaggtgagtgctggaggacttcgccttgagctcct

SEQ ID NO: 532563 - DNA, 513 bp, Homo sapiens
ctgtgcacagtgggagagatgaactaagctctgaagatggagaagccaaagcagttacaaaagatcaggagcccattggtgaaatgaaggaagaagaggaagacacctttgaatatcctgatactaccattgacttgtcccatcttcagtcccaacggcctctacagaaactggctccaagagaagagtctttgaactcaaatgacagtaaatcacagggccgaagacatttgtcagccaaggagagaagagaaatgaaaaagaaaaagctcccatgtgagtcaggggatttagaagtgatagaagaaaaggacaaagagagagaaagtgctgtgcacactgaagcttaccaaaacacaagcaaaaatgtggcagctggacagccaatgaaaagaggacagaagagtaaaatgaaaaaaatgaaggaaaaatacaaagaccaggatgatgaagatcgtgaacttattatgaagttgctggcatctgcaggttcgaacaaagaagaaaaaaaaa

SEQ ID NO: 532564 - DNA, 403 bp, Homo sapiens
agccaggtccattgcacttttggacaactctactaaatggattttcctcatgccattgcataactgctacctgccaccagagcctcagaaatacatggttttccatcaagcactcatggaacatgtaactgtgggcgcttctagggcggttcatgatggatcctccaagatcaactaaatataaaacaagctcccagctgaggcagctgtctcgcctcttctttcactcgctcctggcagcacagcaatctctgcaagttacttggaccctcaggactccttgttcaagtgcaatggaggaccatgcagatggcagggaaaaccaaagaaagctcaggtggcccatcatggctgtcatcggtggaagaacgtctctatttaacactgaaccttagtaatgaaa

SEQ ID NO: 532565 - DNA, 292 bp, Homo sapiens
gaatgtagagcatccccatatagcctgagcaggagatcgcgaggttgatcgtgttttatcgattacagaacaggctcctttagagggatatgaagcaccgccagttcctttgagttttaagctgtggctcgtagtgttctgccgagcagttttgttgatttaactgtggaggtttagggctaagcataggggggaatctaatcccagtttgggtcttagatattgtgtgttcagatatgttaaagccactttcgtggtctatttagtgtcaactggagttttttacgggtac

SEQ ID NO: 532566 - DNA, 192 bp, Homo sapiens
tgaatgcgccgggcaggaaccgaaccgtgcgctgcaggccgaactgcatggccgccgtgcaatgtgatagaaatctgttgaagcactcgtaggccagcgcgtattcctgctcggattcgcgcatgtccacgccatacttgcgcacgaagcgcgagatcatccagttcttgaccgcgggttcccggtagtccg

SEQ ID NO: 532567 - DNA, 354 bp, Homo sapiens
ttaattaatatatatattttgagatggactctcactctgtcgccaggctgcaagtgcagtggcgtgatcttggctcactgcagtctccacctcacaggctgaagtggacttcccagctcagcttcccgcgtagctaagaccacaggcacatgccaccacgcccagctaagtctagtatgtccagtaaagacaggattttgccatgtagaccaggctgatgtcgagtgcttgggctcaagcaatccttctgccttggactcccatagtactgagatcacaggtgtgaaccactgtgccccgtctacgtggaattgtcctatatgagaacagaggttctaccatcatccagtgata

SEQ ID NO: 532568 - DNA, 118 bp, Homo sapiens
tgatctagaggatctcttcttgtgttggaacgacaaacaaggtttcaccatgaagcaggtgtcttgaccatggcgtgtcgctgctactgagtaaggggcatcctgttacagaacaagg

SEQ ID NO: 532569 - DNA, 236 bp, Homo sapiens
cccgactagcctgacaggagacgggctagcctccgtggcccaccgtccgcggccaccaggaaagcactgtttctgccatcccccatgtctcaggttcccaaggccacggggaccgcgccagtgcaggcctacatgcaggtaggggcagctcacactgtgcccctcccacatggccacacggggtcaggccaggggctgctgtgctccttgctgtcgggctagtcgggggggtaccg

SEQ ID NO: 532570 - DNA, 864 bp, Homo sapiens
cagagccctgagcagccccacgcgtcagcggtcggccatagttaccatcacaccccgggaggagccgctgctgccgtagccggtcccagtcaccatcaccgcaaccatgagcagcgaggtcgagacccagcttgccgcccgtcgtccctccgcggtgtcgctgctcctcgaggcgcggcggaccaccaatgccctggcgactacgggcagcggcgctaggcagctggttggaccgggcgggcttcaacatcggggtgcgcttgccgggtggttcacagggagggtcatcgcaagcggaagggtttacgggggcaggcagtaaagattgggttccacgttgcttcgcgggagcggcgctattggccttgcactccgtgcagggcaacttgcaccaccaagggcagacgactggtagtgttggtacagccgagagcttggcgcctattaatggacgcgcattttgacccccgtggcagaggttaaccttttcggcgggtggttcgcgaccactggggcgtacgaccctggtgggaccggtttggactgggcttcgttgggcacgcggaccacagcggcggtggcgggaggctaggcagagatttgtttccggggtctcctggcggggtactacccaggcttccgaggggccgcgttcaaattagttgacggcaggaccggtcgccccttcactacggaccgcatttccaccggttcgtaggggggtccatccagcgcagatatcaacccaagggacacgttttccgggcattgttgcgacgttggggcacaacgaacggggggctccgcggatttggtcccgaaggccatgccgagatacgcggcgcatcgggcgggcaaaggccg

SEQ ID NO: 532571 - DNA, 261 bp, Homo sapiens
  misc_feature (201)..(201): n is a, c, g, or t
agaacagggctttggcacgtttccattggccttaccggggaatgaattaactccctcaccctctttgtgcctggtctggaattttggctaacagcattaacatctaccttaatgacaaagaggaaggggattcttagaggctcaccaaaatgggcccatggtcagaatatggccccccattatatcttgttagctcttccngggccattagtttatactgtctaagtcgtgttggtttaatagcctaaggtgaattcttca

SEQ ID NO: 532572 - DNA, 897 bp, Homo sapiens
  misc_feature (657)..(657): n is a, c, g, or t
gtaaccatgcatctaacggagtcctggtagtccgcacctgaatgtcctcgtgatgacagcagtcgcgttcattagacatcttagtaaatgaatggtatgacgtagggatatcactttacataattagatgcgtgatgttacctagggagatagtaattcaggcgaacaagagtgggagtcttcaatatgagatgaatatatcacctaattaataatgcgggtagtggcatagatgaaaaactgtgacgaaaatggtcacatttgtcaactgaatcattagtatacattcgagtgtaagaatcctaatttgttcttacaacatagtaggtttatccgagacaagtccaggatagtgacccgaatccttcacatcgagagagcgaaagacctgaatagctattactcgaggagtggagacgacaatcacgagtccactcatagtaaggactcaagtttcattgtcatgcttgaaactaggcatgatatctaatttagttgacattcttacgttggagcacagaggaaatgccctatgcggctatcggacatgcagtacatcgcttcctagagtatgctatagataagatcacctgattgatggtcgggcagtgtgctatatctagtggagtgcgcatccaggacgcaccacaacatttncgaaagaaaacccgtatacatcaaactttctgaggacggacaaaagcgggagcgagatacagaaccccccaaaaaagactgggtttgcaagggccagacgcccaatggccgttccaatggacttttttgcgacaaaaacactgtgggccccaacagagaaaacccagggcacatgtggcaggggggcggggggagcccccagaaaagtaaacaaagccccgggggggaagggaagcgcgc

SEQ ID NO: 532573 - DNA, 1360 bp, Homo sapiens
cttaagaaaagggaagtaagtgacgatactcttccttattgctcacttattctctgagcttggaaagaatataactatgaagagacgtcggaactataatagatgaggatagttatacattatacaaatagcattaggtgcggaagaacttacaagcagttgtcgacagtataagatttgcattgttttgtgagtcaatgagacatgcgtccttgttacttgggagactacttaagatagatattagtggttatgttatatggttaagcggatgtacatataatctacgtctttatataggttataaataatgagacacgcatttaaaaatgatcgtggcttctaagacgtttctgatttaaaagagttgcgagtcacttgtcttagtcttgtgtgagtaggatagattcagcgttgtcccaacttcgaaggcgtcaatttgactttgaaataagtataatgatgaatataattgggcaaatacgcgcgataacttcatgaaggtataaaacttttagattgtcttataaagaaatttaatagcagtaaaaaaatgacgttttatatgtaggaaaaaaaccgcctaaacgagttgcagtcaaccaccgcttgggtgcgtccaaggccccttattgtgccccaatgggtttacttcacgcgtttgtacacacgttttggaaacgacctttcttcgagagaaccccaaagtcttaacaccactttcttccaaaagcgtactggtgttgtacaaggggggtctcggcacggaaaaaacggcacggggttcaccttggggaaagacaaaccaattggcacagaagttgcaaagggaactcactccttatattaatatgttttgacaacacccaaaggtcattacccctatttgggcacttagggaggaacgcggaaaagaaagtttaacctacctattggaaaaaaatggcggcaaatggggcgtaaggcgtttacacacagttggaggaacacaaatataggtatttgagagttgaattaatttagagggtgtgcggaaggcaacaacttgtcttttaagcgggaaagaccaacccattttgtttgtcacacaaaaacaactctgggtgcgctacagtcttggtgttgcaaccaagttgtgtacacccaaaggattatgattggctctcctgtatatgatgatgggcacctgggcaccaggtgatagcagcaggcgatcaatttcatgggcgttcattatacttcaaacggcatgtgcgaaaccccactccattgcggaacaaacaaaaccccacataacagcccaagggtaaccacagtgggagtgggacacaggagctatacgaaacatcgtgatggattt

SEQ ID NO: 532574 - DNA, 132 bp, Homo sapiens
ccccttcgttcacaatggcccattggcagtcaatcttctcaccccactccagcccctggcaaccactgatggtttctggtccctttaggttgccttttccaaaaagtcatataaatgagtcatatagtctat

SEQ ID NO: 532575 - DNA, 486 bp, Homo sapiens
  misc_feature (118)..(118): n is a, c, g, or t
atcatttatgtgtgtaaatactcaactaagaaaaatcaaaagtgtggtataatattacaagaaaaaatattcaaaatggaaagtccatttatgaatgtattaatattaaaatccaaangttatgttttatttataagtgtctacagttatatatgtttacaaagagccatataaatcattgtcagaaaggttcctcatcctgccgagatatgtgaccatataaacacttcattgtcctagaacaaaagacagaaagtgttataattctatacaaaggatgaaaggtaagagtttgtggaatgtacggtataccttacacgcttcattgttggattatgattatttgaatgagagtgctgtaaatattctgaatatatcaacataagtgacgttagtttatacgcatcaagaaaatgtatagagttagtgatttttttgtgcatacatcacctcctcactcaagtaaatgtgaatattagagtgcga

SEQ ID NO: 532576 - DNA, 504 bp, Homo sapiens
  misc_feature (9)..(9): n is a, c, g, or t
  misc_feature (89)..(89): n is a, c, g, or t
  misc_feature (113)..(113): n is a, c, g, or t
  misc_feature (150)..(150): n is a, c, g, or t
  misc_feature (197)..(197): n is a, c, g, or t
  misc_feature (220)..(220): n is a, c, g, or t
  misc_feature (247)..(247): n is a, c, g, or t
  misc_feature (254)..(254): n is a, c, g, or t
  misc_feature (307)..(307): n is a, c, g, or t
  misc_feature (334)..(334): n is a, c, g, or t
  misc_feature (373)..(373): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (402)..(402): n is a, c, g, or t
ttatatganagtgacacttaaatcaatcagtcaactctgagtaatgcagactgtactcctcgatgtaagtcggctttaaccagtcaggngaaggtctgaagaaaaaaaaagancgtcctcttcccagaacaagaaaatcctccaacaganacctttggactggaccttgcaccatcagctttcctgggtttccagcntcctgcctcaaactccagccttnggactggtaagactaaataataacaanacaagcnaatgcttttaaggaagtctgtctggagaatcttgacaaacacaaacatctacngagagtacctgtacaagttttgctcanacccgtagcaagaggcttctggctaaccagtggggagtntnangntctttgcttgtaagaactgaacnaccagcggtacaacagccctagcccagggcaagaaagggaatttccgcaatcactgagtaggctgtagccactatctccataaggcctgaattcaccaaggg

SEQ ID NO: 532577 - DNA, 1200 bp, Homo sapiens
tcaggagatcgagaccatcctggctaacacggtgaaaccctgtctccattaaaaatacaaaaaattagccggacgtggtggcatgtgcctgtagtcccagctactcaggaggctgaggcaggagaatcgcttgaacctgggaggcagaggttgcagtgagccaagattgcgctactgcactccagcctgggcgacagagcaagactccgcctcaaaaaaaaaaaaaaaaaaaagaaaaagcgagaaaattacaggggagggcccgggggggggggcccaggcccttttaaccccaggcactttggagagagggccaagggggggagggactcccctggagggccacaagggttcccagaaccaggccgggacacaactggggaggaacccccattcttcatagctttaaaaaaaagaaaaattccaaaatttagcccaggcgctggggggggggagccctggtgtgaacgcccaggtataccggggagaacttggagcggcaggaaaatccctcttgggaccctggggagaggcgcaaaggtgtcgcgggaagaccccgagaaattgggggcccatgtgggcccctcacagccgggggggcgcaacgaggagtgcgaaaaacctcaaattctctcaaaagagggcaaatatacggaagctaaacagaacagcgggccgggggggaaacacgggggttcaaaacatagaagtcacaattttcttccaccaaaaaagacatagatgggaaccgcaagggactttttttaacacacgcacggggcggggggaccctttcggagaatatcgttggtagtgccgcgccaatgggcgcccccctgtgtttccaagcgccctggttgtgtacccccccccaatattgtggtttcccccaattttggcgctgcacaaagcggaaccccttggcgcgggggggtcccccttccagagagaaagaggggcctggaaaagcgccacaaaggtggcggcgccacacaatgccctaaaggacattgtttcccgacagcgtggccgcctctgtcagaacaaagggttcctcaagagggcgaaaaatatcgtgcctgcgcacggcgggaaaagaaatagcgttattgatgggcaccggcttccacaacaatactaggccagcatgttcaacggtgagagatcaccccccacacgaggagcggcaccgcgagcaaa

SEQ ID NO: 532578 - DNA, 1460 bp, Homo sapiens
acatggaaacacaaatacataaaacagatgcaggtggagtgactataggtggggagacaggcaaggctgcagaccctccctttaagccagcacctttacctctaagatacacgtgcagagctgtagagctttctccaagattcacagattgaaaaaccctgccatggacacacaacccttagaggcgttctgcatcatcacaggaagattctggtccagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataaaa

SEQ ID NO: 532579 - DNA, 348 bp, Homo sapiens
gtagctgggattataggcatgcagcaccatgcctggctagttttgtatttttagtaaagacagagtttgtccatcttggtcatgctggtctcaaactcccgacctcagatgatccgcccacagctgcctccgacattgttggaattacaggcatgatccgccgtgcctggccaaacaaaggcatttctatgctaggtcgttcttgttcctttatctgagtgagctggaggtttctacaagtttttatccaaatgggccagaggtttttctatctgtacagccacgggcatgtctccaagcacaacaacatatgctagttcccttctgtcgtcttctcgcaaaaatata

SEQ ID NO: 532580 - DNA, 314 bp, Homo sapiens
  misc_feature (24)..(24): n is a, c, g, or t
  misc_feature (301)..(301): n is a, c, g, or t
attaccaaaagtgcactcttctanatctagcagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatatagaagagtgcacttttagggntcctctaggtcag

SEQ ID NO: 532581 - DNA, 2844 bp, Homo sapiens
gtaagactagctgaggacctgaggatacagaagaaaaatactcccagtcaactagaagaggctctgaagactttgagtacaaggagctcatttcagaagaggtatcctgaggatcgtgattacagaaaatatggacacacatcacaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggtcccctagctctcaaagctagacaagccaagctggaaacgtgtcctactaattctcccagttctctttccaactttaatggtttcaagtcttctcatttccatcactcattcattactacatttgtttcatccattttaatggctgcatattattccactctgtggatatatgaattatttcagtggtcttcaacctttttgctccatactgtaaagttttgaaaagttatctaccttcttgcacattggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataaaa

SEQ ID NO: 532582 - DNA, 268 bp, Homo sapiens
gctgtactcggacggaagggatatctggatgcatgcacgtatggctcacggataattctatttgtagaaagaacccaacctcctagagaagcacaacggtcaggagtctgtacacacaagttcagcttagcatcacgagtctggtataccaagaaaatcaaagtggtacaagtggttggtctacactatgatactttctaaataaactcgtttgtttttttttttttttttttttttttattcccctacggggggggggggagggggg

SEQ ID NO: 532583 - DNA, 2622 bp, Homo sapiens
gtaagactagctgaggacctgaggatacagaagaaaaatactcccagtcaactagaagaggctctgaagactttgagtacaaggagctcatttcagaagaggtatcctgaggatcgtgattacagaaaatatggacacacatcacaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaagttttaatagtgtaagatcctagtgaaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataaaa

SEQ ID NO: 532584 - DNA, 266 bp, Homo sapiens
tttgtgtaaagtcaaacataaacctggcctacatgcacattgaggcccagcgcctttccttaaacttttttatgacacaaagacctttggttaggttttcctggtgaccctctcccccccattagcctgtagtcctgccccattcccccccctgatatggtaaaaaaagtgatcaataaatattgagggaactcaaagaccagtgccaatgcgggtcccccgtatgttgagcgccggtcctttgggcccagggttttttttcttta

SEQ ID NO: 532585 - DNA, 2594 bp, Homo sapiens
gtaagactagctgaggacctgaggatacagaagaaaaatactcccagtcaactagaagaggctctgaagactttgagtacaaggagctcatttcagaagaggtatcctgaggatcgtgattacagaaaatatggacacacatcacaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataaaa

SEQ ID NO: 532586 - DNA, 2709 bp, Homo sapiens
gtaagactagctgaggacctgaggatacagaagaaaaatactcccagtcaactagaagaggctctgaagactttgagtacaaggagctcatttcagaagaggtatcctgaggatcgtgattacagaaaatatggacacacatcacaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaaggtaaagaatgttcatactgatggattccaaaaacccacacattttataaaatcaaattttagaaaatgtattgaaaaaccttacatgaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaagttttaatagtgtaagatcctagtgaaaggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataaaa

SEQ ID NO: 532587 - DNA, 1101 bp, Homo sapiens
  misc_feature (32)..(32): n is a, c, g, or t
  misc_feature (35)..(35): n is a, c, g, or t
  misc_feature (38)..(38): n is a, c, g, or t
  misc_feature (40)..(40): n is a, c, g, or t
  misc_feature (43)..(44): n is a, c, g, or t
  misc_feature (146)..(146): n is a, c, g, or t
  misc_feature (162)..(163): n is a, c, g, or t
  misc_feature (201)..(201): n is a, c, g, or t
  misc_feature (243)..(243): n is a, c, g, or t
  misc_feature (247)..(247): n is a, c, g, or t
  misc_feature (261)..(261): n is a, c, g, or t
  misc_feature (269)..(269): n is a, c, g, or t
  misc_feature (282)..(282): n is a, c, g, or t
  misc_feature (289)..(290): n is a, c, g, or t
  misc_feature (304)..(305): n is a, c, g, or t
  misc_feature (312)..(312): n is a, c, g, or t
  misc_feature (328)..(328): n is a, c, g, or t
  misc_feature (338)..(338): n is a, c, g, or t
  misc_feature (360)..(360): n is a, c, g, or t
  misc_feature (363)..(364): n is a, c, g, or t
  misc_feature (369)..(369): n is a, c, g, or t
  misc_feature (372)..(372): n is a, c, g, or t
  misc_feature (376)..(376): n is a, c, g, or t
  misc_feature (391)..(391): n is a, c, g, or t
  misc_feature (401)..(401): n is a, c, g, or t
  misc_feature (433)..(433): n is a, c, g, or t
  misc_feature (436)..(436): n is a, c, g, or t
  misc_feature (450)..(450): n is a, c, g, or t
  misc_feature (456)..(456): n is a, c, g, or t
  misc_feature (466)..(466): n is a, c, g, or t
  misc_feature (468)..(468): n is a, c, g, or t
  misc_feature (480)..(480): n is a, c, g, or t
  misc_feature (504)..(504): n is a, c, g, or t
  misc_feature (508)..(508): n is a, c, g, or t
  misc_feature (518)..(518): n is a, c, g, or t
  misc_feature (547)..(547): n is a, c, g, or t
  misc_feature (558)..(558): n is a, c, g, or t
  misc_feature (561)..(561): n is a, c, g, or t
  misc_feature (574)..(574): n is a, c, g, or t
  misc_feature (595)..(595): n is a, c, g, or t
  misc_feature (625)..(625): n is a, c, g, or t
  misc_feature (655)..(655): n is a, c, g, or t
  misc_feature (663)..(663): n is a, c, g, or t
  misc_feature (687)..(687): n is a, c, g, or t
  misc_feature (701)..(701): n is a, c, g, or t
  misc_feature (711)..(711): n is a, c, g, or t
  misc_feature (737)..(737): n is a, c, g, or t
  misc_feature (745)..(745): n is a, c, g, or t
  misc_feature (747)..(747): n is a, c, g, or t
  misc_feature (767)..(767): n is a, c, g, or t
  misc_feature (777)..(777): n is a, c, g, or t
  misc_feature (804)..(804): n is a, c, g, or t
  misc_feature (851)..(851): n is a, c, g, or t
  misc_feature (860)..(860): n is a, c, g, or t
  misc_feature (867)..(867): n is a, c, g, or t
  misc_feature (869)..(869): n is a, c, g, or t
  misc_feature (880)..(880): n is a, c, g, or t
  misc_feature (895)..(895): n is a, c, g, or t
  misc_feature (898)..(898): n is a, c, g, or t
  misc_feature (907)..(907): n is a, c, g, or t
  misc_feature (934)..(934): n is a, c, g, or t
  misc_feature (937)..(937): n is a, c, g, or t
  misc_feature (947)..(947): n is a, c, g, or t
  misc_feature (971)..(971): n is a, c, g, or t
  misc_feature (1005)..(1005): n is a, c, g, or t
  misc_feature (1026)..(1027): n is a, c, g, or t
  misc_feature (1038)..(1038): n is a, c, g, or t
  misc_feature (1063)..(1063): n is a, c, g, or t
agcggagggcgaccgcacgatggcggcgcganagnggnantgnnggggtgctgcgcactggtcggggccggcggcggaggctgaccccctaggacgcttcacgtgtcccgtgtgcttagaggtgtacgagaagccggtacaggtgncctgcggacacgtctnntgctctgcatgcctgcaggaatgtctgaagccgaagangcctgtctgtggggtgtgtcgcagcgctctggcacctggcgntccnaggccgtggaagcncgagcggncaggatcgagagncacagannacttcttgccatgnnctgccgntaagaactttcttccntgatccaagnatccggttcccaccgttggccnacnntgttnccnaaanaccagaatttaacantcaatggaangggtgttgaacgggccacccacttatagggantgncactcctctctcangcacanagagaaatgntntccacaaaccgnttaacaacctgtatccctgtgttncctntaacgtggtnccctgaagaaagagaaccttgtgaatcangggaaagaganctntgttgtgaaacancttggcaaaaatataatatcncaataagacaacgggaataacccaaaaatnctcggtggggttttggtcccgaataattgntgtccctncgaattgccccctgggggtggagnaacccccaaaactnacccgccagncggcccaaaacttttcaggaggaagncaacaatncncaaggcggcgcggggcaacncgggtttttnttctttaattgaaacaactttttttgntgggaatttaatggaatggtttggaattgaaaagaagggaacaatgnaattgaaanttcacgngntggtttggcanggcgcctccccaatncanttccgaacncaaggttgaaggcaagaaggttcccgntgnctttggctanttcttggttcttcaatggtttaanaagagggctttccaatttaacaataatttaaaancggtgaaaaattctaatggannctccctggtanccctttaaccctgttttcaaacagnaaccctgaaaaaaatggaggccaatgggcaatttgggg

SEQ ID NO: 532588 - DNA, 1839 bp, Homo sapiens
gtaagactagctgaggacctgaggatacagaagaaaaatactcccagtcaactagaagaggctctgaagactttgagtacaaggagctcatttcagaagaggtatcctgaggatcgtgattacagaaaatatggacacacatcacaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatgtgaagaaaacagtagatacattcagggttgcttctagctattccacagagagacagatgtcacatgatttggttgctgttggcaggaaaagtgagaactttcatccagtgtttgaacatcttgactcaactcagaatactgaaaacaaacctacaggagaatttgctcaggaaatcataacaataatccatcaagttaaagcaaattattttccatcacctggcattactttacatgagcgtttctcaacaatgcaagatatacacaaggcagatgtaaatgaaattccattgaattcagatccagaaatacacaggagaatagatatgtctttggccgagcttcagagtaaacaagctgtgatctatgaatcggaacagactctgatcaaaataatagatccaaatgacctacgacatgacattgaaagaaggcgaaaagaacggttacagaatgaagatgagcacatttttcacatagctagtgctgcagagagggatgatcagaattccagtttttcaaagaattatactacgcagagaaaagacataattactcacaaaccatttgaggttgagggaaaccaccgaaacacaagagtaagaccttttaagagcaactttagaggtggcagatgccagcccaattataaatcaggcctggtacagaagagcttgtacattcaggctaagtatcagcgtttacggttcactggcccaaggggatttatcactcataagttcagagaaagattaatgagaaaaaagaaggttagttgaattaaaatgatctaaaaatgtttagtgacttttaaacttctagattatctatgttcattagataaattggtttctcatttaattttaagaaacaacctgggtttttaaatgttcttgttgcatgatagttgaataagatcttcagggagtaatggtaatacagttgtgaggctgtgtaaccttaaaatgcttttaggcattatgccttgaatactttgcatatgttagctgtttgaacttttgactttagaatttctgttgtatggttaatctttgaaatggatgtatacttaatcagcggaatgtattgtactcagtcac

SEQ ID NO: 532589 - DNA, 614 bp, Homo sapiens
  misc_feature (32)..(32): n is a, c, g, or t
  misc_feature (35)..(35): n is a, c, g, or t
  misc_feature (38)..(38): n is a, c, g, or t
  misc_feature (40)..(40): n is a, c, g, or t
  misc_feature (43)..(44): n is a, c, g, or t
  misc_feature (146)..(146): n is a, c, g, or t
  misc_feature (162)..(163): n is a, c, g, or t
  misc_feature (201)..(201): n is a, c, g, or t
  misc_feature (243)..(243): n is a, c, g, or t
  misc_feature (247)..(247): n is a, c, g, or t
  misc_feature (261)..(261): n is a, c, g, or t
  misc_feature (269)..(269): n is a, c, g, or t
  misc_feature (282)..(282): n is a, c, g, or t
  misc_feature (289)..(290): n is a, c, g, or t
  misc_feature (304)..(305): n is a, c, g, or t
  misc_feature (312)..(312): n is a, c, g, or t
  misc_feature (328)..(328): n is a, c, g, or t
  misc_feature (338)..(338): n is a, c, g, or t
  misc_feature (360)..(360): n is a, c, g, or t
  misc_feature (363)..(364): n is a, c, g, or t
  misc_feature (369)..(369): n is a, c, g, or t
  misc_feature (372)..(372): n is a, c, g, or t
  misc_feature (376)..(376): n is a, c, g, or t
agcggagggcgaccgcacgatggcggcgcganagnggnantgnnggggtgctgcgcactggtcggggccggcggcggaggctgaccccctaggacgcttcacgtgtcccgtgtgcttagaggtgtacgagaagccggtacaggtgncctgcggacacgtctnntgctctgcatgcctgcaggaatgtctgaagccgaagangcctgtctgtggggtgtgtcgcagcgctctggcacctggcgntccnaggccgtggaagcncgagcggncaggatcgagagncacagannacttcttgccatgnnctgccgntaagaactttcttccntgatccaagnatccggttcccaccgttggccnacnntgttnccnaaanaccagaattactatcatgcgaatggggtgacaggccagcattgagggatggcggttctcgtgtcgagccagaggaaagtggtgaccggaccggtgtacacctttgccttggtccttactgtcctgagaagaagctgtggatcaggaaggagctgctggaaccactgcaacattgattccatagtcacggcataccaaattctgggggtttggtccgaatatgatgcctcgaatgccct

SEQ ID NO: 532590 - DNA, 347 bp, Homo sapiens
tgcagtaatcgatggcaccggggatggcagacagtgccagcccggagttgaggcacaccatgtggccattcttcagctccagcataccccgcaggaaggccttggtggtccaaaactggcccaacgtggtgatgtgttgggacttactgaaggcattattatcactggccattaagctcttcccatggaccacggcggcattgttcaccacgatggtgatgttacccaccttcttccggacggccttgtccgtctggtacacctcctcccggttgcccacatcacaaatgaagaaatggcgctcattgcccatctgccggatctcctcccatcctaagaagttgccg

SEQ ID NO: 532591 - DNA, 774 bp, Homo sapiens
  misc_feature (761)..(761): n is a, c, g, or t
gtaagactagctgaggacctgaggatacagaagaaaaatactcccagtcaactagaagaggctctgaagactttgagtacaaggagctcatttcagaagaggtatcctgaggatcgtgattacagaaaatatggacacacatcacaaagacctaaagacgtggagaggtatgaaagcagagagcctgccaggaacccaaagtggaagcctgagcattccctcccaccttaccaagaggacacagaccagtggaaccttgggccccaaacttatcgacatgctgagagggaacacccagagaccagttcagcaaccaaagtatcctatgactatcgtcacaaacgtcctaagctcttggatggggaccaggacttttctgatgggagaactcagaagtactgtaaggaagaagatagaaaatatagttttcaaaaaggccctctaaatagagagttagattgttttaatactggaagagggagagagactcaagatggacaagtcaaagaaccttttaaaccgtctaagaaagacagcattgcctgtacttattcaaataaaaatgatgttgatttgcgatctagtaatgacaaatggaaggaaaaaataaagaaagaaggggattgtagaaaagagagcaattcttccagtaaccaacttgataaaagtcaaaaacttcctgatgtgaaaccctcgcctatcaatcttaggaagaaatcacttacagttaaagtagatatagaagagtgcacttttagggntcctctaggtcag

SEQ ID NO: 532592 - DNA, 346 bp, Homo sapiens
atgtgatccggctgcagatcgccgagaccttgtcctctgtctcatgatgtcatgattgttaagatgataaggccagcatggtgctcatcctgtaatcccagcacttggaggtccgaggcaggtggatcactgagccagagttgaaaccagcctggccaacatggtgaaaacctgtctctactaaaaatacaaaaattagccgagcgtggtggtgcgtgcctgtagtcccagctacttaggaggctgaggcatgagaatcacttaaacctgagaggtggaggttgcagttgagccaagatcacgacactgcactccagcctgggcaacggagactctgtctcaaaaa

SEQ ID NO: 532593 - DNA, 471 bp, Homo sapiens
gtatggcggctcaaactatactggattagtgtctactaataaattgattgaaggtgaagatcatttacttcctagacgcaggcattttatttgcagatgtgtaaagccgtcgacaactataaacatgctgaaacatgatacaacagtccttcaactgtatccattgcttaaaactcccagagttcaggaaaacaataaatcacaggtggaccagattcaatatgagaaaatgtctgtggagttggagaatacagtctttcgggggcagagggggctggcttgccctttttactattatgtacactactactacgttaagataacaagccttgggttttatgtttcttaaaactatcttctaaaatataaccgtaaaacagagttaaaaagataccttaagagaagcataagaaattcgccatttggggaggccagtctcgtggggcccgactccgccaggggatcctctaa

SEQ ID NO: 532594 - DNA, 194 bp, Homo sapiens
aggtgactctcaggttagctctcacacaccccgctctgtagtaccgcgctctccaaccaccccggcgatctccacccaccccggcctcctgagtagttaggactacaggtgcatatcacaaagcctggctatgatttttaaattttttatggagatggggtctctctgtgtcgcccaggttggtctggaactcc

SEQ ID NO: 532595 - DNA, 686 bp, Homo sapiens
ggacaaaactagtctcgcagttatgatccggcgccacaagacatcatcttcacggcacgccaatgagtccacacacggtgtcgaactgccagcgcctcgtcgagggcatcctcacagcggcctcctgagggaggcagcggctgtacaatggatgaccaactcttggatagataggtgctcaagacactgggccgatgtgtggcttcaccagtcaaacaggacggccacaggccccagcacagtgggggctggcttccgggcatgatgatcagcttttgaggccctgtgcatcgagccggtttccagcctctggcagagctgccgatgtgatgatatgcgccccatggacgtccgggaagcacgtgtccaactgaacaaggcgtggcgagttgagatccccaagaaggccccattttgccgcaagtaaaccgagattggggagtcgtgaataaaaaccctccatgggggatataacaaagggccctttttataacgcctcctgcgaacacgttggcgctatcagtagcccatgcggacttatgaagacgcggacgcaatctttcattaaggcccctttaggagcggagcttctttggtgcaaaagcgagtgatgtccttcagaaaattgtgggatcacacccccttataaaaattcgaaatattgggaaacgcgcgtttttagaaac

SEQ ID NO: 532596 - DNA, 441 bp, Homo sapiens
tgatttagaggatcctgaagtggcggttggtgtgactatgcgatcggaatgccgttgtgtgtagcgtatgatgtggtgggacatatggggagggaactggaatggaagcattgagggtcagagctgtggggtaggggtgtctgaatcctcctgttgtgattgggtacactggttgagcttgcttgtggtactaatcatcctagcggactgggggactttgtcctccggtgccacggcgctacgtgggtacatccggggactactactctggacggtgtgcggacggcccgtgggattcctgttttggggtctccgtcgccggcctcctgtttctgtttcatgacgctcaaaaccgtcaaccacatgtacgggtcagcttcgcgcctcacggtacgccctagtggcccaagggggccatcttcgagggtaccggggctcgac

SEQ ID NO: 532597 - DNA, 403 bp, Homo sapiens
cgccgggggaatgacagcgagaacggacaactcgtcggcgggaggaaggttccacgcataaaacaaacaaaaaaacaataggggggctatcagaagaaaaagcgggggacgagaggacaaaaccatggcatcaagaaccctcaggctattataactctttactcgtgtgaccccgcgtcttcagtcccgtactcgtccgtgtgtttctttactttttaatcccaaaaatccttctaattgctaatgtgccaacagaggaaccacattgttttatagctgataagaacccgtctgttttcgaaaacatctgtctgcaacgtattactcatgtattctcaaagtcatatttatcacactagtcttctttgactgtattcaacaaaaggcagtttcatcgccttac

SEQ ID NO: 532598 - DNA, 784 bp, Homo sapiens
tatttcattctgggacggggcttagattgataagattacatggaccgtggctgacaattaacacagcgctatgccgggacagccccagcagagcagcagtggtggcccgcgacgcagacagtgcggggcaccctgagtcctacctgcccgaggagtacatcaagacgggaaggctggctgtaggacacggacaccttcagactataaggggtaggtagtagctaagagacctatggctaggtacagaagggctagtagaagatcgcacggtagccaggaaccaagtatactagaacagacctaggtaggcaagaggaggctgaagagaggctaggaagtaggcttatagagaagcacccagagacacactagcaagcaggtactagagctagcagatagcctagggctagctacccatacgccatagcagatctacagagaagcacctaggaccccaggcccgggccctgaaccacctagaagctgggcctagggcctagggccacgctaggcctgcatagctgcctgcaccgccgggccaaaaggaggcctcctatgacccaggtagtacgacgaggctagagcaagctagcaggcagtggtaggcgggggtgcccgggcattcggaggccgccagctagcatcccccttaccccgcaggagaactcctacgtagtccagcactaggcagagcccacagtggggctgctccatggcagcccctaggagcgcatcaggagccagtgccaggcagaaagcgttggagaaggcccaccagccgtga

SEQ ID NO: 532599 - DNA, 196 bp, Homo sapiens
ctcccggactaagcccttcacctccgcaacaataagtgtaacacagtacaccgtggacaggatcaccgacagctgcaagggtcagcactaggaacaccttgcggatgaaggcctgtcggtatgctctatgtcatccctagttgggtggcagggcaagtcctgtgttgtcatacgtaggatagggggacccatcctc

SEQ ID NO: 532600 - DNA, 202 bp, Homo sapiens
tgtagtccggtctcgttttgaacttagggattcaagcaatccgccagcctcagcgtcccaaagtgctggaatacaagtgtgagctaccaccactggcagttaagaattttaacaatttgtcaatgaaacaagaatctcaattagagtctttatatacaatctgtactgttggaattttcaaataaatattgtaaagaaaatt

SEQ ID NO: 532601 - DNA, 159 bp, Homo sapiens
aaaaaaaaaaaaacccggtcgggttaaacgggggatccagtccccccggcgctttgttaacgttgggcccccctttggcaaaaaaaagggcccccatccccccttttaagttttttgtaattttggctttttttaataaaaaaccccctttgttccgta

SEQ ID NO: 532602 - DNA, 221 bp, Homo sapiens
aagccatgacctgtgctcacacaatggccccatgcgaggcccctacacatggactgcctggagagacacgaacatatgacaggaacacactggacatgatacagaatgaggccagacacacccatgcctgatgacctcccaagcagcgaccccatggacagatggggcagaacagaaggtgtatacacttgtgcagacaacacagggctggacgcccacac

SEQ ID NO: 532603 - DNA, 245 bp, Homo sapiens
tcgggcgtgcacttacacatgctctgaatgtgttcctaggagtctacccaccaataaattctgaactcctcctatgggagggattagtaaggagagaggcgacatgtttcacacaggtacagacattaatatgaccataaggaaatattatgaatagctttatgcccacaaattcaaaaacatggatgaaatgggcaaattccttaaaagatgcaaactttcagaaacggaaaagagtaaacaaa

SEQ ID NO: 532604 - DNA, 629 bp, Homo sapiens
  misc_feature (219)..(219): n is a, c, g, or t
  misc_feature (386)..(386): n is a, c, g, or t
  misc_feature (463)..(464): n is a, c, g, or t
  misc_feature (487)..(487): n is a, c, g, or t
cgcgggacgcagatggtccgagtcacaagtaaagaatgtctggtggtcttggcatgagagattcatgtcataaggaatcactaacaccttgactccagatcatggcttgaaacacactggaatgggattttgcataaaagaagaaagctcaggaatgataaatttacacaccatggatctagaagggagtctataaccccagaatcaccattattttgntgatccatatggctatcaattaaagtgctacctgagtgctgttcaacttcttgagatggtgaaaaaggatgaaaggagacatagcaatcttcaactccctcctttacttttgaataagaggtgatgaaggcaggtcagagagatctgggtcaaatctcatgatttantgctattaacctggccaaatatttaaaaaaaaaaaaaaaaaaccccccctttttttttttttttgggggttgtgggnnttccccttgggggtttttttttntacttagcaatataaagacactggtcatacccaccactcagaatttcaatcagaactaaatgaaataatatatgcaaagtgcttaatatagtacacctggcatggagtggtaactcaataaatagatcttttgttataaaaa

SEQ ID NO: 532605 - DNA, 930 bp, Homo sapiens
agcgtgctctgtcctacttctgacttgacttgtggtgtgaccatgttcattataatctcaaaggagaaaaacaaccttgtaaaagcaagcaaaaatgaccaacagcaaaaacaaggtcttattccgagcattccagtaactttatggtgtatgtacttagctgtactataagtagttggttggtatgagatggtgtaaaaagggccaaagataaaaggttatcatttgtagtgactcctgtttgtgtctagtgaaagtagtgtgtttatttcttttctggactgtgttgatgtatgtggtgaaataatgtaagtccaataatagaacaggaatttctatttggactgaggtggttctaacgaaattagagaaaaatgagagatgagattaagaaggcattcttagaagcagtagttcagagccactggatggaatctgtaatccaggtgccctacaaaggctagaacactacaggggatgaattcttcaaataggagaccgatggatctgtggtcctttgggactcatcaaagccttggtttagcatttgtcagttttatcttcagaaattctctgcgattaagaagatatttattaaaggtggtccttcctacctctgtgatgtgtgtcgctgcacacagcttagaagctgctataaaaaagggagagagctcccaaattgaaatcagcgtgtaataatttaacccatttgctattacaagcaagggcaggggcagcaggttgcagagaactattggcatggcttatggtgatcagcaccaacgaaggttcggtaaacctaagtgccggttttacaccaaaaaaaaaaagggcggggagaaaaaaaaaccaggggcccaaacgcacacgggtctttaaaggggccccagggcgataacagcgggcgatacacggggggaagacgggttg

SEQ ID NO: 532606 - DNA, 496 bp, Homo sapiens
acagcagaagagcagctgcaaaggagctagtctgggccccaggagtagagacagaaagaagtgcacgtctgctcctctctctacaaggccagcaccaagccctgacccatggcatgctgatgccacgtatgacaccctcatccatggacaagcccagagctccaaaagaaagtccaagggactgatgccctccaccctgagatttcatctttccaatcttttcttatcagatacgtgatttctccactcttgtagaaaagacagggacaaggtgaagggaaggatagaagcttccttttgaataattccaggaggtagagggtgtggtgatgaaaaatttatattctttggactaataaaaatattagattagaaaacaagggccaggagtagtggctcatgactgtaatcccagcactttgggaggcagaggcgggtagatcccttgagcccaggagtccaagaccagcctgggcaatatggcgtgacccccatc

SEQ ID NO: 532607 - DNA, 798 bp, Homo sapiens
  misc_feature (504)..(504): n is a, c, g, or t
tgcccaaatattaatgtatttagcactgataaaaccaaatggcttatttctctccagattggcccttattctcctactggaattctggattatccaagttagaattctcatcttttcccttgtatttgaaggtggaaaacctgagctggtaaggcccattcccaatctagcagtcccaatctaggagttaggcatgcacttgataacacttcttggtccatcttcccaagaaagagcaatagaaggattgaaattagcagcccacaaggcttggccctcttcttgggtgccggttccttctcatgcttcatcagttcatcgcactgtccaaacaatagtactggctttatagcatcctggaaaatcacaaaggtaacccagacccttaaaccttgagtacttaacatttccatctccgcgtatcacaggaacataaatgtgatcatgtccaagtcaaacttgctcttctttctgtgctgtctgtttcaataaataggtatacanacacccaattactccagagtagcatctttgaatgattccttttcgcttaacccctgctatatccaagctgtctccaaatacattgagttccttctcccaagtattacatgaacacctttcctctatctttgccatcaccttagtcaaatccactgtaaactttcactggaaagctacagtactttctactttatctctttgcattaaatctcatcctcctctcatcattctgtagctaatggggccctgttaaaaagtaaagtctgagcattctccttaatgtcttaaattcca

SEQ ID NO: 532608 - DNA, 122 bp, Homo sapiens
gtgcaggcacaccggtcttccagctggctatcgctgtgtgccagtggtgtcggcattggcttaggcctgggtggaggaagcagctactcctatggcagtggtcttgtgtgttgcagtgtgtt

SEQ ID NO: 532609 - DNA, 205 bp, Homo sapiens
  misc_feature (22)..(22): n is a, c, g, or t
ggggggggggggttttaaaccncccccccccaaggggggggcccggaaaaagggccccctttccccctaaaccccccgttggtttaacccccaagggtttattggggcagggggggtttccttttaaatgggaaccccccccccttttggttccccccccccgacgggtttttaaaaaaacccaaaaaggggggtttcctcccca

SEQ ID NO: 532610 - DNA, 285 bp, Homo sapiens
ttaaagccccccccttttttaaaaatgggggcccgggattccccctaggggggggattaaaagggccgaaacccgccttttcccaaaaaagggtttttctgttaaaggtttaaaaatttttcccctaattttggggagaaaaaggggttcggaaaaattattttgggccccctttgggcccccccctgaaaaaaccgggataaagggtttttgggcccgggtctcccctgttaaggggggccgaaaaggttttttttagggtgggtttaaatttcttttaaatta

SEQ ID NO: 532611 - DNA, 110 bp, Homo sapiens
gtgatcacacgctaacgtctgccctgttctgtatggtgagccgcacacaagccaccaccgcctgccgccttctgcgcaatgcaaccgcctgcaaaaaaagggcgtgcgct

SEQ ID NO: 532612 - DNA, 937 bp, Homo sapiens
gggagctcgctgccgaggggacgctgggctgagtcgtgccggcggcgcggagcccggcggcgagcggcagcggggtccgggtccggagacgccacatgagacggtttaagcggaagcatcattactgccattgactgccagacatttggctcggagtcacttggctgtgacccagcccattcggtcaaagatggacaaacagagatccgaaccatggtcatctatcctcaaaccgagcaacaacaacagcaggcgagtaggggtccagggcaagtccaaagcatgcaatcctctgcagttcattcctcagcaggcaagcagccggtgcacccaatgaccatggccaaacagcaattctgtatggccagagacagactgtacaggactcatgagggtgaccatgatcttatcctgcagagagcagctgatgcactgcctcagagaaggcagtgccagcggccgaggcatcaccacgaggtctgcacaccgaacacatccaggaacgcgagtctactggatcactctgacggacagagacataaccaaggcataccgggaccagaccaggtggagactggagtatacactaagaaaagcatcccaacggcaacccaactaagaaactaggtggcccaatgcaaacaagggaccaagcgagacaggccaacgccaagaaaggcagcaggacaaacacgatactagagaaacatcaagcgaagtacagggatgacacagcgacccaagaccgcatagagagaacggtggaaaccctggatccacagttccttgactaccctactattgagggcgatacttgggaaacgttgaccctgcccaaggcaggcaatgagcgcacctttgaaagcctgacataaagatgtcctgaaggtcagtggattgcattccatccggaggcagacctttacagagaactgac

SEQ ID NO: 532613 - DNA, 942 bp, Homo sapiens
tattagtgactcacccctcccctgcagggtgttgcctcctcatgtgtccctctttatctccccttgtacacaaccccttgtggcccatatttttttaaaagctcctcatcaacccgtaaaattttcgcactcgctttcatataataaatttccggcttcatcatcccttaatccctccataagctcttattaacccgaattctctgcaaccaatagaagcccattgtcaacctaaaatgtctgcctattttggtgaaacccccactgccaacgttcgtcatgcatcgtccaccccacaatatctggcgcctcgtgaaagtatatctctcccaactgttgcccccgcaagcttccccctccttcgaatataaataaaagggggagaacccaaaacaggagactaatccactttcttttccccccctccaaaaaattttcatatctatctagttcccccatttaagtgtaacaatttgccccttcatagaacagaccctacattcaacctctctttcagtcgcactccaatatatattttatgcacatatcttcatccctggtaaaccccttgtgtatacaagtagatacgttgaatcccagtgtcaataatgaaactatgatcaatgttgctccgggatggcaccccgaccacctctcgggataggcttcccgcttctcggggaataaatcacgatgcccaaagcggcttgattccctcgagaggggacgcatggatcaatactcatgtttgatagccccatcctcgtatcttcttaacaactgacgtgagtctgcccgcccctcctttaaaagtggctataataggattgttgtctttcgaaacaggtgctcaccttcttttggagatgatcgcattgtttgtagggcgcaagtaactttccccattcgacaaacaaaataacccctccaacaaacataaca

SEQ ID NO: 532614 - DNA, 1059 bp, Homo sapiens
  misc_feature (733)..(733): n is a, c, g, or t
gaggcattgaggcagccagcgcaggggcttctgctgatgggcgcaggcggatcttgaggaaaccgacagaataagttgtttctctctttgatcagataagacgattaggtacaagctacttataacaagagtatagtcaagtaggttacctagagaatatgggcttatgcgttaagttgttaaacgtacatttgtagagtagcttaatgaattgttaacgatgagaattatgcaacgcaccttagacagcagctgaggcactgacgcgcaacggaccccagcactagcccgaggttctcctaggaaaccactgcaacggcagggttgcagcatgcaagcctttccttcattgcgcacgataacacatacattcgctactttttaagcacccgaacatacttgcacgacgcacatacgggaacttaacaggaagggcctccggaaaagttcaaatgaactctaaattagacagagggtgtggcccagatgtgagctttctttaaagggattctgacagagacttcgccacaggcgttggagaagctttgaaaagaatcgaggtcttttcaaacaggtgtttaaggtctttgaaacgagaggttatggttaaggagctggattgtcaacaaaattccaagttttgggaccatgggctgcaactgccttttgttttaacagtagcacatggcaaggcactttttcaaaactccgcggaaagagcggctcgcactcntaatcgaacacagggaacaccctttttggcgacaataggttctcccatttggcacgtggccaatgggggtaaggaaatacttgtggtctgggttccaactcttttaagaagaaggtcgcattaaaagggttgaacaacggggacgaactttttaagcgtgtaacagaagcgggccaaggaacgcgggacaaacacacgtgtggggcaatagcgggacatgttctaacattttagggggcgaagggatgtgggattgacacagcggaactttggacatataggacacaaatttttccgggggaaaggaaaacagcgacatacacaga

SEQ ID NO: 532615 - DNA, 700 bp, Homo sapiens
ggtatatacctaggagtgggatttctggatcacatggtagctcaatttttagtttcttgaggaacctccaaactgttctccctagtagttgtactaatttacattcccaccaacagtatacaagggttctcctttctccccatcctcaccagcacctatctaacttttggataaaagccattttaactagggtgagataatatctcattgtagttctgattggcatttctctgatgatcagtgatgatgagcaccttttcatacgcctgtctgccatgtgtatgttttcctttgagaaaggtctgtttagaacttttgcccatcttttgatcagattattagatttttttttcaacagagttgtttgagctacttatatattctggttattaatctcttatcagataggaggtttgcaaatattttctcccattctgtgggttgtctcctcacattgttgtttggttcctttgctgtacagaagttttttaacttgatgtgatcccatttgtccatttttgctttggtttcctgtgctcaaaaaatattttcccaaactaatgtccttgggagttttaccattgctttcttttagtggtttcacaggttgagggccttgattaagtctttaatccattttgaattgatttctgcctatggcaaagatagaatgccacctataggctagtttcattctttt

SEQ ID NO: 532616 - DNA, 402 bp, Homo sapiens
  misc_feature (41)..(41): n is a, c, g, or t
  misc_feature (69)..(69): n is a, c, g, or t
  misc_feature (76)..(76): n is a, c, g, or t
  misc_feature (91)..(91): n is a, c, g, or t
  misc_feature (154)..(154): n is a, c, g, or t
  misc_feature (157)..(157): n is a, c, g, or t
  misc_feature (166)..(166): n is a, c, g, or t
  misc_feature (168)..(168): n is a, c, g, or t
  misc_feature (172)..(172): n is a, c, g, or t
  misc_feature (179)..(179): n is a, c, g, or t
  misc_feature (183)..(183): n is a, c, g, or t
  misc_feature (226)..(226): n is a, c, g, or t
  misc_feature (244)..(244): n is a, c, g, or t
  misc_feature (255)..(255): n is a, c, g, or t
  misc_feature (276)..(276): n is a, c, g, or t
  misc_feature (294)..(294): n is a, c, g, or t
  misc_feature (300)..(300): n is a, c, g, or t
  misc_feature (304)..(304): n is a, c, g, or t
  misc_feature (316)..(316): n is a, c, g, or t
  misc_feature (318)..(318): n is a, c, g, or t
  misc_feature (322)..(322): n is a, c, g, or t
  misc_feature (334)..(334): n is a, c, g, or t
  misc_feature (366)..(366): n is a, c, g, or t
aagaccccatacggccacaatccagggagcagcacaatgcnagaactgaagacctcctacgagtggtantggggcnttcccacgaagaggnctggggaggatctcgggcctccgtctgccctccctcctcgatggggggcctgctcccgctctnacngggagcgcnantgcnctatggntctntccacggggaactcccaaagacaggacactatgcaggatatgnacaaaatgaatacccccnctctcctcccncccgggctgcgcccccccgcntctccccctcctccgacnccctcncctncccctgccccgncncccnccggcctcctcnagcccccccctcccctcgcccctggccacccncgcgctctcccccccccctccctcctcccaaccacg

SEQ ID NO: 532617 - DNA, 823 bp, Homo sapiens
gagacataatttagtctattgcacttgccaagttgcctcttatgctactgtgtgaatagaaagtaagataatatgtttgaaggtgtttccaaaactgggaagtgatatacaaatgtgaaggggtcatttttatttattcaggtctttttagttgatgtcatctagtagtgttaaaagagagctttcctatttcttaaacaatttgtattgagtgtaataagaacttggaagagaaagaggttttatttctagtctaacacattatatctatatataaataaagtatatatgagaagaaaacaattgtctcttttaagataatattattgttattgtactgtcttaagttacctctgggaaaagaacaatatatccaaataaaagacctagaaggagacagtaatcttccctaggtttgcatttgtttactctatttttccccaggactgtcttctatagaatttaccaagaattctctgttaggcaacatcatgccatttggagctattacagtctctgactgctacctttgtcttgcagggtgaaagttaagagcatttctaagtctgatttactgcattctgtgtaatcttatggcgatgcatcgtgttccggtcactggcgcaccactgtcaacacgtcgataacaattatcatgcacagccactgcatctagacaaatagcatgcagctctgtaattcactgtgactttctgactcctgcttgctacctggtatctggccattctcctgagcttcaattaaggaactgctgccaacccattaggaaccatgcaacaccggacaaatgcatgcgactatg

SEQ ID NO: 532618 - DNA, 190 bp, Homo sapiens
ctgcagagattcttctgcggtgccagcccgatataaaccctcacagctaccggaggaaggagggaggatgcgctgtggggttgtttttgccataagcgaactttgtgcctgtcctagaagtgaaggattgttcagtccaagaaactgacgttatttgatttatttaaatggctaagttttcttttttccc

SEQ ID NO: 532619 - DNA, 256 bp, Homo sapiens
gttgtccgcatcaccctctgtaacaccatacgatcgagaacggtaccattaccataccaagcagtaatgcagccagtcaagatgctctcgatggaacagctgtagaactttttgagagtttgagggcccatgccaaaccttctcaacctcctgagagagaaaaggggcggtcgcgacttcttcacaactgtgtgcgtgtgtaccattttaagtcctttgtgatttggacaccgaggtcgacgcggccgcgaattta

SEQ ID NO: 532620 - DNA, 322 bp, Homo sapiens
cacaatctctgatcactcgcagacctctgcgttcccgggttcaagtgattctcctgcctcgccctcccaagtagctgggatatgcaggtgcccaccatcatgcccagctaattttttgtgcttttagtggaaatggggttttaccatgttggccaggctggtcacaaactcctgacctcaggtgatccacccacctcaaccttccaaagtgctgggatcacaggtgggagccactgtgcctggccagttatttccctttagagcacaatggatctcgagcaaggagaggacagcgattctcgtacgaacggttacgattctg

SEQ ID NO: 532621 - DNA, 451 bp, Homo sapiens
agcggagaccgagtactgaccccagtgtctttccacctcctcctgcagcagtggctgctggagcagcaaattagcagctggcaacttgcaggctgcaccccgggacaagtccccagggatggtgctacagccgaagaggggtggctatgagagccaccggaagcgggtgtagtgtatgggaaggcgggcagacgcagcttggagaccatgctggatggacccgtgagacaaaacactatcgcagagcagagcattacgaagaaaaaacacacaaaagatagaaagatgagaagacaacatcagaaggacaggaagagaacaccaagagaagagaaaacaagaaccagagaagcaagaagaaaacgaaaaggaggcaggacagaaagacaaaagaagaaaaatgaaaaacaaagcagccaaagaaacgataacacgaaagaagacaaagaag

SEQ ID NO: 532622 - DNA, 663 bp, Homo sapiens
cacgcagccgcaggccgggaccttgggacgcagctggggagtcaggaaacgcgcgcagccagcccttcccgcctctcggactctccggaccgtctggcccgtcctccccatcgccctcctactctcccctccctgactccttcgctttttcccgttcctcctcctctcccggaccccgggtgccataaccatgtccgcgggggagattcgcgggaatcccgactgagaataacttcaacgttcggctgtacgacgcggaggagcagagccgtcatggaagcacggtcttctcgatttacgacgggttccacgtggtacagactcatgcgttcggaacatagctacaatacctaaagcaactccatttgcggacttgactttccttagtcaagacaaaccagtgttagctatggcattggacctctgcagcagggtcgcgacctttgacgacggccttcttgggagaacaagcaagcatgaggtacaccgcgacggagggagtctccctggcaaaagacaccctagaaatacgctcgcaaaggctaagccaagttcatggggggaccttcccagcagcgcttcggacgtagctagggatggcgttaggttacaggacgattcgaccaaaaatcgatcaaacatccccgttacccaaacaggaac

SEQ ID NO: 532623 - DNA, 331 bp, Homo sapiens
gcctgtttgggactttgaaaaaatctgattttattttctcaatcaaaatgaagctcttcatgttaatttagactgtttagctttccactgatttctcaagatactttccagatattaacagtcctcagaactgtgtaaaagttaacccccaaaaccatgttttaatgaaaaagtttaaatgtaagactaatgtcttggggactttactaaatgtttttctaaaaaaaacccttttcaaatgttaaagtttttggggaatttttatttttaaaaattttttaaatttttttaaattttttttggaaaaatttttaaacttggcccaattttg

SEQ ID NO: 532624 - DNA, 761 bp, Homo sapiens
agcgttgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaagagacaagtgattaatcggattttcatcaaaagacactgacttagtactgcttaggctgccataagcacaatactatagactctggtggcttaaacaaaagaaatgtattttctcacggttctggaagctgggattacaggcatgagcccgcgcacctggccctgtcactgaccattctacagctggtgatcgaggatgtgcacgcaagcctgggaactgatgacaaatgcatgagcacaaacctctctcgcgaacaactagccggcaaattcccttaaaactgaactgtaggcactgactgcccatgacccagcaccttataggtccctggaggcgatagcggacggcagtcgaaataataatcaacgaatcacacgtgaactaccccagtcatcatgaaacgacacggaaaacgacacggcaaccgcggagaatccaacgcgatcggaacccaccacaaccggacacgagaagcaactaaagcacacaacgcagaccacacacaaggaacaatggcaacccaccaatggacccagaccaaaccccccgcaaccacacagcaacaaacccgcaagccgaagcaccaccaaagaacaaccac

SEQ ID NO: 532625 - DNA, 1101 bp, Homo sapiens
tctggggggaaaaaaaaaaaagacgccccccacaaaacacgaggcgcgcgggcggggagcaaaaaaaaaagaggggggccgcaccaccaaacaaaaaaaaaacgagggggggcggcgccataataaaaactctcccgggggggggcccacacatcggcactgacacccaccgattatgtagaaaaagagagcgcgcgccaaaaagagaggaggaagggatataaataaacacacacagagggcggagcggcagagagtgaaaacaacacaacgagggcgacggggaggagaaaaaaaataacaaggaggggagagcaactgtgtggaggaagaagagaacacacaacactgggaggaggaggagagagaaaaatcgaggagagaagaaacaccaaaccaagaaaaaatacaacaaactcacgaaagaatagaactctcttcgcttctcccgacgggggcgacgagaggcggagcacacaaaacaagcgaagcaaatagtggagagcgagaagagaagagagacagcggaggagcacgagaaaaagaagaaaaaaaaaaaaacaatcacgcagggcgccccccaccatccagacacacaacaggcacaaaacaaaaaaaaaaaaagaaaaaaagaaagaaagtgaaagagaaaaggtaagaaaaagaatgaaaagaaaaaagaaaaaggaagtagagaaaagaaggagaaagggagaaatagaaggaagcgaaaataaaggagaagaggaagagaaaaacatagaaagaatagaaaaaaacagaaggggaaaaaacgaagaagaaaagcaagaaagaaaaaagaacacaagaagaaagaagcagaaaaggaagatagacgagaagaaaacgagaaagggagaggagaacagacacggcaaaagaaaagagaagggagcgaaaaggacagaagagaaaatacaaaggagaagcaagagagagaaaaagagaaagaggaggcaggaacaaaggagggagcaagggaaaaagagaagaaaaaaacaaaagcgagagaaagacaaaagaacaagtaaaaaggaaacagcaaggaaaggaagaggagagaagaaggagaggaagaaa

SEQ ID NO: 532626 - DNA, 390 bp, Homo sapiens
  misc_feature (319)..(319): n is a, c, g, or t
  misc_feature (327)..(327): n is a, c, g, or t
  misc_feature (383)..(383): n is a, c, g, or t
tttaaatgggacaagaattgctcactcggggagctcggtttttggagacgtgagctggccgatgctcccaggtgaataaagccctttccttctacaaattgttgtctgaggggttctagtctgtggctcatcctgctgcaacttcatccatcaagttaagaacagaatgtctgtcacaggccatgcatcctgactctcagtgttccttacccaaccataagttttctcaggtactttctccagcagttaatgctgttacttgagctgaaagaataaatgcctgatgtactgtaggaatttaatccagcacagggttttngatgattncccttaaagccgacccaaataggctcatgatggcaagggttgcttaaggcactgcntttaacc

SEQ ID NO: 532627 - DNA, 412 bp, Homo sapiens
  misc_feature (279)..(279): n is a, c, g, or t
  misc_feature (318)..(318): n is a, c, g, or t
  misc_feature (321)..(321): n is a, c, g, or t
  misc_feature (328)..(328): n is a, c, g, or t
  misc_feature (333)..(333): n is a, c, g, or t
  misc_feature (335)..(335): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (350)..(350): n is a, c, g, or t
cacagagtcgagtagcgtcaggcgaacacaagcaaacgtctcaggagggtctcctaccctcgtatgtaccgcggacgctgcgctcaaggaaaccttccgctagagggtcatccacctttctgtataaattataccagcgtcaagtgacatagataagaacttggcacacttcaaatcagagcagtgattctctcttctctccccttttccttcagagtgaatcatccagactcctcatggataggtcgggtgttaaagttgttttgattatgtaccttntgatagatccacataaaaagaaatgtgaagttttctttnacnatctttncattnancaancanagnccttngttggaagccggtttgggagaacccatttctaatttgaatgaaatgaaatctattttcagtg

SEQ ID NO: 532628 - DNA, 850 bp, Homo sapiens
acactcccttataagcaatctatagtgcctgatgatctgaggtgagacgaagtaccatgccaaagacacagtcgtacactgtgcccgctgcgttctgtggaataatcgtctaccacaagaagcagtcgctggtgccataccaggttgccgactgctgctcaataagataatcagcagattgctcatcagaaagactagaggtccatgaaggtcagtgggccaatatagttgaaagtagtaaattattaggtatattatctacattctgttgcaagtaacgtcaatggtaacatgaaggggagtagcatggaattaatcaattattttgggcaggtatggccatttttgcacggaatatcggttcttccttatccatgaacatgggatgtggtaccactttgtttgtatcctctcctattcccgttggtgcagtggttcagtacgtttctcccttgaagaggtccttcacatcccttgtaatttggtattcctagggtactttcattatcttagatagcaatttgtgaaatgggagtgcaactcatcatttggctctctgaagtctgaaattggtgtataccgaactgcttggtgatttctttggtaccatagattttgtgattcctcgaaaacttgtgccgaactttgctgtactcatgacgtaaaggagtatattgggggctcgaggaatgatggcgggaaggctgaaatataccattcatagttaatcctgcaacccatgaaaaccaattatgacttccctcttagtcctatttgaatatgccttctttctttcctgctggcctggtggccccggaccgggaatttccatacttttttgagagaacga

SEQ ID NO: 532629 - DNA, 414 bp, Homo sapiens
gcacggaacagggctgatgacagcaccgaggtagagagggaactagcttgcatccttcatgtcagccgaggtgtagatgatagatcacagtgttgggtgataagcaggaggtaaatgagtatagtatgttgtctgcacaggagggctatatgttctgggccataaagaaaggcagaactatagcttatctgcttcttcttttagtatatatgttctggaccatgaagaaaggcagacctgtagcttacttgctttccccttgtcctgccagcctgactccttttccctaattaggactccacaatagctctgacttcacttcaccttctacctaaagcctgtaatcaaaaggaagcaaggtctgatgatagcactccagcatatgtttttctgtggttattgcttgttccgctg

SEQ ID NO: 532630 - DNA, 838 bp, Homo sapiens
aactaagttatactttaagatgtctttaaacagccattgcagatacataaaactgtggaactgctcgtgtattcgtgatagtggatagtgcttgtggccaacttaaccagaattaacagtagaggcagcatcatacataaatctctaaagattatgtgtgatcgattaagacttaagataagttacaagaagaaattcacagatcatatgacaaaagacatgttcatggcaagagacaaagacatattctaagtagattaagtaattacagatgtgtcaagactatacagttctaggatttatgatgtagtcattaagttcatcaaatactataatgaaatatgtaatttaacttcaacataatatttagaaattatatccatatattcaacaagtaattattaagtgtatttatgtgccagataccattctaggtgcctgggatgcatcagtgaacagaatacatctagtgctgcatgagggagcttcttattagtgaaggcggacattagacacagatgtatacaatgagtcattgaacaagataatgcaggcagagatggcttctagtgaaagacctaaactcagggtgatgagagggaacagtgaccgagagacagctttaggtggatggctaaagtgaggcttggacgaacatgataattcatgtgtgacctgattgactgaggataaatgtagaagagtcagaggctgaggattacaggccaggaatagcctgtgtgctatgtttgtgggacattagccagaatatgaaagcgtgttaacacaattggatcttcagaaatggatgaaggcatagcctgaggaaaagaagaaa

SEQ ID NO: 532631 - DNA, 1207 bp, Homo sapiens
aggtgccgacgaagtctcacaacataatccccctggaagcgtgaccatgtacaatggatgacacgtagctgtcagttgaagattgattacacttgctggcgttactaagtgggtgacatatgtgagagagcgaagaatgaattaacgaagattttcgacgacaagtaaaaggaattccgccttcagcttgcgatttcgtaaatttgaggctaagtctcaaagaacgatcatattgtatggaataatagtgtggatctggagaggacctggtcgcacttcctattgacaggcgttcttggagggaaccaattacagttgcaggtccgaccgggcggcggcccaaagttaggcgcaaaggttgcaagcagtagcgtgcgcttagaccttgttgtcctgtaagagaggagtccctggggttcaatggacttcagggtggctaagcgacatttccttctgcacaaattaatcaaaaaagcggcctgcggacgcgaataacacggtggaggacggatttcttcgagagaataacatacggatgagttgggaaggtaaacttgtatgattaccatttgagctagggtagtccttacttcggaggcaacggaagtttgccaaaaagcaaaagggatgcagtagggctcttacgattggatataccaccgcgttggtgtgggaaatttgggtaagcatttaacagggaagcttgttgcatccagaaacgctggcattctaatcgaactggaccagggatggggacagaaccaacaaatttgcatatgtacaacaattccaaataatcccgccgttcctttccaccaattggggcaagacgggaaccgaaggctggaaaggacacaactcctaggttacttgtaccagggaacctttcgatcagataacttgtggaggggaagcgtcctggggacgctggtgacgcatctcccattgtaccaggtgtttaaccaatgccgcggaccaatctgacttaaaaatggcttccaccgccagcaagaagaaacaaacataaaacgagacaagacaaagacacattgctgaggacccacgggcgccacgagagaaaggataaaaaacgcacaccaagtgaagagggcagggggaacacatggagggaacggagaagcggggacaagaggggaaccaaagaacacaggggacaagagcaacggggtgggaacaacgcaaaaaa

SEQ ID NO: 532632 - DNA, 379 bp, Homo sapiens
cattggactgtaaatctaaagacaggggttaggcctctttttaccaccaaaaaaaaaaaaaaaaaaaaaaaaaaaaaaaaattttggggcccccgggcacccgcgaaaagactgtctaaaaacattctgggtggggcggcgcggcgggcccacgaaaggtgattaggtggaacaggggcccctaggcggcgtcccccgaagggaaaaccggggccacagagacaacaggtggcggggttttccaccccaaaataaaaaaagcgccgcgggggaaaagcaggagcggtctctggcaaacaaatccaaaaggggaacgttccggaaggaacaaacgggggctctcaaacacaagagaggtccaagggagacaccggaaata

SEQ ID NO: 532633 - DNA, 235 bp, Homo sapiens
  misc_feature (45)..(45): n is a, c, g, or t
  misc_feature (112)..(112): n is a, c, g, or t
  misc_feature (174)..(174): n is a, c, g, or t
cggcgggaaatcggctgtgggagagaggctaggctctgaaggagngaatccggcgggtatcagagccatcagaaccgccaccatgacggtgggcaagagcagcaagatgctnagcatattgattacaggatgaggtgcatcctgcaggacgggccggatcttcattggcacctncaagctttttgacaagcacatgaattttgatcctctgtgactgtgaatgaattcagaaaga

SEQ ID NO: 532634 - DNA, 722 bp, Homo sapiens
  misc_feature (36)..(36): n is a, c, g, or t
  misc_feature (71)..(71): n is a, c, g, or t
  misc_feature (115)..(115): n is a, c, g, or t
  misc_feature (139)..(139): n is a, c, g, or t
  misc_feature (144)..(144): n is a, c, g, or t
  misc_feature (154)..(154): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (185)..(185): n is a, c, g, or t
  misc_feature (192)..(192): n is a, c, g, or t
  misc_feature (194)..(194): n is a, c, g, or t
  misc_feature (200)..(200): n is a, c, g, or t
  misc_feature (214)..(214): n is a, c, g, or t
  misc_feature (226)..(226): n is a, c, g, or t
  misc_feature (239)..(239): n is a, c, g, or t
  misc_feature (241)..(241): n is a, c, g, or t
  misc_feature (246)..(246): n is a, c, g, or t
  misc_feature (481)..(481): n is a, c, g, or t
  misc_feature (517)..(517): n is a, c, g, or t
  misc_feature (533)..(533): n is a, c, g, or t
  misc_feature (567)..(567): n is a, c, g, or t
  misc_feature (693)..(693): n is a, c, g, or t
cggtgggtgggaggggggttccacgtggagcgcggngtgctatagagagccggccgttctccaggggtganctggggaggcttctgcggttcttgtgagttccggcgatggcgcnagttccccagctaaccccctccanagctncccccggatnctcagacaagnanggngcttgggagttactngaggctntnacgggntcgccctcggtgtnggcaagtgagtnctctgtggccaanangtcanagtcgtccctgaggctgagtcgaacacagacccgtggccctcataaaattaaacataaaagcacaaaaatggcgcaaccagacagcattggcttcagacaggcaggacacggggcccctcgtgtgacctgttactttccacaaagtggcaaggtcctggcactgacttccggccagttgagaaggctgttccgcccacccggccatgactcagacccagaggctgatagcacatnacggggccgcaggcagcatgcccccgggctctcgtnaaacacttcatatggnaaaaatcctaaggaacagaatcctgaatggaganaacctcatacttttttaaaaaagaaggaagtgtatgaggggaatctacggggtgggttttctttaagaggtgagatcttggaatcttgcaagcactgggagtggactccggcggcggcgcagacgngagcagtggagcgtcctcgggccacctgc

SEQ ID NO: 532635 - DNA, 353 bp, Homo sapiens
gtagcctgaagcctgacgtgtactcctacgctccattacgatgctggacttccagaaccatggtagccttcagtgagatttccatcttggctggtcactccctgactgaagctgtaggtgaatgtgttgttatgtgtgtgtgtctggctttagcgtcacatgggaaataacagtgtaaggaggacactttaaaccctttgggtggagtctcgtaattctgcagactattttcaagcgacctggtccacccaggattagtgaccaggatttcaggaaaggattagcttctgtctagagaatgtctgaacggattgtaccttctgatgaggctgcatgtatactattttgtcttt

SEQ ID NO: 532636 - DNA, 523 bp, Homo sapiens
acggtccaccgacggggtgggaagggtgttaaaaagaacaaacaggccaggcgcagtggctcacacctgtaatcccgagcactttgggaggccgaggcgggtggatcacgaggtcaggagttcaagaccagcctggttaacatggtgaaaccccatctctactaaaaatacaaaaattagccgggcttggtggtggtcgtctctaatcccgctcctcggaaggctgaggcagataattgctcgaacctgggaggcggaggttgcagtgagccactgcactccagcctgggcaacagagcgagactccgtcttaaaaaaaaaaaaaagacaaacaaaccaagtagggggatatcattaaccaatggaggacgggctccctgggtccccggccagggcctgcagggaaacgtaagggccaggtaccttttaaacaaagccaagtcatcagggccctcccggtgtcagagacgctagagttcgtcaaggaagccgggttacctatgggcaccgcctagggaagtga

SEQ ID NO: 532637 - DNA, 243 bp, Homo sapiens
  misc_feature (34)..(34): n is a, c, g, or t
  misc_feature (65)..(65): n is a, c, g, or t
aggtgcagattcatgaacagcagctggatctgangcatcagtctgcatcttagggatcgctcttnctcacacacgaatctgacattgctctcttcttgcttacaatgcctaggtcgccactgcctgctgcagagaaaacacactcctttgcttagcccacaatatctatttcacttgacccctggccacctctccaaactaactggcttacttcctagtcctacttgtggctgcaatcacact

SEQ ID NO: 532638 - DNA, 564 bp, Homo sapiens
ttctcatggacagtgacacattctgtctagcttgagagactaagctctgattattattttgttttatcttgcccaaattcctttctaaggggtctggggagtcatgccctacaaaccataaattctcatcagatgagttttatttaaccctgtataacgtgacttactttccagtctgactcaggcataacaaggaagaaaatcaaaatgttttaccctaaaatatatttctttgccataccttggaactgtcctgcaaagtctcttgtgggaaaaacccacattctatagagaattccctttcccctttgttttccttccttcctttccagatccaggagataatcaattaagagccaggcactctttcaggtctcataagaaacattttacaacctgctatctctgaagtccgctatctgagagctctgcaaaataaaacttcgtctccacaatcctttatcttaacctgaacatttcctttgatcttaggtcttgagataaactcaactaattgtcaaccagaaaatgtttaaatttacctatagcctggaaacccctgct

SEQ ID NO: 532639 - DNA, 285 bp, Homo sapiens
tgcgagagtgttctacaggatctcctcactcactcattccttcactcatccagccacctaaaaacatttactgaccatgtactacgtgccagctcgtagtttacagccttgcggaggttttattcgtgacttcctctagattttaggcatgtgtgagacactcctaataagagagagttcaacgcctgtggcgagtagacaaaatctcacttcccagacgtcagaggagacagagacctgtacccttgaccactcgtccgagtcgtaccgtggtaccgagtctcg

SEQ ID NO: 532640 - DNA, 511 bp, Homo sapiens
ccccccatcggcaggtgtactcaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccatgattgtcagattcaccaaagttgaaatgaaggaaaaaatgttaagggcagccagagagaaaagtcaggttaccctcaaagggaagcccatcagactaacagcggatctctcagcagaaaccctacaagccagaagagagtgggggcccatattcaacattcttaaagaaaagaattttcaacccagaatttcatatccagccaaactaagcttcataagtgaaggagaaataaaatactttacagacaagcaaatgctgagagattttgtcaccaccaggcctgccttaaaagagctcctgaaggaagcactaaacatggaaaggaacaac

SEQ ID NO: 532641 - DNA, 208 bp, Homo sapiens
cgcgctcggtaccccacttatgcgtgtgccacctccagcctgggttacagagcgaatccgtctcaaaaaaaaaaaaaaaaaaaaaaaaaaaaagggttggtggaatccgggggggggagcctatgggtgggtgggttgggtggggtggggaaatgggtccccctggtattgggaaaatctggggtgggtacccttgtggaaccctttt

SEQ ID NO: 532642 - DNA, 119 bp, Homo sapiens
tgtgtagtgtctagaggatccagagaaattttctgaagaggtgaattaaactgatattcaatgacaagaatgatgtggaaaatccggggaaataacattctaggcagaggtgatcttct

SEQ ID NO: 532643 - DNA, 213 bp, Homo sapiens
tacgaggcctcgtgccggcggctgcggcggcaggaaatcggggctcggtcccgccggcgcgcgaccccatccccatcccggtccctgcatagcgatccccgggcccatatatggacgcagcagagccgggactccccccatgtcctgatggcaggaataggtacattgacatctttccggagcctggacaacctcgaaatctcactggggaac

SEQ ID NO: 532644 - DNA, 472 bp, Homo sapiens
aataacaggtactagcacagcaggccagattgggagttggggacacatgacccttgtctcaggctttgggagctcttggggtatgggtagggggtcagggggacagacgttagccaagaccgaggaagcagcagcaggtacgggattccccctttccccggtgctcagtctttgcccaagccaaggccccacaggcccaggaagggggacgggtggcacgtagcttctccggggccagggcaggttaggacacgggctctcagagcctgggtctgggcccagcagggctgttcctggagaaacaggtgagctggttccacagagctcagcagccacacggctaaggggccacgggctgggcactccgaaggtgccgaagctggcgaggggaggcatcccgtactgaatgccagagcccatcctctccgggtctagctcgcctgagtcaatcttgttgaggattggcgcagag

SEQ ID NO: 532645 - DNA, 670 bp, Homo sapiens
gacacgtccatgatgattttgggacagcgatcaatgtggcttgtggatggtgtgaatttgcaggggttctctccacggaattggaccaggaaatggggactgaccatggatagtgaaaattggaaggaatgcataagatggtggttgaaagtggcctatgagagtctatccagcttaaaggatatacccactgggctattggattaagtgtggctgatcttattgagaacccatggtgaaaaatctatcccggattcatccccgggtccaccatggtaaaggggatgtatggccttgagaatgaagtcttcctgagcccttcccaagtgatcctccatgcccgggggttaacccagcggtatccgacccagagagcttaaggatgatgaggttgctcagctccagaaaagtgccagataccctgtgggacatcccagaaggaccttaaagaccctgtgactagtgagctttaggctgtaggaattttaaaactaccaatgtgattaactcgagccctttagattttcatccaaggacctggatcaccgatttgctttgatctttttccatatgtgaatttgggctcaccagaatccaagcctatgcttggtttaatgccttgccatctgagctccttggaccaatataaattaactattgttagtgtgga

SEQ ID NO: 532646 - DNA, 101 bp, Homo sapiens
cccccggggggtgattttttcaaataggggccgagggattgggggcccttggggactcaacaaaccctgggtttagcattttgccggttttattttcaaaa

SEQ ID NO: 532647 - DNA, 189 bp, Homo sapiens
tcctacgagcgcaccatgaattatatatttatcatccttattttaatagtggtatccttcccaatgttaaagaaacagatttacttattattttaggaggacccatgagtcctaataatgaggataaatggatttttgaagaacgagaattaattcgcaatttaatacagcaaaataagccaatatttg

SEQ ID NO: 532648 - DNA, 332 bp, Homo sapiens
tttttgagtctcactctgtggcccaagctgaagtgcagtggccaatctgagctcactgcaatctccacctcctgggctcaggcgatcctcctacctcagcctcccgagtacctgggactacgagcgtgtgccaccatgcccagctaatttttgtatttttagtagagatggggtttcactatgttggccaggctggtctcaaactcctggcctcaagtaatccacccgcctcggcctcccaagtgctgggattacaggcatgaccactgtgcctggccagactgaatgatttttaaaacacgaataataacttgcaaaaagggggtggtgtg

SEQ ID NO: 532649 - DNA, 306 bp, Homo sapiens
cacactcgcggcagtgtcctacatgctagctggacattggggatctgtagtttccccggtagtccccttcagtgactggtacatgatcactgagatctgcactaggaacctgtgtgaccctcaccgctacaacatcctggaggatgtggatagtctgcatggacctgtatacccggaccacctcgtccctgtggaaagacaaggcagcagatgtaaatcaacgatgagacgtgctgcacagttaccagctagtccctatgtcaccatcgtggaccacctagcgaccgccagcggactctttcatga

SEQ ID NO: 532650 - DNA, 104 bp, Homo sapiens
agatactcggacggactgacggactgacggactgacacgactgacacgactgacacgccggatccgacgcttgggacgacgggacgacacgacgcgaacgatgg

SEQ ID NO: 532651 - DNA, 112 bp, Homo sapiens
aactatcttacattctagggataaatcccacttgatcatggtgtacagttgttttaatgtgctgttgaattaattttgccttgttgccttatcttcttccaaatgtactgtt

SEQ ID NO: 532652 - DNA, 549 bp, Homo sapiens
atacgctctagacggggttcagcgtgtagccaggatggtctccatctctgattcgtgatccgccggctcggcctcccaaagtctgggattacaggcgtgagccactgcacctggctagactttaaaaaaaaaaaaaaatacggggggaaaagggatattatgtatagaaaagtctacacttctggatacaactaactaaaaaaagccggatacactaaacaaaacccaaataatgtctcccctcaaaagggggtaactggaaaagcaattcgagcaaaaatcagggagtccaattataaataagtatatcaccaaggtgaaagaggggtttaatttttcccacaaaaggttaaaagaaatacacagcagttttagaggaagaggcaaaaaataataagaaaattatatgcgagtggcaaaaggtgtgactatttcacaaactctaacatatacactacaaaagggaccagaagaatcattatcataggaagcaaggggtcatttcaaaaatcagaggagggatgatccatatttaatttaattcggtgg

SEQ ID NO: 532653 - DNA, 314 bp, Homo sapiens
ggaaaatatggtggtcgcagatgtgtataatcaccgattgccacaaaaatttttccaaattggatggagggtttaaaccacatcatgcctcgggatgacatttttcgtgtacgaggtctgcagcacttccgtggatggctcggatgtgttcacggttcccgtctacttcagggggagggaggccccggccctcaaggacttttccccccttcaacgcttttttgggagacacctagcctttttttcccccagccacaattaaccctgtggattcttttcccgggttttttgttatctttaacgccgtaatttaa

SEQ ID NO: 532654 - DNA, 1120 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccaatagcccatgcttccgtgggggtgctggtgccagctgggctgggtgtgggttctgtgtccttccaggatatgtgtcatttcccatgaggggccggggcaggtgttctgggtgggggctcaggtggcagtatttttacgttattttggttagcctgtgtgaggtggcaattgtatttgcttaaaatccaccctattttatccttgtt

SEQ ID NO: 532655 - DNA, 108 bp, Homo sapiens
gaggcgcgacggagagagcaacgacccccacgagaagacgaaggggaagacgcgcgagggagccgaggacaagatgaccagcggcgacagggcagtccaaccgcaaga

SEQ ID NO: 532656 - DNA, 359 bp, Homo sapiens
ggggtccagggtaaacccccccatgtttgggctcccccggggcattttttggggaggaccacccgtcaaaaagcgtttaggatccggaacccttctgtttggagggggcggcccggcaggagcgcgtttagggactaaggaaggcttggagaagcaatttgaccaagatcccatccctttttttttttttcggaaatggagggggagtctccctgtgttaccccagctagttttgaactcctggcctcaggtggctgggtgggggcacaggctggagtattcttagttctactggttctacactgtgaggtggcaatgggatttgctcagatgccacccaataaaatgcctgttactta

SEQ ID NO: 532657 - DNA, 870 bp, Homo sapiens
  misc_feature (55)..(55): n is a, c, g, or t
aaaaagttgcgcccaagtgggtgtaaaggaataatttgtctaatcctccttttgnaccctagtggtttatttcgccgcgacacttttattgcgccgcccctcatctggggggccggcaatttttctgggaccaaaaaagacaacaaccaccaccgtcgctgtgttgagaagcactgagttggccggctgttcccccctctcttatgggaagtgtctctccttgatggagacgacctcctgctgatatgcgcttcttacagaagggagttgtctcgatcacatacaatctctctctcggggggggaccgccaccagttaatgtctttatgcggaggtattctttccctcttcatggctgccacaccccccgcgcccccccttatttttggagaagcaaaattttaaaatggagtgaattttactccacgagaataatcccccttccacattcgcggtgacacaaattggtgatagtaataaatattgcgggttcatactcattaaaacaaccgtcgccacgacctcaaaatttgtgttgaaaaaataacacgtaaattcacaaaaatgatatttttatctcgcacgccacttattgagaattacaaccacactggcccacatgaatttgggagattttaaataatctgccacaaagttgcagatttatattcaaacatccacttggaataacacccttgagcaccacatcccacccctgtaatatgagaatttgtaaattaacctgtcaccacgcggtaattgaattctgcctctattgttagttttctccctccttaatttgagaaaaaggccccacacttttaaatatttttttccccaaaaaaaacaaacaattgggtaaaaaaaaaa

SEQ ID NO: 532658 - DNA, 115 bp, Homo sapiens
tccaactgcaccacgaaaaaatctccctccctattccctccttccctagccaggagacaccacacacctgagcacactacactacccacccgtacactccacagctacggagagg

SEQ ID NO: 532659 - DNA, 1243 bp, Homo sapiens
  misc_feature (36)..(36): n is a, c, g, or t
  misc_feature (75)..(75): n is a, c, g, or t
  misc_feature (78)..(78): n is a, c, g, or t
  misc_feature (281)..(281): n is a, c, g, or t
  misc_feature (986)..(986): n is a, c, g, or t
  misc_feature (1098)..(1098): n is a, c, g, or t
gacagaataaaacacacaacaaaaaataaaaaacgnttaagaaagaagaaaaaaccagaaaagttttaaaggaancantggacagcacgggagcaaaagaagaggtaaggagagggggggtttgtgtaattccgttatttctatatctatccaggagtgttgtcgcagagcagccaccgacgatttcagggacgcgagggtcgtgcgttctacgaatcatccgaattaacaaccatacgatgacgcagtgtctggcgaacccccgatacgagagcggcganccgagcacaaaaaagcaaaccgaagaaataagaagatcatattagcttcgttagcagaagcgcgacggaagcgagtgcagcccccggagatgatcatgatggtaagtataataaaatgagtataatggagcgcgggtctgtcgtatttacttgggcaggcgggccggatatcgtagccacgacacatagatcatccacccaaccgcgcccgcgcgtttatatcataggtgtgtatcgattcaaaaaaaagaaaagttagagtatacagtacaccgtctttgcgcgtcacacgcacaaaacgaccggacgtaattacaagaagttgaaaccaacacagaaatcataaacagcccaagtattatatagggaaacgcgctgcagttgttagcgatgccgcgcgcgtgcaataccgcgccgaagtacccggcgcccgctcgtgctaccacatgcccaaggttcgaatcgcgcaatttgacgcggatgtgccggcggtagttccttctgcggacgggagtaggtgaccagcggcggggtgcgacaataggagcgagagattacttataaaccgagcaatgcgcatgcgcgtctaatttatataatgcaatgataaatagacaaaactgtgattactagagtatagaagagttatatattcgagaagacggatatagcatgtcgaggcagtcggtgcgtgcaggagtatantcgcgggaacagccgcggcgtgcatacaaccggtgtaatggtgtacatcacactcgcagcaccgcccgcggttaatattaattaatccataaccgtaactcaccacagtgantacgcgtggtgccacgatagattccgacgttcctcgtagagagctgcgattctcgtatctgatcaattccgggacgtatagcgtctatgtataagatagagacgcttgctgtattaggttaggactagagaaacacataaaattg

SEQ ID NO: 532660 - DNA, 856 bp, Homo sapiens
  misc_feature (625)..(625): n is a, c, g, or t
gttgagcagaggagtgatgtaatctgacttaaccttttagaagaatcactggctcctgggaagaaaatagactgggtatgtgttatacagcaagaatagaagcaggagacttctgcaattccttttcctaattattcagctcatagaagagccattatatttttatttcagagaaacaagggagaagttgcatttcacttaactaggatattactgggccttttaaaacaccctaactgctgtttagcaaattttataagcatgattaatatgcttgtgactctagggttgtgctgttcaatacggtagccacttgcctcatatgccttttaaatgtaaaattagatgaaattaaaaatcatttccttagtcacactagccacatttcaagtgctcagtagccactggtggctagtgactggcatattgaacagcacagatatagaatatttccctgtagctagttactggacacctctgctgaagggcttgggtagggcagctcacgcatgtgaatattaatatagtataggtgatggtgcaattcttgaactgtgttttaattagtccaatctaggagaatagttttttaatggggtagggtaatctcttgactttgggcaantggggcgtgggccaattcaggtgggtacttgagaaggaaattttggccgaagatgatcaggtgttcttatgaagctacggtatgaacttcatcgaagcggactagaatggtacgggaaacggccgggggataccttaaataccgcattgctgaggtctcaggagacttatatataagccccttttaggcccccacttgcagagggaggtcaccaggtgccccaccgtccct

SEQ ID NO: 532661 - DNA, 2189 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgctggtttaggccgtgattctggaaaaccttggatgggccttcgtcctatgtcagccttccctctgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactta

SEQ ID NO: 532662 - DNA, 759 bp, Homo sapiens
gtacccacaggaggtggttagtcttccgttgccccgatgagcttcatgctcatctttggcatggaaggcgagtgccttccgcgcggcacaggggatgtccagcatcgccgatgtccaagaaacgtcgtgtgtctgggcctgatcacaaagccgggttctaactgctcccctgcaccagtccgtgtattgtaccgaattgccctcgtgtgccaagccaacggcatggaacaagaacggcagtagaagcagacatagacgatgggcctttactcccggcagctgtatgtgttggtgccatgagtgcaatgaagcggctccagaccatccagtgtcctgtttatcaggcctgcggggcctgtgtcgtggagatcgctaagaacatcatccttgagaggttgtcaaggactgttaccactacatgaccaagggcatgcacaagatggggctgaatacatatcctcccaagttactagctgcatataatgacagaatacagaaaacacacgaagacaaaagacatcacatacacagcatatgaataaaactcaaagaaagataatactaccatgtacaaaatgctaaacagcttggagacaccttctaatgaatggacaatacatatatattgaattaccaagagtgcatgattgatcaccaacaaccacccagtgaatgacataatgcataattgcgtgagaaaaggcacagaacagacaaatccagaatgaatacatgaagaacttacgagactgtatagtt

SEQ ID NO: 532663 - DNA, 796 bp, Homo sapiens
  misc_feature (41)..(41): n is a, c, g, or t
  misc_feature (87)..(87): n is a, c, g, or t
  misc_feature (98)..(98): n is a, c, g, or t
  misc_feature (113)..(113): n is a, c, g, or t
  misc_feature (115)..(115): n is a, c, g, or t
  misc_feature (118)..(118): n is a, c, g, or t
  misc_feature (130)..(130): n is a, c, g, or t
  misc_feature (162)..(162): n is a, c, g, or t
  misc_feature (179)..(179): n is a, c, g, or t
  misc_feature (189)..(189): n is a, c, g, or t
  misc_feature (195)..(195): n is a, c, g, or t
  misc_feature (210)..(210): n is a, c, g, or t
  misc_feature (227)..(227): n is a, c, g, or t
  misc_feature (234)..(234): n is a, c, g, or t
  misc_feature (248)..(248): n is a, c, g, or t
  misc_feature (251)..(251): n is a, c, g, or t
  misc_feature (258)..(258): n is a, c, g, or t
  misc_feature (264)..(264): n is a, c, g, or t
  misc_feature (325)..(326): n is a, c, g, or t
  misc_feature (345)..(345): n is a, c, g, or t
  misc_feature (353)..(353): n is a, c, g, or t
  misc_feature (364)..(364): n is a, c, g, or t
  misc_feature (370)..(370): n is a, c, g, or t
  misc_feature (401)..(401): n is a, c, g, or t
  misc_feature (431)..(431): n is a, c, g, or t
  misc_feature (446)..(446): n is a, c, g, or t
  misc_feature (469)..(469): n is a, c, g, or t
  misc_feature (489)..(489): n is a, c, g, or t
  misc_feature (517)..(517): n is a, c, g, or t
  misc_feature (524)..(524): n is a, c, g, or t
  misc_feature (544)..(544): n is a, c, g, or t
  misc_feature (556)..(556): n is a, c, g, or t
  misc_feature (561)..(561): n is a, c, g, or t
  misc_feature (567)..(567): n is a, c, g, or t
  misc_feature (575)..(575): n is a, c, g, or t
  misc_feature (586)..(586): n is a, c, g, or t
  misc_feature (598)..(598): n is a, c, g, or t
  misc_feature (604)..(604): n is a, c, g, or t
  misc_feature (631)..(632): n is a, c, g, or t
  misc_feature (651)..(651): n is a, c, g, or t
  misc_feature (731)..(731): n is a, c, g, or t
  misc_feature (736)..(736): n is a, c, g, or t
  misc_feature (742)..(742): n is a, c, g, or t
aatatagttcatattattgtttttaaaaaattttatttttntataaaaaaatataatatttaaaaataaaaaaaaaagaatccaacntgtgcataacntttggtcaatatgtncnatntataatatatanaaaaaaatacttgaaataaagtgaagttattnatgaaaaattagccatnagttttcttnttttanataggtatctaaagnctatatggacttatttntctgatntatttttggtgatnttnaagatgnttcttntgtggcagctttagctgatttttgtatttggctttgctaaagatattattagagttaaaanntatgcttctttgctgggtnggtttttnattgggatttngagttncatattttgttacctttttcgatagctaganaggttaagaaaaagtgtttttttaaaatanataccctgtggtttntaaatgctatatgaaaaaatagnctaattgtaaacaaaatttngctgttgaaaaaaaaatcaatttggatntaacagnctaagtaacagaactattgngtgttccccttnacaanactganttaatatnaggcttaaganactcttcccatnattatnttacttccctgctggcaaatttaaacnnatttatttaatcagtgttntcaggttgaatcaagtacacttttgaaatgtaaagccacaacagaaaaatacgttttaagaaaataaggcattggccagngaggnacctcntcgtctgaacaaagaccttgtctactaatactgagcaaacccacatctgggccc

SEQ ID NO: 532664 - DNA, 2503 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgctggtttaggccgtgattctggaaaaccttggatgggccttcgtcctatgtcagccttccctctgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttacttaaaaaaaaaaaaaaaaaaaaaaaaaaaaaaaaaaaaaaaaaaaaaaaaaaaaaaaaaacaaaaaacaaacaacaaaaaaaaaaaaaaaaaaacaaaacagaacacacaacagagacaaaaaaagagaacagaagagaacacaacacacagacagcagggccgcgcgcggcacgagcacgcagccacgactgaagtgccactccatccacccctgcgcctgcgccggccgccgcccgacccaggccgaggtcgccggccgacggggaggcgcgctcgttccccccgcccactgaccccgccacaccactggcgcca

SEQ ID NO: 532665 - DNA, 537 bp, Homo sapiens
  misc_feature (529)..(529): n is a, c, g, or t
cgggaacctgggggattcaagcgcaggctgtcaatcattgtcactgtgcgattggtggtcatgatccttcggatgatactggctatctgtctacacaactgtataaaggccggagtcgggctgtgcatgaagcgacaaattcccactgactgtgtgatactggaagtactaggactattcactcaagccgctatgttgcactgctatacgtgagcttgaatgaggatagaatgcaagggactgcacatgttgatttctgacactgaataccctggtgttatgacaggtctagatatgagcagttagaaccattagtattgtggaaatgacatgagcattagacactatgtgatcgaacggactggaccacacccgattccacgatatgaagggtgcgcccatggtcctcttgcgcatatcatgctgtacattatagattccgtactcaaggtgtcaccatgatcttcaatcgaaaacaaatgggactatgtcgtaactagcagtggctacagcgagcgattatgagtcntattgtgg

SEQ ID NO: 532666 - DNA, 2135 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgctggtttaggccgtgattctggctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactta

SEQ ID NO: 532667 - DNA, 2476 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgctggtttaggccgtgattctggaaaaccttggatgggccttcgtcctatgtcagccttccctctgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttacttaaaaaaaaaaaaaaaaaaaaaaaaaaaaaaaaaaaaaaaaaaaaaaaaaaaaaaaaaacaaaaaacaaacaacaaaaaaaaaaaaaaaaaaacaaaacagaacacacaacagagacaaaaaaagagaacagaagagaacacaacacacagacagcagggccgcgcgcggcacgagcacgcagccacgactgaagtgccactccatccacccctgcgcctgcgccggccgccgcccgacccaggccgaggtcgccggccgacggggaggcgcgctcgttccccccgcccactgaccccgccacaccactggcgcca

SEQ ID NO: 532668 - DNA, 2157 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgctggtttaggccgtgattctggaaaaccttggatgggccttcgtcctatgtcagccttccctctgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccttgtaccgggtgattttccatgtattgctattgcttgtttctggtacttggtctgctataattatagatatgatactgtgaatacttttttaagttgtattatttataggatc

SEQ ID NO: 532669 - DNA, 705 bp, Homo sapiens
ggtcccccgggctgtaggaattcggcacgcgatgggatgttcctgctgtgttatgccgcgattctgtctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactta

SEQ ID NO: 532670 - DNA, 1528 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgccgtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttacttaaaaaaaaaaaaaaaaaaaaaaaaaaaaaaaaaaaaaaaaaaaaaaaaaaaaaaaaaacaaaaaacaaacaacaaaaaaaaaaaaaaaaaaacaaaacagaacacacaacagagacaaaaaaagagaacagaagagaacacaacacacagacagcagggccgcgcgcggcacgagcacgcagccacgactgaagtgccactccatccacccctgcgcctgcgccggccgccgcccgacccaggccgaggtcgccggccgacggggaggcgcgctcgttccccccgcccactgaccccgccacaccactggcgcca

SEQ ID NO: 532671 - DNA, 1454 bp, Homo sapiens
caccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctgggtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttacttaaaaaaaaaaaaaaaaaaaaaaaaaaaaaaaaaaaaaaaaaaaaaaaaaaaaaaaaaacaaaaaacaaacaacaaaaaaaaaaaaaaaaaaacaaaacagaacacacaacagagacaaaaaaagagaacagaagagaacacaacacacagacagcagggccgcgcgcggcacgagcacgcagccacgactgaagtgccactccatccacccctgcgcctgcgccggccgccgcccgacccaggccgaggtcgccggccgacggggaggcgcgctcgttccccccgcccactgaccccgccacaccactggcgcca

SEQ ID NO: 532672 - DNA, 1359 bp, Homo sapiens
gtgatcgccatcttagggagtagatgttctcgtaccgtgcgagcacctgtgcgcgttgcgaaccccttcaagacgccacatctgcagctcggtgcacgatggtctcaggaggacctccgcagcaacatccccagtggaccacgggccaagccacctgccgcaatcgacaaccctgtgcagcctgcccgccgtgagaaagaagtaccagtttcgtgcaattttggctcccgcgcaaggtatctatgcaactagctgtggctctacgagcatagcgcgagtctataaagcatctgatggaatcctgacacacaaccaccatgcatgctgcacatatccacactgacgaatcttgacgagtagaaccttgcacagataattgccacagcttggcacaccgcaccaaagaaggtacacaacggagcaactactatacaacggcaattccttcaagctttaacacctttaacaacgacggacgggacttgggttcgcttaccgatacggggacatcacggagccgtcaaaacaagtcgactccggcggacatccagcgaacacattattaccgttctgcagccctataactcgccaaagttgacaaacgaggggcaccacctcctctgcagcaaaagatcttcatgaaccacatcactagaaactcgaaaagcacgtcattctacaacacggtcccattagcgtaaaacttcacccccacacatctactcgcccactattgactgacaccacaggccgcacgcaacactacccctacacatttcccatcccattagcacacaccaccaccccaactcgaaaccagccacaccaaataactccgcaccacactaagaacacgaatccattctgacaccccacgcactgtccctgacacacatcatctaccgcgtcatctccacacgtggccacacacatattgccacccacaacacgaccacccacaatataacctccagaacaactccctatatactataacccgatacatttcacagaaccaacatcatccccaacacaaccccccacaaacaagtccctaacgacatatctaccactcgcaccaccaacaacccacatcccttaatattgacaccgagagtcgacataatatgcacacgacaatatcccacgaccaaatcacgatatgtacgcagcaacttacatcactgaagaaatcacaggcaactatacggtctctctctacacaacacacaacacacatatctgtcatatacccacacaaccgccataaccatcgacctactagcaacctcacacccctactcttcatcactagtagtcaatattaaatctcaacgacagctaaaatttacaccgtag

SEQ ID NO: 532673 - DNA, 107 bp, Homo sapiens
tcccaaacctgtcacactttttcttttattttttttgagaaaaagttctgctcttgtaacccaggctggggtacagtgacacaatctcagctcactgcaacttctgc

SEQ ID NO: 532674 - DNA, 814 bp, Homo sapiens
gtgcagtggtataatcatggctcactgcaagactccttgaatccctgggctcaagcaatcctcaacccttagcctcccgagtagctgagactacaggcaatggaccatgcccagctaatttttttttttttaaattttggtagagacagcatcttgctatgttgcccgggctggtcttgaactcttggcctcaagcagtcctctcgatcctcccaccttggctcctaaagtgcttgagattacaggtgtgagccactgcatctggcttacttatttggtctatggtctgtccactagtatgtaaagtcttagagagcaagaatttggtaattcttctcttcctcctttcctttcttcctcttttacttcattcactactgtattccacataaaatatattggcatatagctaggtgtccacatatgttgaaggaatgaaagactttatagacttgagttgcaatataaaatgtctttttttaactgtgagtcatggcaaaaaaggtttgaaagcggtttctaaattaatgcagattgtcaggtggcttggtattgacccctcggaataaaacttgaaaatggactagtttacaacacgcaacacaccacaaaaacaaatttttgcgggcgggccgcgcacgaaaaagattttataaaacacttcgtgtggggccgcggacccagaagtgatatgaaaactgtcaacacggtccaagagaccccggcaaagtggggggttcaccaaaaaagccggcggccgggttgaccacacgaggtgggcctacggctcaaggccggatacccgcccagggtc

SEQ ID NO: 532675 - DNA, 357 bp, Homo sapiens
  misc_feature (73)..(73): n is a, c, g, or t
tgatgtctggagagttgacacttgctccaaagcaggccaacagctgtgtatgggtatggatgaaccctacgtnttagctgtttctcgctgtgaaaatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtt

SEQ ID NO: 532676 - DNA, 1463 bp, Homo sapiens
cttcgtcgtatagtagtaggccgggggagtctactccctcgcatgagtattaagtcagggccccggggcaggaatcacgtttttacagacgggaacgctgttgtacacttgggtccttcttggggggcactcattaggagaccgcttgtgcacaaaaacacaggcggtgatcgccgtgtccgggatttctcccgcgattttctttaaccaccaaaggggtctgcacaatcgcttatttaaataataggtataatccccctgtcccctgtagcccccctaaaaaggggggcctctctacagcgccttcccttaatggagcccctcccggcgccgaaggacacaaatcgggggtagtatgcacccgctgctaccccggtgcgcgctagtaaacgtcgtcgccgtcaaaaacattagggggccctcagctgtataccgccgatagccacccccgccgtcgcgccaagaatgatggcgccaaagggagcgggcgccgcagaaatgtgtgaaaccacccgggcggatagggcacacaattatcccaaagggcacacacacgaacaaacaagcacaaccacgtgggtccccccaaaaaaagggccctctcttccgtaatatccggcggggaattatactcccctctagttgtgaattttaccccctcccacgaaaagattgtgtattttgttgtttttcaccacacgcgagattgttttcttgtaggccccgcctgtttgtagacccacacgtgctcactagaccttaatagctccctttatctcccccccccacattatatagagagagggcgacacacgtgggcgccccacacacacacagggcgatattctaccctccccctgcggattaaaatctccccccttatagagagagttccctcacacgctccgtaaagaacacacacatcccgcgatatgtaacgctctgccacatcacacgagagagatatatacacacactcaccctcgagaggctcacacacacaataggtgttaaagatatgaggaaacacacacctcggagaacaccacacaaatagatgtcacaagccacacggcgtctactaaacacacattttatactgtggtgttcttatatgtttacacccctcctcaacacaagccctcacagagagtatctcttcggagagatctctcccctctacgcacacatggtctcgagcgggcgacatttatcgggcgtcacaacacattttgttgtgagccccacagggttcccacggagcattcacagtgctatgttattggcgtcaacatttcctccaatatagtgcgtgtcatacccgcccaactaataatattccacatttacacatacgccaaacaatccactttggggttcgaaacccccccctgatactggcattttgataaaagtggtttgaatatttttgataagtttccatctaattgatgagggtctta

SEQ ID NO: 532677 - DNA, 685 bp, Homo sapiens
  misc_feature (239)..(239): n is a, c, g, or t
  misc_feature (302)..(302): n is a, c, g, or t
  misc_feature (304)..(304): n is a, c, g, or t
  misc_feature (315)..(315): n is a, c, g, or t
  misc_feature (317)..(317): n is a, c, g, or t
  misc_feature (394)..(394): n is a, c, g, or t
ttcaatatcatatattttaaaggtgactcacagttggagcaagaatgaaagaaccacgaacttcaaggtaaaacgggcaacggcgtggggcaagcctctctgcatctgcgtgtccagcctctcctgcatgccagaagtccccaggcaggagtgtggtgggacatccggctggggtaaggacaggcaccctcccactgtgtcagggcccagagagtggatggagaagctctgcaagaganctgcacaagggcgccttgtaggagcctgcagtccccacaggggtgttgtggataacacttggngngccctggcctntnggggtcacggagggcttggctctcacctcagagctgcagaagagccacttctacatcaggacctcagaagctggaangggatggcggcgaggggcctcttgtggggtcacagagatgggtctcagagatggccgtgtggaaggttggattctcaccccactctgcccctagatgtctggtgacctcccctctgtagtccttgtatttggaaaaacagttatgactccgtgcataactgggtactttgctatgtatcgtgttaactcttttacgcggtgtctcccctggtaaggtttacgaagaagggtctaagtgggtggggttctcagaggcatcgcaagttacagaagaaggcccggactaccggc

SEQ ID NO: 532678 - DNA, 497 bp, Homo sapiens
tctaggactaagacaatttactggccttatgagatgagatgagacacacccttacaccattttgtcattgaagaatatctaatgactatattattggtttgccattggattaaattccagaattcttatgaaaaataaagcaagaggcttctcagaaatttctctactctgagaggtctttcttctgtgcatttcttgggttgacactgaatctgtgccagaatttcatcaccacctagcactgccaagcactctaccttctgaagcagtttcagggtcgtgacggggtcaaaggcaatgaccccatgagtaccagactctggtagtttgactggctaaaactagtcacagggacctgggccatcctcttactgtatgggaagcttacctaagttaagcctcagtccttgaaactgtcagacctggctctgagatagcaacatttacacaaagaaaggaaagtttgaaggctgagcatgagcactcctctcctggta

SEQ ID NO: 532679 - DNA, 876 bp, Homo sapiens
gatccgagtggtgtctgaccgctggtcctctctatgtgaacagccagactgcctgtctccttgccggcatctgatcttgcccggagaagtacccccctccaagcgaactttaggacctgggagccctggcccgtgtctgctctgagtaaacagtgcctttgagagtctttaccaagataagagtttcctttctgtcacatccgcatccagacccaggtgtataacgagctgtatacaagcgagtgacgactaactgtgtttgtgggggcccctcacgggcagcgggaagactattcgtgcaagagattgggcatcctgcgaatgcatgttgcagagctcggaggggcgctgtgtgtacgtcacccccatggaggccctggcagagcaggtatacatggacttggtacgagaagtgtccatggacaggctcgacaagaaggtggtactcctgacaggcgagacacagcatctagacctgtaagctgctgggcaatagggacacagttatcatcagcacccctgagaagtgggacatactttcccggcgatggaagcagcgcaagaacgtgcagaaacatcaatctcttcgtggtggatgaggtccaccttatcgggggcgagaatgggctgtcttagaagtgatctgtcccgaatgcgctacatctcctcccagattgagcggccattcgattgtggcaatcagtcttccgtctccaatgcaaggatgtggcccactggtgggctgagtgcaccttcaactttaaattcattccaatgtgggtccgtccttggggtggaatccaggttaaatagacataaaaaccctggttccaggaatgggtcaagtgtacagatgcagaactgatgttgtaggta

SEQ ID NO: 532680 - DNA, 992 bp, Homo sapiens
  misc_feature (31)..(32): n is a, c, g, or t
  misc_feature (202)..(202): n is a, c, g, or t
  misc_feature (233)..(233): n is a, c, g, or t
  misc_feature (235)..(236): n is a, c, g, or t
  misc_feature (238)..(238): n is a, c, g, or t
  misc_feature (251)..(251): n is a, c, g, or t
  misc_feature (253)..(253): n is a, c, g, or t
  misc_feature (263)..(263): n is a, c, g, or t
  misc_feature (277)..(277): n is a, c, g, or t
  misc_feature (308)..(308): n is a, c, g, or t
  misc_feature (328)..(328): n is a, c, g, or t
  misc_feature (364)..(364): n is a, c, g, or t
  misc_feature (378)..(378): n is a, c, g, or t
  misc_feature (391)..(391): n is a, c, g, or t
  misc_feature (714)..(714): n is a, c, g, or t
  misc_feature (717)..(717): n is a, c, g, or t
  misc_feature (864)..(864): n is a, c, g, or t
  misc_feature (892)..(892): n is a, c, g, or t
  misc_feature (904)..(905): n is a, c, g, or t
  misc_feature (926)..(926): n is a, c, g, or t
  misc_feature (929)..(929): n is a, c, g, or t
  misc_feature (931)..(931): n is a, c, g, or t
  misc_feature (988)..(988): n is a, c, g, or t
tttggaaaaaaaaaaaaaaggaatcttcagnntagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccganccccccggttcaccacctgtaaccacgggcngnngnttcttactgtttntntatttatttnttttttttattttntttatctctctctaattttattgtcttggtnagtatggtgtatccgctgtnaacgagggccttgaaggcgggacaaggacgcgatcnatgggccacccgtngtttccccctgcnagctctggtctttgagaagtgcgagctggcgacctgcactccccgggaacctggagtggctggcggagacgtctgctcctccgactccttcaacgaggacatcgcggtcttcgccaagcaggttcgcgccgaaaagccactttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctcnaantcagatcatgaagaactttcaggctcctccacaaatctcgctgaccataacccttcttcttggcgagaccacgatgatgcaacctcaacccactcagcaggcaccccagggccctccagtgggggccatgcttcccagagcggaganaacagcagtgagcaaggggatggtttanataacagtgtannttcacttggtacagtaatgtntgntnatccggataaggacaaaaaacgccagaagaaaagaggcattttcccaaagtagcaanaata

SEQ ID NO: 532681 - DNA, 1104 bp, Homo sapiens
agcgggctgagttgctggtactgcccgtggtcgcttggttcgaggtgtgccgtgatcttgatctccgcggagttcgatctccctggcttttgccgctcctatacgtcgctcgcccttttcgaggatcgacggatgtctgctcgcgtgggccggaatatcgtggatcgacctgggcaccacctattcgtggcgtcgcgcggatcttaccatagcaatgagccagaggatggaggatcatctgtgcaactggaccgaagggcaagtcgcatccatgcacctagtcttacggtggtccctttcgacggaacagtcagaagacaaccgtaagtagtgcgaaacgactctgcggaaagtaacccagtgttgaggctatagaaaccctcgatctaactatctatcatttcggaacggcccaagaagtgcctgaatttgggtaccggcaaatatacgtaatggtgatgctgatcaagttgtaacatttcagcaattactgcaaatccaagctgaggtacccgagttgccgcgttgatgtagaatggcagtgccgagaggaggaagcggcccacacggtgacctccaataagatgtgttgaccaacacgtgtaaaaagtgattaacctacaagggggctagcactataccacaaaaggaaattccatattatctgtactctctcgagaaagggagagaaaatacattacctatccccaatgtgggaatccccgtcaagccggcattcagagcaaattttaaacacgggtatcgcatttcggacgggtcacaatgtctcattaccacatgtgtggggggggcgctcaaaagtggtatgcctgccaagggacggtcggagtctccgaattccacccgtgagttcctctacgtggaccctggtaattctctacaataccgcacatctttcgatgtaagcccgaaccctggggagccagacgcgcaatattgcaaccgccaggggggcaacaggtcttgacgaggaggttaccttccaacgttgcgttgactatgatggccatttcctattccaaatacggaaagggcccccaacagggtttgtgtccaacccatttacgtcaacgggtgctccca

SEQ ID NO: 532682 - DNA, 185 bp, Homo sapiens
agatttaggtgtatgctgaacctgtgtttgcatcctggttctgttacacctgagtgggtgacccttaagcagattctctagatcccagttttctcttgtgtaaagtacaggtaatgatacatgtctcttccagtattggggaggaataaataagatgtgtaaggaaagaattttttcatgtacta

SEQ ID NO: 532683 - DNA, 349 bp, Homo sapiens
atgctgtctccatgtgttaagagatctgtgctgtccgctgtgtctggtggatcatgatcgatggagccctctcttagaccagacgatgatcgtggtccccggcgtggcatgcgttatgcccgtggccctagacgtggtcctgcggacgataggttctctacgtcgtgaggcagacgatgaccggccttcctggcgtaacacagatgatgacaggtctcccagacgaccttgccgattaagacgggggaaactggcgtcatgcgaaaaatgacaagaccacctaaacgagaactagataaggcacggaggaagctggcaaacagctaatgagtacagaggaccaagacgt

SEQ ID NO: 532684 - DNA, 341 bp, Homo sapiens
  misc_feature (16)..(16): n is a, c, g, or t
  misc_feature (52)..(52): n is a, c, g, or t
tatatattcggccggntgcagtggttcacacctgtaatcccagcactttggnaggccgaggcaggcggatcacctgaggtcaggagttcgagaccagtctcaacacggagaaaccccatctctaacaaaaatacaaaattagccaggcgtggtggtatatgcctgcaatcccagctactcgggaggctgaggcagaattgcttgaacgtgggaggcggaggttgcggttagcagaagactcaaaaccttccgcagaaatgcttatcggttcaagtccgatatgagccaccatttgttaaataacgccaaaattataacactaacactaaaatcaaaaaaag

SEQ ID NO: 532685 - DNA, 227 bp, Homo sapiens
accagcctcatttttcctccggtagcctttcccacctaacctttgcatcccccagcctcatgtcctgccccatccctatcctgcctgatccctggatttccctcagatccccttttttcaaacagcgccaggccggggtggggccggggttggggccgagccccccaactgcccccctcccctccctttttgtataatttaataaaaaaatggtggggcttttgtta

SEQ ID NO: 532686 - DNA, 483 bp, Homo sapiens
ctaggataggcgggttccgcgagtgtctcagctgctcctctcgagtcctgcgcatcccggtcgagagtcatcggcgtgccggtctggcaccaaatttgagcatgttccagtctgaacacgtagtcatatgagaagccctggtgatggaacagattccggaaaagctgccgcagatacgagtagtcaggctcgtcgtcaaaacgccaggaacggcagaaattcaggtatgtggcaaattcggaagggtaagcctttagacaatacgtatctgatgggagtggatcatatacttctcgctaatcctttcgtattgctgtctcttggtgcgagccttcaccccctgtcaggggagatagcccaggttgaattacattagcacgttgcccagagcactccaagtcatctcttcgggattggccaattccaaggtgccgtgtagatagaggcgtccgagcagttcccgtaaggttcttgtactcacga

SEQ ID NO: 532687 - DNA, 376 bp, Homo sapiens
ctgtagaagtttcacacctttatgtggagactgataagtaagcaacaataaggaagggtccccaggttggggacgagaccccaatgttgagaacaataatgaacaattatagtatgaacaatagttagagacagctaatcacaaacaacctgcgggcacaatgacctcattccacacgtagcaccctttagcaggaccctataaaactttcctccagcacttgcctctttgcaggtagccccttctctgctgagctgcccactgcaacatattttcacaatttctctaataaatctgcccttctttcacctacaactatctcggtcacatggctttaccacctgcaaaactgaacctaggttgtaagctacccaca

SEQ ID NO: 532688 - DNA, 191 bp, Homo sapiens
gctagaataaagcgcggcagaagaagatagaaagaacagacttgtctgattcttccatccctttatctttctcgcatactgatgcttcctgccctcaaacatcagactccaagttcttcaacttttggactcttggacttacaccagtggtttaccaggggctctcaggccttccatgacagactgaagac

SEQ ID NO: 532689 - DNA, 126 bp, Homo sapiens
ctaaaccgatgttgctgctgaagtcaagaacgactggctaaaaatcacgcgacactgatagatgcactattaaccgctgcaccagtgcgcaacaccaagaaattatgaaaacgattctctactgac

SEQ ID NO: 532690 - DNA, 257 bp, Homo sapiens
ccaaaactttttaaaaaaggttaaagggattttttttttaaaaaaagtaaaaaaccagttaggcattattttaggtaaaagcactgggtttttcccgaagcatctggccccaaatgcctttgggggtaataaggtggggaagaaacccccagttgggccagtattcgggaaggccccgcccccaatgaaatgtttaagggtttgccttttcccaggcctctgaaggtttttggatccaacccagattttgtttggca

SEQ ID NO: 532691 - DNA, 317 bp, Homo sapiens
gaggacccccggcacgagcgcagcggccgccacgaccacccattgtttcggaacggacctctcccacaggagggtgccggaaagattccacagcccctccctacgtcggcctgaggccctgctcggcctcccccagcagtgagatggacaccttggaggagttcctggaggagagcaaccgcagcttccccacccatgacactcccagttgccgggatgacctgctgagagactacttccgaaaggccagcgatcccccagccatcggaggccaaccaggaccacctgccaagaaagaaggggccaagatgcccacc

SEQ ID NO: 532692 - DNA, 953 bp, Homo sapiens
gagcagcaggcggaggcagagcacagcatcgtcgggaccagactcgtctcaggtcagtggcagccttctcaggccagacgccgaccaagggaatctcattaccgtgagaatggcaagtgatgtgcgttctgcctcctaggcatcaccgtgtgccatacgcagttaatgcgaggcttgatcttggagtgtcctgagtgatacaagctgctgtccaggagcaaagtactccaagattgtgtgccgagacccacatgtggtaatacctcttgagccaatctcaggaaggcgagtatttcttcgcatagtcctcctacaggaatgctgagttgctcggaaatgaaacccatgtgaattttaaactaaggagacccatgtcgctgggtataggtccaaggaacgccatgggcgcgtggatgctatggatgctgatgctgattgggtgacctatgtggcctcagtgggggtactccatgtgttctgcgggcggacgctgactgattgtgctgacactgatgattctcgcccagtactggtggtcgcaccattcgtgttgcagtctgatgatctggtcccgattttcccacggaccttggcagaacgaagtttcgctccggttgtccccctatgtagacggatttggcctgccgaggagatagtgtggaattggccttgtggtcactacttaagaagttcactgccaggacatgcgtacctgatggtgggcgagacgtcacatacactgcagcaggcttaatggggtatagcactcccgatgtcaggcatgaagccgaaagatggctccggaagaaacaaatgccgcgcggaccaggtgttcaccaccactgccggctcggacggttagcgccgtgatagaagagacggacagatcagagggggcaactaaaatatcaattagaaatatatgtatctttcctttgtcttcttcttctggg

SEQ ID NO: 532693 - DNA, 186 bp, Homo sapiens
gccggggaggaggtggcctgtgaacctctcctcttggccgagaagacaaagccccgccgcaaattcaaaacggctggggatgagagtcgaggaggcgagtgcgggatcagagcaaagaaggacctggggcattgcaaaagcggaaacagaattctgggtgaatgctgggctgcttagtagtcgaat

SEQ ID NO: 532694 - DNA, 777 bp, Homo sapiens
agggttacagattcacagcatctcaaggcagaagaatttttcttagtacagaacaaaatgtagtctcttatgtctacttctttctacatagacacagtaacagtctgatctctctcttttccccacaattccaagtcattaaaagttcagatgctgccaggcatggtggctcatgcctgtaatcccagcactttgggaggccgaggcgggcggatcacgaggtcaggagttcaagaccagcctggccaacatggtgaaactctgtctctactaaaaatataaaaattagctgggcgtggtggcacacgcctatagtcccagctactcgggaggctgaggcacaagaatcgcttgaacctgggaggtggaagttgcagtgagccgagatcacaccaccgcactccagcctgggtgacagagtgagattctgtctcaaaaaaaataaataaaacaaagttcagatgccgggcgcggtggctcacgcctgtaatcccagcactttgggaggccgaggcaggcggatcacgaggtcaggagatcgagaccaggtgaaaccccgcctctactaaaaatacaaggcgcggtggcgggcgcctgtagtcccagctactccggaggctgaggcaggagaatggcgtgaacccaggaggcggagcttgcaagtgagccgagattgcgccactgcactccagcctgggcaaacagagcgagactctgtctcaaaaaaacacacaacgcaagaaagaaaattcttatttccttgggccctcctacctt

SEQ ID NO: 532695 - DNA, 388 bp, Homo sapiens
  misc_feature (12)..(12): n is a, c, g, or t
  misc_feature (18)..(18): n is a, c, g, or t
  misc_feature (23)..(23): n is a, c, g, or t
  misc_feature (72)..(72): n is a, c, g, or t
  misc_feature (142)..(142): n is a, c, g, or t
  misc_feature (160)..(161): n is a, c, g, or t
  misc_feature (166)..(166): n is a, c, g, or t
  misc_feature (172)..(172): n is a, c, g, or t
  misc_feature (198)..(198): n is a, c, g, or t
  misc_feature (214)..(214): n is a, c, g, or t
  misc_feature (224)..(224): n is a, c, g, or t
  misc_feature (230)..(230): n is a, c, g, or t
  misc_feature (255)..(255): n is a, c, g, or t
  misc_feature (302)..(302): n is a, c, g, or t
  misc_feature (305)..(305): n is a, c, g, or t
  misc_feature (317)..(317): n is a, c, g, or t
  misc_feature (326)..(326): n is a, c, g, or t
  misc_feature (346)..(346): n is a, c, g, or t
  misc_feature (349)..(349): n is a, c, g, or t
  misc_feature (360)..(360): n is a, c, g, or t
  misc_feature (362)..(362): n is a, c, g, or t
gagaccatacanacagantacantgtgtatatggatgaactctcctccttcattgtggcaaagcccaacatnccatgggtgtttctcacagatcccaaattggccacggaaggttattttggcccttgtagtccctaccagnttaagctgtggggcccanngcagnggccangagccagaaatgccatactgacccantgggaccggtcgttgnaacccatgcngacacnagtggtcgggagactctagaagccntgcttctttttccattggctgaagctctttgcaattcctattctgtnaancgctgtgttccntgtggtganccaatcatcaatttctctanganttctgggtacngnctacccagacaggggctttgctattt

SEQ ID NO: 532696 - DNA, 273 bp, Homo sapiens
gatctcatgggagtacagtaccgggatggcgcccagcagttgcggcgggaacttgcgcagcagcaggcgtttgagctgtacctcgccgctgtcgcgcacctcgccgccgtaggcgacgacgatacgattggcgccgccggaggacagtgcgttgaccgccttgatcgccgcgatttccagcgcctccccttccagcgcggcatcgagcctggcgattcgttcacccaccagactggagaacagcccgcgctgctgcgggtcctgctgcatggc

SEQ ID NO: 532697 - DNA, 789 bp, Homo sapiens
tctgcacgtgcataataataataataataatcagttatgaagctaggtgcaatggttcatgcctgtaatccgaacacttttagaggccaaggcaggaggattgcttgagcccaggagtttgagaccaccctgggcaacattacaagaccctgtctctctatttaaaaaaaaaaaaaaaaatctgttaagggctttaaggcatgacttggttggctacaggaataggtttacagggtgaacgaaaaatttatttggatgatttcacttgtgaagtaaaagatagttaggtgggaataaacagctacccacttgtttcctgagaactgaaacaagtttcacacaacttcttctacttttggtaaaacctgtccgggaagccttagacaaaagcatgatgggattttcaaaaaagggggagctcttctagaaatttcaaacgtacatctgttcgcaaaactagcaacaataggtgggtccttttacagctgatccatacaatgtgaatggccctcagtggcatgccattgtagtcaacaggggttagagggccccttaattgtgaagtaaatcatgggacaaaactaccattgggccatttgggtatttctaaaccccaatgccattgttaaatatttatactcgtaacgtttacacatttgttcccatattagttggtattaaaccgtgtcacattcctactttattgataattgaaatatattttccataactacatagtttaaacacccctcatatatattagaacccccatgtttaaagagggtataa

SEQ ID NO: 532698 - DNA, 554 bp, Homo sapiens
tgtctacaggaccctattttgcatcttcccttgtggtggaggtgggagagtcttactcagtgtgagacggctgttggggtccgagcctcaacttcaaggttccccaaaggcaggagggaggcctgcgtgtgccctggccctgcagcaccggcactgacttgggaggcggggagcctgcgcacgtagtgtggggggcccagtctctacacagctgtccagctgtccttgccgattgctttaggaggttcactcatctctgtaacccttcctgtcttggacagcagtagtgcctgtgaccagtgtgtttgtgaggacgaagtggctctgtgcacacagctggcccctgagaaatgccagctgccagttctgtgtgcatccagtcgttgcacacggactggactattttctaagtggtgcttttaagaaaccaagtgtcagctgggcgctgtggctcacgcctgtagtcccagcactttgggaggccaaggcgggtggatcatgaggtcaggagatcgagaccatcctggctagcatggtgaaaccccgtctctgct

SEQ ID NO: 532699 - DNA, 370 bp, Homo sapiens
agaaattagcctgtctcttaccaacggaaaatcacatacggggaactgggatactataataaagaacaatagtgacactgtgtcaggtgagatgacggacttgtcatgtgctgtggggggtcaaatactgcagaaggccttcttcctctggaaaggtcataaagacatgtcacacttgtgtcggcacttgtgacgtgggtacgaatttactcaagtagacaatgagacgaaaggcatgccaaagcaacggactcgggcctgaactaacggtctactaagttggtggtcctctggctaagaattcgtgctgtgcctccattaagagaaacgcaggagctagtttgcctggagcacatgatttatgcatgac

SEQ ID NO: 532700 - DNA, 633 bp, Homo sapiens
atgctcttgatgcttgtagatctgatcaagcttcagatgcctttctaacttagtctatcatgtaaaatgttggtaacttgaaccacaatcattgtaccagaaagactagtcgttgaataggcataagtcacagggatatacacatgagaagatgctttattgactgtggaagagatgttatgtcctatgtagcaaatgacggttcttagaggctgggcccagtggatcatgcctgtgaatcccacgtgctcggaggatggctgtgaggtggacaagatcaatctgatggccatggaagttcgacgaccaaatctggtgcaacatgccaaaaacccatctctatccaaaaatactaaagaatttgtgccaggtgtagtggcatgcgcctataatcccagctactagggaggcatgaggttacatgtagaagattgcgccatctgcagcttcagcctgtggtcaataaagtgcgactctaaaaagaaggtttagtccagatgcagtggctcacacctataatcccaacactttgggaggctgaggcaggaggatcttttgagcccaggagtttgagaccaccctggacaacatagcaggaccctgtctatgcaaaaaaattagctgggtatagtg

SEQ ID NO: 532701 - DNA, 177 bp, Homo sapiens
aaaaaaaaaaaaaaaagagttattacttgttgaagtctcacatccccacaagggaatgatagaaacaaatattttgctggtattcatttcttcatttctattccagctgagtcttgaattcctgggctcaagcgatcctcttatctcggcttcccaaagtgctgggattacagacac

SEQ ID NO: 532702 - DNA, 768 bp, Homo sapiens
gagatttagattgtgggtcactgccaaaaccagtcagagtgaagaaggtatatagtacatgctaaaatacgggataaggagggttacacgtcaagggctgtggagaaaaagtacttattaattgtccaactgggagatgattgcacagcaaggaaaatgtagtgaaaatacccaattcaagaaagagccttgattcagaaacagtacagttacagcagggagtagaatgtcgatcattcgtacttctggtgcatatttatgattgaagcaaaatggctggaaatatattaggtatattaggtgtccatgcaattatggattagagagcctagttatttttaattagggacattaccaaaaaacatcaaaggggttgaacttatcgttctatttagtatgttattatatgtaacaaaaggaacctattttaatttcaaaatttgaacaaatgatggcaattatggaagtacagaatatcaatggtgcctgtgtgtgtagtgtaggtgtgtgtgtgtgtgtgtgtgttctgcttttgtgaggcacaacaaggaattaagtagtcaaatcatttcatccatttacaaacattacacaagagaataattccaatagtctttttccccccatttgaaactgctcgcgggctactttagatagtctaataaaattttgagagtactctgcgtgtaggaggggggccaggcagcagaggctctcaaacaggtttcaagactgggtttgacatttggggccagataaaatggtggg

SEQ ID NO: 532703 - DNA, 102 bp, Homo sapiens
gcggccgcctactactactactactgctcggaattcaagctgctaacgatgtacggggacatggaaataaacacccacgctgccctgggcccctgcaaaaaa

SEQ ID NO: 532704 - DNA, 430 bp, Homo sapiens
aattccagctcggtttccaggaccagtcttaattgataagtgttacgtgtgttctgactgctccaccaactggctgttttccagtctctctccctctgttcggcccccccatctcctaagacacaaaaatattcaagttacaccaataataaccctccagtggcctctgagtgttcaagagtaaggaggagtcgcatgtctcactttaaatcaaaagctagaaatgattgagcttagtgaggaaggcatgtcaaaatgcaagactggctgaaggctaggtctcttgtgctaaacacttagtcacattgtgaatgcaaaggtaacgttcttgaaggaaattgaaagtgctgggctgtgcgtggagactcttacctgtaactgcaacactttgccaggctaagatgggaggatcacctgaggccatgagttt

SEQ ID NO: 532705 - DNA, 1141 bp, Homo sapiens
tcggcgcatgcgcgctgaggcctgcctgaccgaccttcagcagggtctgtggctaccatgttctctcgcgcgggtgtcgctggagcgtgtcggcctggggaccttgcatgccgcaaatggacttcaacgtacgaacatatggcaactttgaagatgatatcaccgaggagactaacagtccatcaagaaacatccagaaaattaccaagtctatgaacacatggtagcggcagcaaaaatatgcccgagctgagagagagcttgaaacccagctcgaatatatggatggggatctttagctctgtattgacaaacgctgatatcaagtggggcctgaaagacaagaagaaacaccttccttatgggtgtgtcctcagatcgaggacttgtgtggtgctattcattcctccattgctaaacagatgaaaagcgaggttgctacattaacagcagctgggcacagaagtaatgcttgtgggcactgggtgacaaaattcaggaggcatacttcatagcgactcattctgaccaagttccctggtggcattcaagagaatgtgggcaagaaagccccccaattttgggagatgccgtcatgtccatttgccctttgaatttactaaattctggattatgatttgatgaaggctccatcatcctttcataaactccgggtcctgtcatcctctatataagaccagaagaagagccccaatttttgcccttaaataccggttgcaggtgctgaccggaatgagtatctagtaggcatttgaatgcggacgtgggctggacactttccacgaatcaatcggggcaacatacatcttacaagccccgtgggaggtccccactagtggacacgtgcccaatacacacttgacacgtccccaaaaggtcctgagactgtgtcactgtgctcataccacgggaaccacacggcgtacacagcagagtgaatacataggggggccgcgcaataaatgatccctccaacaaaagaaaacacccctgtatttgcccgtaggaccaccctactaagaaaaagttaatccaaggagcacgcggccggaccttctattctgctcttttactactgtcactcactgacgcctcggtcacacggcctagacgacagcgc

SEQ ID NO: 532706 - DNA, 110 bp, Homo sapiens
cagatcagcctaccttaaactctaattctacctacgcctattttacaccaacccccatagtattgtggtagtagtaagcattcaactcacggggtacgcgagactcgaca

SEQ ID NO: 532707 - DNA, 345 bp, Homo sapiens
agattttttaaaacctccataagtagtccaggggccgggtgtcacgcctgtagtcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccagtgcactccagcctgatgacagagcaagactcagtctcaaaaataaataaaaataataaaacctccataagtaatcctgaaaaaaaaaa

SEQ ID NO: 532708 - DNA, 459 bp, Homo sapiens
cccccgcttgcggcttctctcttcttccacgcatcgattcatcgatgaagaggatgcagggcatcttcgagcaagggcaataagtctcggacttggcaaaaacagaaagagagtcacctgaccagagaatattatgtattctctgaataagaaatgaaataaatcggccgggcacagtggctcatgcctgtaatcccagcactgtgggaggccgaggccggtggatcacctgaggtcaggagttcgagaccagcctgaccaacatggagaaaccccatctctactaaaaatacaaaattaggcaggcatggtggcgcgtgcctgtgatcccagctactcaggaggctgaggcagaagaatggcttgagcccaggaggtgaggttgcagtgagcctaaatcaccccactgcactccagcccagatgagagagcaagattccatctcaagacggcaagcgg

SEQ ID NO: 532709 - DNA, 816 bp, Homo sapiens
gtagtagtcccaagttctcagagatctcagtgctgatctgggacgatgcccgggagggcgaggactccaaggcagaagctggtgctggagttcaccttgcaccaagccagtgactttctgtgcgcgaatgcgccatggacaagatcgtgatcgtgctgaagaaccgcatctatgtgtactcccttccccgagcaagtccccgaacagtctgttgtgaggtttgatacctcgggacagagccacctaaggggcgcaccaggccgctcccctccatgcttcgcaccctagcggctctgtgaagcttgtgcgctgcgagttctggcagtgacgcatgctggctaggtgttgcccgggtatcccaggggtggtgggggggtctgtcgacactttgtggggatcgctgggggtgagcccgtggacgtggcccgcctcgctcctgctccattgcatccactccaacgggggcaccctttcagtcactgtggacgtagcccgctggtgatgttctgctacagagcccgtccaggcctgtgtgtttggggcgctcagggctcgccttgagcgggtagcctcgttgttgtgcagctctgggttgtgatatccttaatgcgcgagaggagaaggcttggttgagaggcgtggcgggctcaaggcacttggaccgcgtggccaatcgctcctaactgcggtgtaacctgtcgagcccactgcaatcctcgctttcctgcttgcggccttccaggttgggtcccgggttctggtcgcatagtgcttcgttctcaatggagttctccagcctcgaactcgacgctaccg

SEQ ID NO: 532710 - DNA, 247 bp, Homo sapiens
gtaaaatacaaaattagccgggtgtggtggcgggcacctgtaattcccacttactcaagaggctgatgcaggagaactgcttgaatccttggaggtagaggttggcatgagctgagattgcgccattgcactcctgcctgggcaagaagagtgaaactctatctcaaaaaataaataaagaagcctcccagggcctggatcattccaatctgcccataggccatggtgatcagccgctcattcctac

SEQ ID NO: 532711 - DNA, 1699 bp, Homo sapiens
taacaaaaaaaaaaccctttttttttttgtgtggagtaaaagatgtgttattttctcttttgtgtgtggtgtgacaaaaaatatagggaccaaaatatatgtggggacaaaaaatgtgtgttggagaaaaaaaaaaaaaaaaaaaaaaaaaaaaaaaaaaaaaaaaaaaaaaaacaaaacacacaacaaaaaaaacacaataatacaaacaataataataacaacaaacatcactacaaaatcatactaacaaactacaactatcaatcattaaacaatctatcaaatctgttcgcgtctcctcactatcatttattctctcctctctcttctgtcacacacacccctactttcaatatttctctttaacacacatactactcatctcttctaaatcaccaaactacactcacccagccttccctaaccctccacacactcatcatcacacttcctaactaccctctcatccttctccctcttccatactcccccctacttctatcctctccccacctctcacaacacctcatcaaccaccctacacctgactcaacctacctatcctacaataaactctcacccacttcctcattctatcctaaaccctaacacaacacaacataaacacacaatacctaaaaaacacaaaataatgagcagacaccactcacaacacaccataacactccaccccaaactaataacaccaaccactcaaacccctcaaccacacatactacataaatatcaaacactcctcactcttcacctcactatcacaccactccacctccaactcccaatacatcaactccaccataactccatctcctccactcatcacgccccaacccacccaacccgatccaccatccacacctcacatacaatcccgtttcccactattctcttacacccccaacaacatcaactccctctaccccactaccaccctcccacacccaccaacaaacaacactataacccaacacaaaactaatccataactcacataccgtatctacaacactcacacattcacctgaatcccacctaaacattcctattctacacactatcacccatctattctatcacgacacaccatactaattcatcatctacaacaacacactcatccactctcctccccactacccaactcactcaccactccccactcatcatcacaccactctctaaccacaatcacatccaccattaccacaccacacctcctcaacacccaatcacacccacccaaccaactcccccctacccccacaacccactcccccaacatccctaccccacatccaaccatacaccaccaccatatccatccaccaattcaccccacccactcaaacaaccatctccacctctaccacacacgtatacctcttaacaaccaacacaatcaacccaacaccacccccaactatcatccacattcaccccctactcactctcatcccactatcactccatatcatcaccacacatacactcaacatactcccaaccttcactcactctacctcacaactctcacacatcaccctcatatcatccatatcacaccctccgatcctcactccactcccctcacccctactctacacactctctacaatccaatcacatccatcttagcttacctactccaccctctcacaccgccctcccactcacc

SEQ ID NO: 532712 - DNA, 702 bp, Homo sapiens
tgtgtccctttgtcttaactgttttttcacaccctatgtatgtaaaatactgcctccccactaggtcacttataaaaactgtcaggcctctgagcccaagccaagccaccgcatcccctgtgacttgcacgtatacgcccagatggcctgaagtaactgaagaatcacaaaagaactgaaaaggccctgccccgccttaactgatgacattccaccatggtgatttgttcttggcccaccttaactgagtgattaaccctgtgaatttccttctcctggctcagcagctcccccactgagcaccttgtgacccccgcccctgcccaccagagaacaaccccctttgactgtaattttccattaccttcccaaatcctataaaacggccccaccccatctcccttcgctgactctcttttcggactcagcctgcctgcccccaggtgaaataaacagccatgttgctcacacaaagcctgtttggtgtctcttcacacggactcgagtgaactttgatgccgtggctcggatcgggggacctcccttaggagatcaagcccccgtcctcctgctctttgctccgtgagaaagatcacctatgacctcaggtctcagactgacagccaagaaaatctcacattcaaatcggtagcggctttttatctctttcaactcctatcctaactctttcttcattggggc

SEQ ID NO: 532713 - DNA, 108 bp, Homo sapiens
gtagtctagacgcccgactctgtgggcgccaattccctatagtgagcgatacacccaccatcatgcctagggtcttgttaccgagctagtggtgttactttcatggtc

SEQ ID NO: 532714 - DNA, 186 bp, Homo sapiens
  misc_feature (12)..(12): n is a, c, g, or t
  misc_feature (88)..(88): n is a, c, g, or t
tttctggggatncttgctgccttaggagattgaggaaaatttcatggagaaggagacacttaagaataggccagaatcaaatgagatncctcatttgagagaaattagacatcccttgagtgaagacatatacatggctaacaggtatatgaaaaaatgcaaagatacagagaatatttgaaaatg

SEQ ID NO: 532715 - DNA, 190 bp, Homo sapiens
cagaatattctgtggacaaattattggtgagtatcagtctatacaggacaataaagctcttaatcccccagattacttacaaagcatagcgggctctatgcttgcacaggtcgtgactcagacactgctagtggaaagctccaaatccatgacagtcaaagtctctgctccttcaggaacaggacatctt

SEQ ID NO: 532716 - DNA, 576 bp, Homo sapiens
  misc_feature (69)..(69): n is a, c, g, or t
cattagtttggtaatagtattttggaagctggatttctctaaagctgaagtgccaattaaaatatttcnataatgcttgtagaaaaaaaatcccaaaaattttgaaagaaaacttctctggtgcctaaaaattaacttggggagtttttagcttttaaaagttgcatctattatttttctctaatactttgttagagtcatggctgacacttttagaagcgactttgtatttttttgttgataaaccagccttcctggaggttagtgttttttcaaatataacaaactgtgtagggtttaggagtagtcagtgttatacttactgtttagatattttaatgtgaatctattttaatttcctttgtgttttaatttgctcatagaaacattatatgtaaaacatactcaagttcacttaaaagaactcatattttatcgacataaaatctctacttaggttttatgagaatattaaagttgtaagttatcactcactttcacgcatcctccctggactatagagcaattgaattcctcacaaaattcttgcagcaaataaagaaatactttgcaaaa

SEQ ID NO: 532717 - DNA, 143 bp, Homo sapiens
ctatgaatatgtacaaatgatatttgccaatcataagtcctgcaatcctccagaatgcatgcatatccaatacttctttcatcatccctcttccctctgtcagcgtactgtgtgcggtgtactcctcgtatcagtcttaaagt

SEQ ID NO: 532718 - DNA, 1041 bp, Homo sapiens
gttgactattctctacaaaccacggaagacgagtggaagcactatacctatgattcggcagcatgagctggagtcctaggcacagctctaagcctccttattcgagccgagctgggccacggcagggtagaccttgctaggtaacgaccacactcgtacaacgtgatcgttcacagtccatgcaatttgtaatacatcttctgtcagtagtgacatatccagtcataatcgtgaggcttgtggcaagctgactaggttacccgcatatataatcctgccccgcgatatggggtttccccgcataaacaaactataagcttctgacttctggtacgtccctctctactagtcctgctcgcatctgctatagatggaaggccggagccaggaacaggttgagactagtcatacccgtcgccgtatattcagggaagctactctcgcagccctggagcctcacggtaagaacctaacacgagtcttctccttaacaacgtagcatgtgggtcatctcgtcgtatcttaggggccatcaattgtcatcgatcaacagtgtatcaatataaataccccctgacatagttcctagtacgcaagagccccgtcttcgtgtagatccggaccataaatcacgagaggcctacttcttctatctctcccagtcctaacttgatggcgtcactattactactaacagacggaagctcaaaacaacttgtttcgactcgcggaggaaggagaccaattctatacaataacattttcgtgatggtcggtacctgaagttatatttgtatccaccaggttggaaaagtttgcatttgtacgttatactcgggggaaagacattgctccatggatggttgacagaatacggatcaaggtttcgggtgaaccccaaatagtggatggcgaacgaggattaccggataacgtgacacgcgaataattgcgcccgaactaaattgcgtggcaagattccggggcgaggccacacacaagacgtttggtgggaactgcgaaatatgcgcagactatagg

SEQ ID NO: 532719 - DNA, 431 bp, Homo sapiens
agggcagatgcacaagcccactcgagcccagcaaatggaggaggccccccaccgccaccacaaatgtctggcccagccaccaagctgcttccagctgggccagggtagccggctgaggttctcgggtgtcctcagatgctcaaaggcaaaggaaccccctgccgcctgaggctgctcctccccctgccgagggcgtgcagaggcctgagtgctgcccctgtggagtgggcgtggctcaggaagtatactccctgcaggcagcaggtacgacgctgccttaatggtattacaggcaggggtgtgcaccacctaaaccccagaccctcaggccccagggacgatcagaacacagggaacagggtagcgagactggcagggaagcccccgggtgtgccttgaggaggctggccccgcagaagacagggcggccg

SEQ ID NO: 532720 - DNA, 990 bp, Homo sapiens
gcgttggctgtgtgagaggttctctcgctctagggagattccttcatgtcattgcattcgtatgtctaatggtgataccgcgttgtttccgtgtccttcatatgatggaagatatagtggatcgaaactcattcggaaagctgaagaggcaccattgcgttagccctgtgggaattaagcgggtggttctgcatgcattctgttgctatattggatttatatagaacctagatacgaagctagaggggtagatactaagagattgtccacttacatctggactcccacatagcgctgtaggtgagacccacatggttttatgtatgtaagagaagcagagattcgttcgggtataggcgctatgccacttgtatctgggaattctgggggccgaggctatgccttagaatgaagagatgctgtgcgttggtccttagctgcaggtagcttgctaaagttaagatgtcttattcattcatcatgtttaccttattttatcgtttggatatcactctatgtttcgtcctagggtctaggaatggtaacaatggtcgatagtgaatattagcccttcctttctttgcaatgggtggataagcagttgggtgacccgagttactagatgactagtttacatggctagcggcgttcacggcatgtctaggttaagccttaaggcattgtacctaggtgccacttgacggcgttggaatgtccccctttctaattttctaatgcatgtaacctggttcttcaggacgcatcccagggccttccgcggcgtcccccgggtggtgccgcagtcgactgttgggtgttgcgttgagtcttttgccccgctttcacctgtgttgcgcgttgtgcgcgggggcggtgaacctgtccgtggttggctctggggggcccgggtatttgttgtttcccgccctgtggggagtgtgtgttacccccggggcacgcgcttgtcttggggtcggttgaaaacagccg

SEQ ID NO: 532721 - DNA, 819 bp, Homo sapiens
  misc_feature (37)..(37): n is a, c, g, or t
  misc_feature (63)..(63): n is a, c, g, or t
  misc_feature (74)..(74): n is a, c, g, or t
  misc_feature (77)..(77): n is a, c, g, or t
  misc_feature (103)..(103): n is a, c, g, or t
  misc_feature (117)..(117): n is a, c, g, or t
  misc_feature (129)..(129): n is a, c, g, or t
  misc_feature (183)..(183): n is a, c, g, or t
  misc_feature (230)..(230): n is a, c, g, or t
  misc_feature (234)..(234): n is a, c, g, or t
  misc_feature (242)..(242): n is a, c, g, or t
  misc_feature (244)..(244): n is a, c, g, or t
  misc_feature (260)..(260): n is a, c, g, or t
  misc_feature (279)..(281): n is a, c, g, or t
  misc_feature (286)..(286): n is a, c, g, or t
  misc_feature (294)..(294): n is a, c, g, or t
  misc_feature (298)..(298): n is a, c, g, or t
  misc_feature (301)..(303): n is a, c, g, or t
  misc_feature (318)..(318): n is a, c, g, or t
  misc_feature (321)..(321): n is a, c, g, or t
  misc_feature (331)..(331): n is a, c, g, or t
  misc_feature (415)..(415): n is a, c, g, or t
  misc_feature (501)..(501): n is a, c, g, or t
  misc_feature (619)..(621): n is a, c, g, or t
  misc_feature (694)..(694): n is a, c, g, or t
  misc_feature (796)..(796): n is a, c, g, or t
gctccctggcaccctccaaagatggagcgttcatctnggagaccgaaaataaaaaaggacaanagaccaggctnagngggagcggagctcaatggggggaagngaaagcggcgatcntctcctgcagcnaagccagggcaaggcactagagacgccacatccttcccatgccaccaactcgtnaggtcccacgcgaagcggagccactgaccgctacagcccagctaccntggnttgcctgngntgggagggcagcacgncttccagaagcttccaaannncaccntgaagccnaagnccnnncaggaggtctgaggngcngggggctggncaggcatagagggcccggggtggtccttcctcccagggtgcaaaggcttcttctattgttcggaagggagcggggtgggcggancccagtcagctagtgaggagttccattccagcccacccagctgggggaccctcctctggcttcacttgccccagttgagggccaanaccaagcaggagagactgaggctccagtgagaatgaggcaggacttcaaataagctgaaaaacaggaatgtggtgctaagaggccagggactgagctgccctatgcccactgcccggnnntgccctccctgcacagcaggggaacctgcgaccctgctcctgtcttttgtgttaaaggagcactctgtgctancaaccccaagaagcttcactgggagcgactcgtttttctgaatttcccacacttctaggccagacaaggagccaggggtgggaggggagggaatggggtcanggggcttgaggtgctagagatgg

SEQ ID NO: 532722 - DNA, 328 bp, Homo sapiens
agcatccttttcagctgggcactatcattttaaatcaattggtaaaaaaaaaaaaaaaagcaatccggttttaattttttaattcattagtaggggttatgtttaattcattagtaagagaaggttatgtttattagccatttggaattccttaatttctggtaatttctcctggccggtaatggacgggtatattaatttttccatatttattggtaagagttctttatctttatatggggaggccagctagcatttatggagcacttaccaggtgctaggaaaatgctagggtctgggccgtgcgcaggggctcatgccggtaatc

SEQ ID NO: 532723 - DNA, 239 bp, Homo sapiens
cccatgtgcccttcacgatgtgtctcacacactcaacttctctgcaaaagcatctccctcactcctcctgagctccgtatagcgacttgtcaatatcttgctttatataagatagagaaaagatggatccaatatatagcagcatatagatacagatcagatagatcataaaaaccacaattgcagagacacggaggagtggtatagacctatatatcccgaactgaagtgaatattct

SEQ ID NO: 532724 - DNA, 903 bp, Homo sapiens
ccccttcttgtcttactccttctttcttgccttttcattaggcgtctttttcattcggggattttgtctgggtatccgcatcctgatctccggtttcttcggcttttgtctctcttgttatggctatatcggcactggattggtgtcgcttgtgaatacttttctctgtcttactttgcagggtgcttcgtattgtcccttgtgtttattatatggtggtcatcctttatcttgattaatcattgttatccgccagcattttttccaaagtgtgcggagttttcttaatgtggcctcgaacctgaagttctgttccatctattagtgctttctaatgggttttctgtcggtcacgttctttagaatgaaagggacccattgttcccgtattcacgcgagtcgtcatctcttcttctaacatgatgtcccttacagtttatcttgtcccttttcctctgcttcaacgccatccattcctatgggcttatgagcgttcatgaggactgcatgcccatgagagagacgaggagatttctcgcgagggagcctcatcacctgctcctagtgaccgttgctccctttgtaagctcaccccattgcgcagcagtgacccttgggctggactgcccagtgctctttcagggcactacccctagctctcggatcataggtacaggcacgcatgctgaagtgggcccctctccgtcgtgacccttaggggtccatcccctcttgcccagggtccccatcattgtacccaagcagagctgggcccgaagaaccgctggcagaacgcagcactctgcatcacacccgccccagcttctgccacggcttcagtcatgggcaaggaggaacacgctgaaggagaaagagaaatgcaggagccgcggggctcccgag

SEQ ID NO: 532725 - DNA, 984 bp, Homo sapiens
gtggcagctcaagtggccaaggcaagtatgggtcaaagtcagcagtggtggctcatggctcctggaggtggcaagaaggatgacaaggacaagtaaaaagaaatatgaacctcctgtaccaactagagtggggaaacaagacacgaagaacaacaaatgggaccagatgctgccagcaaactagccactggtgacacctcacactcagggccggttcacattactgacagttagacgagaattcaagactatcttctcatggaggcaccgaattcattaggaaatcaggaacaaaatgaaacccattagaagcaaaagcaagacggaggaacagatcaaaagtggcatgatctgcacgggggaccccgatgtcagtaggaaccttggaacgagattattgactgacactcatgccatcgctgtactaccttctgttggaagctcacgaaacatctaccgttcagcaatacctaacaatatctagtagaacaaaggatacatgcctaggaaaccctggcctggctccgagaccttgctaacaaaccaaccaaatggtgcattgacaggtgcatcagcgagagtgccttgcatggattgcacatcgggattcccactggagtcacgaagtgaaatgaaaggatcggacaaagggccccccaggaaggaccgttaatgtccacgaattacttatggagagaagagatagaggatcgagacctaaaagtttccagcgggaaaatttaaaacgggcaacattcctggtggcggaagtgtttatacccttgattcactaagcccaaggtaccttgtagaccatactaactgaaacggaagaactgcggacaatttaaatggacccttaccacataacgagatggggggttccaactattacgccaataataggatatccatccctgtgggcaaatcatagcggattaaaaatccatttttgcatgatatcgccacacatgataccacatt

SEQ ID NO: 532726 - DNA, 109 bp, Homo sapiens
ttgcagcgagccgagattgcgctactgcacttcagcttgggcgacagcaagactccgtctcacaacaaagaaacaacgattaacaaaaaaaaagagccattcaagagac

SEQ ID NO: 532727 - DNA, 126 bp, Homo sapiens
taatagccggcccccctttgattttttacctcggtttctcttcgtcaggtgtggatatcggcggtagtcccttgcatgaagtgctgactacagtgtgggttccatcgtgtgaagaaagagtgctgg

SEQ ID NO: 532728 - DNA, 337 bp, Homo sapiens
  misc_feature (127)..(127): n is a, c, g, or t
  misc_feature (188)..(188): n is a, c, g, or t
atttttctgtgttttaaaaaatttattaataatgccacccacccatccggatgttaaaatattttatacttaaagaagtttcctggctgggtgtgttggctcgtgcctgtaatccccagcactttgntaggtcaaggcaggcggatcaccgaggtcaggagatcgaggaccatcctggctgacacagntgaaacccattctctactaaaaatacaaagaaattagctgggcgtagtgggcgcctgtagtcccagctacttgggaggctgaggcaggagaacggcatgagcccgggaggtggagcttgcagtaagccaagataactgtgtctcaaaaa

SEQ ID NO: 532729 - DNA, 749 bp, Homo sapiens
cacggtggctcacacctgtaatcccaacattttgggaggcagaggcgggcagatgacctggggtcagaagttcaagaccagcctgaccaacatggagaaaccccgtctctactaaaaatacaaaataattagccgggcgtggtggcacatgcctgtaatcccagccactcaggaggctgaagcaggagaattgcttgaacccaggacgcggaggttgtggtgagccaagatcgcaccattgccctccagcctgggtgacaagagcgaaaccccgtattgaatgaataaataaactaaataaactagttttaaacaaaaatagtctaaaacacacacaaacacaaaacacacacagcacacacagacacacacagagagtgaatcgagactcctaacctctcaccgtgggagtctgcactatcacagtggtagatgtattctgtcagagtatcgtctgcgaacattgaagaatacttgcgtgagaactcaggccttacagcgctgcactagaccttaaaccctatataagcgggaaatttaaaaacgtgcgtgttataaacttataggtacaccttatccacctacattctatagaagagtgagagtgctgtgtgtgtgtaaatgcagtgttatatgcacactatattatatatgttctcacatatatatcggtaggtgggcaaaacagcacaaattctgataggtgtcctccttaaagttccccaagggaacatatttactatcaacac

SEQ ID NO: 532730 - DNA, 205 bp, Homo sapiens
ggtcgacctcagagggaagggtaggagggatgtaagtcagagatataaaaccaaacaatgtatgttctcacttataagggggacctaagctattaggacatagaggcataagaatgatataatggactcttggaactcagagggaagggtaggagggatgtgagggataaaacagtacacactgggtacagtgtatacgtcgacg

SEQ ID NO: 532731 - DNA, 177 bp, Homo sapiens
catgcatttcaatgcagcccattcgccagtttccactgtcacctggcctgtgctgtcacttcagcaccatgccatggcttcacatctttgcagccccagccatcatggctccattccactccagttcatggtggggcatcctctcagcagtcgcaccttgccaggccatgccacagc

SEQ ID NO: 532732 - DNA, 320 bp, Homo sapiens
cccgccaccttcctcctgctctggccatgtgaaatgcctcgcttccctttcaccttccgccatgagtaaaagctccctgaggcctccccagaagcagatgccaccacacttcctgtacatcctgctgaactgtgagccaattaagtctcttttctttataagttactcagtctcaagtatttccttataacaatgcaaaaatggccgaatacacttgcctacttttctctatccccattttaacaccttaatccaagccaccatcatctctcacctggatcatgcaacagcctcccagctcgtctctctagggtcctcca

SEQ ID NO: 532733 - DNA, 236 bp, Homo sapiens
caacatgtcagtcccttcaacatctcatccctccttccaatatctcatgcccccttccaacatctcattgctccgttccaagcatcccatcacaacccactcccaacctcccatcacaacccactcccaacctcccatcacaacccactcgcaagctcccatcacggcccagctcgcaagctcccatcacaggcccagtccgcgaagggcttcccagccgcccatcgcaggcgcct

SEQ ID NO: 532734 - DNA, 1082 bp, Homo sapiens
gccctatcattcttttccaatgggtgctagcctgcttatggttgatgatcataccaaggactcaatacttccagagtatctatgttgcctctggtctgagggagggagagtccggttactctggcaaccatataagtggcagcccatgtacctgtcatcacatcttgaaaaataatgatgatgatatgaactagtgactaattttcccttagagattcctctagtcgttgggtcccagctccactggaagttagctcatacgatatgtgcggagacccgtattacgaagcagctggtggttctgtataactactcaaaatggacaagtaattcctaggtgctcaacgaaggtaaggatgttcagtatattgaccaataataactgaagcaaattaggcttatgtgacttgagcagttattaggtctgggggatgtgtgtaagagggttggctggatctcccaagacagttttatgtgagacatgaccacacgaaagcagtggtcttgattgattccatggtgtcctcagttgcgggtacttatcgcctggcgatagcgcagatctgtccaggcgttaagacaccttctgacccatagctcagtatgtctgaattccagaggtcaccatcgaggcttctcgacttgctgatgtcacaaactcgtcacccctctgatggctgccttcaccatctaaatgcagtgtcacacataaaacagggttccaatttgtgaccatgcttgcccactggtatgtaatctcggagagatttggcctcccgatcgcaagaacgtgggtccacttaacatagcgtacgattagatggcggtgactctcttgaagaggtaagtcaaggctgtctccgttaaacgtgcgtgaatcctctatttgcaggccctaagcgcggaatcaaatagagggatgaaacacatcgagggtggcacgctggttttgcaaaatgccgggcatctccgctgactgtacatctagcgcacggacactacttcgggataattcccaggggctcgttaaaaggtattcgttatcacaaaacaagagcggccctaatgtgccacgaccaaac

SEQ ID NO: 532735 - DNA, 223 bp, Homo sapiens
gagagagagctggattatgtcatccccctggctgttacttctgtttttcttccccttttttcctcttcccagtatagggttactactttcccaatatagggttgattcccgtttgtccttcaaacttcagatcagtgtcccctcctccggctggccttcctcgctctaactccacaccttgtttctttcactcgtgctttcattacaagctgccatggaacct

SEQ ID NO: 532736 - DNA, 887 bp, Homo sapiens
  misc_feature (404)..(404): n is a, c, g, or t
  misc_feature (488)..(488): n is a, c, g, or t
  misc_feature (563)..(563): n is a, c, g, or t
  misc_feature (858)..(858): n is a, c, g, or t
gtgaagaggtgccttccaccatgattctaggtgtcctgtggcttccccagtcacttggaactacaatagctgaagaatgtgagaaagaaaaatcaaaagcacacaaatgagactgtgcagtgaagaggccacagagacaaccatactgtctttttgtatcacaataagcaaaaataccaaggaaagaggtttattgagcacgtggttctctaggctgggaagttcaagactggacagctgcatctggaagcttctggtaaaggctttgtacagtatgaaaatatagagaaacagaaggggaagcaggtgttgttaagagaccagacatgagagacagcctcattttataacagccagggtaactaaatcagtctgatgagagcaagaatttactcttggaaaanagacattaacttctcttaacgatctaatcttaaggcacaatgtctcaacaatgtctcacttgggaacaagcatcaacgtgagtnttgatgggaacaaaccatcttcaaattataacagtttacttttcactctattaattgtgttctttgatgaatganagtttttgattttgatcaaggccaatttatctatttcttcttttttgttatctgtactttttatgtcatacctgtaaaatcattgccaaactcaatgccatgaattcttttatccatattttctcctaagagttttatattttagctcttatgtttaagtctttgatacattttgagttaaattttgtacatggtgtaatataaatatccaacttttgcatgtagatatattttcccaagcaaaattgttgaaaagactgttcttttcccatcgaataattttggcacacctgtnaaaaataactgggattatgaattcagggg

SEQ ID NO: 532737 - DNA, 1272 bp, Homo sapiens
  misc_feature (79)..(79): n is a, c, g, or t
  misc_feature (81)..(81): n is a, c, g, or t
  misc_feature (83)..(83): n is a, c, g, or t
  misc_feature (93)..(93): n is a, c, g, or t
  misc_feature (97)..(97): n is a, c, g, or t
  misc_feature (133)..(133): n is a, c, g, or t
  misc_feature (135)..(135): n is a, c, g, or t
  misc_feature (177)..(177): n is a, c, g, or t
  misc_feature (193)..(193): n is a, c, g, or t
  misc_feature (515)..(515): n is a, c, g, or t
  misc_feature (552)..(552): n is a, c, g, or t
  misc_feature (789)..(789): n is a, c, g, or t
  misc_feature (873)..(873): n is a, c, g, or t
  misc_feature (948)..(948): n is a, c, g, or t
  misc_feature (1243)..(1243): n is a, c, g, or t
gtgaagaggtgccttccaccatgattctaggtgtcctgtggcttccccagtcacttggaactttcagtaatttgcccananantggactctantganaaccgcctgaggaaagtaagttacagttaaatgaananatcttgtacacaattcaatgtatatacctgtgaaaccactancccaatgaagaaaaanaaaatttttgtcattccagagagttcactcaggccctcttccagtcaatctccacactcctagacaatagctgaagaatgtgagaaagaaaaatcaaaagcacacaaatgagactgtgcagtgaagaggccacagagacaaccatactgtctttttgtatcacaataagcaaaaaacagcgtctcagtatgttgctcaggctggtcttgaactcctgggctcaaatcatctcccacctcagcctcccaaactgctgggtttacaggcatgaccaactgcacccaggaagacatctaggaatgagaatcctactttgtaaggnactccacaagttaagaagaggttatgtcacagtaaanccatcaataccaaggaaagaggtttattgagcacgtggttctctaggctgggaagttcaagactggacagctgcatctggaagcttctggtaaaggctttgtacagtatgaaaatatagagaaacagaaggggaagcaggtgttgttaagagaccagacatgagagacagcctcattttataacagccagggtaactaaatcagtctgatgagagcaagaatttactcttggaaaanagacattaacttctcttaacgatctaatcttaaggcacaatgtctcaacaatgtctcacttgggaacaagcatcaacgtgagtnttgatgggaacaaaccatcttcaaattataacagtttacttttcactctattaattgtgttctttgatgaatganagtttttgattttgatcaaggccaatttatctatttcttcttttttgttatctgtactttttatgtcatacctgtaaaatcattgccaaactcaatgccatgaattcttttatccatattttctcctaagagttttatattttagctcttatgtttaagtctttgatacattttgagttaaattttgtacatggtgtaatataaatatccaacttttgcatgtagatatattttcccaagcaaaattgttgaaaagactgttcttttcccatcgaataattttggcacacctgtnaaaaataactgggattatgaattcagggg

SEQ ID NO: 532738 - DNA, 163 bp, Homo sapiens
ctcctgacctcacagtgacccacccgctcggctcccaaagtgctgggattacaggagtgagccagcgtgcccagcctgagactactttattgatggagcccactacaaggggatgaggaggtataagcacaccgtgcccaggtgccccccccagagagagcgt

SEQ ID NO: 532739 - DNA, 447 bp, Homo sapiens
gcagggattgcccccaccaagccccaaagttgggagtgggcaggacggggcagcgccaggaagggcaggacagaaacctggcgttggtgagattttgtggctgatcccacagcttcttgggcagatttggggccttttgtgccagagtttgtggaatctcacacaggcaagagttttaagccagtaaatacaggacatcggcatcaaagactcagaattggggtcctggaaaaaggccccccaggatggaagcaggaagccaagtgcacggcagaccacgccgcatcgggttcccggcaggccactctttaaacccgatttgtttttttccaggccttagttaaaccaggccccctaaatacctgtcattatttgtgatgatttcgcattaattggggtttttgtcccttctgttcctttttttaaaggctggctttttaaacccta

SEQ ID NO: 532740 - DNA, 809 bp, Homo sapiens
  misc_feature (9)..(9): n is a, c, g, or t
  misc_feature (104)..(104): n is a, c, g, or t
  misc_feature (132)..(132): n is a, c, g, or t
  misc_feature (149)..(149): n is a, c, g, or t
  misc_feature (160)..(160): n is a, c, g, or t
  misc_feature (166)..(166): n is a, c, g, or t
  misc_feature (168)..(168): n is a, c, g, or t
  misc_feature (175)..(175): n is a, c, g, or t
  misc_feature (179)..(179): n is a, c, g, or t
  misc_feature (199)..(199): n is a, c, g, or t
  misc_feature (201)..(201): n is a, c, g, or t
  misc_feature (206)..(206): n is a, c, g, or t
  misc_feature (310)..(311): n is a, c, g, or t
  misc_feature (346)..(346): n is a, c, g, or t
  misc_feature (357)..(357): n is a, c, g, or t
  misc_feature (368)..(368): n is a, c, g, or t
  misc_feature (393)..(393): n is a, c, g, or t
  misc_feature (488)..(488): n is a, c, g, or t
  misc_feature (516)..(516): n is a, c, g, or t
  misc_feature (523)..(523): n is a, c, g, or t
  misc_feature (528)..(528): n is a, c, g, or t
  misc_feature (591)..(591): n is a, c, g, or t
  misc_feature (626)..(626): n is a, c, g, or t
  misc_feature (648)..(648): n is a, c, g, or t
  misc_feature (655)..(655): n is a, c, g, or t
  misc_feature (663)..(663): n is a, c, g, or t
  misc_feature (666)..(666): n is a, c, g, or t
  misc_feature (681)..(681): n is a, c, g, or t
  misc_feature (684)..(684): n is a, c, g, or t
  misc_feature (694)..(694): n is a, c, g, or t
  misc_feature (696)..(696): n is a, c, g, or t
  misc_feature (707)..(708): n is a, c, g, or t
  misc_feature (808)..(808): n is a, c, g, or t
agtgggggnggccacgaccacggccccggcctgctgctgtgggagcatccacagtcgagcgggggttcttgatggtttcatctacagacacgatcaggcacgcngcctcagaggctgctgtcagcgcattgntccgcaccatagctggntcccacacganagcttnanagttgtnagcnatgtcctcgttgttgatgtntnctccntaccatgtacccccctgggcatgccgggcccgcagcttgttgagaatgtttgtggcatcaaagccagctttgtcacacagctggcgtgggataatctccaaggnnttggcataagccccaatcaacagctgctgttttcntggaatagtcnttgagttatcncgcagtacttggggagttccatctnaatggccccgccaccagccaccactgaatcattcttgatggccctcctgacgatcatgatggcatcatgcagggaccgctctgtctcctccatanaactgctcggcgccagcgacggagaatnaaggtgnatgtnttggccttggggcagacagtaaaaaaattgtacctctcgcctccaatctgggtctcttcaaanacctggcatcgacccagcacatctgctgacagagnattcacactggtctggattgancctacanaggccatnatngtcctcttcagatcntcntcaggtactngnccaaccaagannatgtccctgtcaaaaaagtactgggtggccacatccccaatggggagtttggacaagacaactttggctccagaatgatggatcttctctaacttgtcana

SEQ ID NO: 532741 - DNA, 780 bp, Homo sapiens
cttccagacaaccaagcatcaatagacaaagctctcacataatgttcactatttgggcgatgggtacacttagaagcccggacctcacaattttgcaatatccatacaacaaatctgaatcttgaaaaaagagagagacagagagagagaccaaaatgaacaacatacggaaggaacttggaagaaagagacagcccagcagaagaaaatggtgattgctgtctgcagagagaaattaggaaacaattaggaaacagagtacaacaatccaaagagctttacaaaattaaaaagcagattactggaatacacttggaataaaggttagaaaatagagaaaaatctccctgaaaacagaacagcaacaaaataaagtaacagtaggagagaaaacgtttaaaagtttagaggttcaattcaggaagcccagtattcagaagagagaataaagaaacaaagaaagaaaattactgaaggaatcatattaaaaaactttctcagaacatggatatgagtctccagattttaaaggggccaatgtaaattattgaaatttcagctcactagagattggagatgaggcttaaaaacttccaaaagaacaaaatgggtcacattaccacaggattgtccgtcggcacaaaaccatttggggttcctaatagcaggctttaaaatttacaattagagcttactttcaaaattctggggggaatttaccttcaaccaggaatttttttattccgccctttaaacagggggagggccaaaaaatgggcc

SEQ ID NO: 532742 - DNA, 957 bp, Homo sapiens
cacgaggccaagagcctgcagccccagccgccttggtgcagcgtacaccggcactagccctgcttgcagccccaggattagacagaagacgcgtcctcggcgcggtcgccgcccagccgtagtcacctgtgagttacctacagcggcagcgtgcagcgtgagccatgcgagaacggccaaaggggagcagcgtcccgagaggagcgcctcttttcagggacccctgcctggctggcggacgcgcgggaaagcggcgtcgcgaacagatgccagattgagggccctgcgggtggagagagcgacgcccgaggggatggcggcacgcgtcccggagcgcctctgtgctggagcgctacttgctgctaggtgcgcacctttggccacgcatgcgcgctggcctggctccgcgcgtcttccagccttgcagctgcatggagttccactccacctgcagcgcggcgtactgtgccagtgggcgcgccttgcgagcgccgtgctgccggactttcttccgccgtctgccttaagcacttccaggcggtcgtctcgcccggaccctgccccttcgggaccgtctccacgccggttctcgggcaccacctcctttcgctgtccgggacgacacgacgcggcggcggtgcgcaagcctctccagactgcccttcaccttcaccctggcccgggtaccttctcgctcatcatcgcaaccttggcacgcgcccatgcgactgtacctgcggccaggaggccttgcccaccagcatgccctccttgcgcaagaattcgcatccgggctcccttgctgtggggtccggaactggctacttgggcttgcccccttcccggccatcccctctcacacggcctgtcgcctcgctcctaaccggggctcctctggccgctgccgccttactacgggggagcacgcggcttcccgccgtgttcccgacacgcgcc

SEQ ID NO: 532743 - DNA, 1030 bp, Homo sapiens
ggatatgctcaagcccactctggatcgaactgaagcgcaacatcagtccaatacgtaatgaagctaggcccttactagaccaaggggagcttagacccacaaacactgagtgaacagctaagcaccctaatcaactggcttcaatctacttctcccgccgccgggataatagaaggcgggagcaagtccaccgagcaggtctgcaagctgctgcttcgaaattggcaatgcacgtatgaaaaagtcatccctcggagcgtggctaaacagaggtctaagcccgttcttggaggaagagcagatcgcaaatgctggcacatcaagaccgaattattaccctgcgagcccgcaagaaaaaaatacagaaggaacacccgaagacataggaggaaacacaagacatagggagagaattgcgggatcacgaggaagaacagcaggagtgaggcgcgacgttcggagaacgtgagggactctatagagaactttcgtgaatacataggtaggaaatcttaggggactgttcgacgattaggggaggaccaaaatgttaggaaacagataccggaggacatgagcagaattaacagagattgcgtatggtacaggaaagcaagggatcttaatgaccgaatactaacgaaatggatgaatattggaggaagaaaggatgatcttaataagacggtaacccgagatcgcctctgatggacacggcgcctctacacggcccagaagagtcaagcatcgagggaaaagacaagtaagcaaagggaccaacggagtaagcagagctaccgcaacacacgaggaaaccagacacgcccgacgacgcaaaggacgaagatggcaggagatggggcacacacaacaaaacacaaacgccaccgaggcacacaagcagcacccgaacgatagacatacaacaaccaaagacggcaaaccgacgcacaccgcaggcccagaggcagccaacgagaacaacacaacaacaaaacacaaacacacaccacctaagaaccacaaaaac

SEQ ID NO: 532744 - DNA, 317 bp, Homo sapiens
gcggccgcctactactactactactactactaaattcgcggcgcgtcgaaccctacaagcctcagagtatttgagtctcccttaacaatttcggagggaatctagggttcacaatttttgtagcacaggttccaaggacttcaagtcattaatggctcaacttttctcaataactgcttcatccggcaactaatatttcaatttacatccaaacatcactttggcttcgaagccggcgcctgatactggcattttgtagatgtggtttgaataattctgtatggctccatctattgatgagggtcttaaaaaaaaaa

SEQ ID NO: 532745 - DNA, 826 bp, Homo sapiens
gaaatggttcgctattcacttgacccggagaagcacacgaaatcatgcagaatcaatgaggttccaatatcttgcgtgttcactttatagaacactcgtgaaaactgctcagtgccatcaagggtatgcatatactgaaaagccacgaagtatctgaaaagatgtcactttacagaaacagtgtgtaccattccgacgttacaatggtggagttggcaggtgtgcgcaggccaggcaatggggctggacacacggtcggtggctcctggaatagagtgctgaatctgtgctgcacatgcttacatgaaacgcgagagagtactgctgaacttaagggtttagatgtagatcctctggtcatcgagcatatccaagtgaagcaaagtcagctaagatgcgaccgaccggacctacagagctcatggtcggatgaacccatacatgagctctcactgacacgttgaagatgatccttacgtgaaaaggaaccgattgttccttaaatcagaagaggaggttgcccagaagaaaaagatagtcccagaagaaactgaagaaacaaaagtttaattgggacgggggagtttaaatttcaggcaattaaacaagttacaatggttaaccaaagacaaaaagataaaaagaacaaaaacaagaaaaaaagcgccacaggacaatacatcatagtggacagaaagagcgagaacaaaaagaagatgatcaaaacacaggtaaaacagatgaagaacaaaacagagagtcaacatcaaaacccagcaccaggattgtgcaaaaaccagacgagtaaaacacgagaggaaaaccc

SEQ ID NO: 532746 - DNA, 139 bp, Homo sapiens
aatatttatacttcctctcacgctcatacttgtatctcaacgcttatacttcctctcaacgctttatacttcctctcaacgctttatacttcattcccggtatgaagtataaagcgttgaggaagtataaagcgttgag

SEQ ID NO: 532747 - DNA, 222 bp, Homo sapiens
gacccaatggcagatctcttatattggctcccacgggttccagctcctgccaccagcctgcataatggcctccctccagcaccgagattgatggcggtgccgctgcccattagcctccagtggtgcccagtggctcgccacatgcaatggctgcattccctgccagctcagcccctctgaaatctgcccctacttccattcttccacctgggaggccatcac

SEQ ID NO: 532748 - DNA, 215 bp, Homo sapiens
tagaaaagcttcagaggttaatgcgacatctataaataatgtacctaaagtatctaccatagtaaggaattctagcttttctccttttcttcttaaaccttttttagcattctctcttacgcactagagaaacctcaccagcccacttattttgaacattatctgaaatacttttgaccattttgagcaacagtgttcacatctgtctgtcttta

SEQ ID NO: 532749 - DNA, 1617 bp, Homo sapiens
  misc_feature (408)..(408): n is a, c, g, or t
  misc_feature (554)..(555): n is a, c, g, or t
  misc_feature (557)..(557): n is a, c, g, or t
  misc_feature (612)..(612): n is a, c, g, or t
  misc_feature (663)..(663): n is a, c, g, or t
  misc_feature (965)..(965): n is a, c, g, or t
  misc_feature (1538)..(1538): n is a, c, g, or t
tctctcattttattacaatgaagttaaacagtacagaaaatgtcactatggaccttggtgggtgtcagatttcttaaaaccctggcaactatggaggacactctaatatactttaaattattggttcccctattcagacttccgaatggtccaagtcactgggaaacagttaacaagccctccaccaagctaaggttgggggcacttgaatgtcccaacgagctatctggaatatggctggtggaagggcacaatctttcacaatataagcattgtgtcaagcttacacgaaaatcttggcgctttaactagagggtggggtatatggtctcatatgtgtaatatcttccgagcgcgccttcacacaatatttaacacggacacccaatatttacactatatacactntcacactttcttaaaaacaccttaagtatggcacacactatgagcacaaaaagaaacgcccatatacacagagtatatacaatatctggcgcacatcttccgagagcaaacatgtctcccgtgagctgttttaattatatctcccnnanatattatattgtgttctccccctatgtgtgcacacatatcaatatgtgtgccccnaataatgttccccctgggtgtttatgctgtgggggcgcacaacgcaatacnaatggtgtgtcccgggtcgtccacaacaatgtttcccacacatatgtggcaaaacgctcttttctattatggcaacgggaaagacgcattgggggcgtttcattctataacaacacccgaggcccacccaacatgtttgcggccacgccacacacgcggggttgttaaaattcttgcgcgaaaagactctttatatgtaaagaactgggcgttttcggaaagtttaccaggaactcccgacgattaaaagcggggccgccgcactcgttgtgggcgaacactattctcacccaggggggagncggtgcctcccattatcccccccattgctgggacagagtgtttcgcgcaaagggggaggggccgcccaaccctcctgttgtgttcacgatgcggcgggtcgccccccccacttttgtggggcgggcgtcccctttgtgctcgcccacttctctacgggggggcggcgatttaaatcgaccccgccgagggacagacgggactaccccctcgggacaatgacactctttgtctgttgaaggatggaggccccccaataaatgttgtgcgccccacaagaagtaggggggccaacaggaggggagagaaccacaacaccccccttggaacagggacgagaggaagaaaccacacgagaggagagaggagggaggaggcaaacacataatcccgcccgaagagtgggtcccccccgggggcgtgggtatctccaacacaggagagcggcctgaccatctcgcagccgaacgagacacaacactcgtggaagaaaaaggacgaggaaggagcgcacccctatatacaaagagggagagaactcaatccacgaagaggagaagaacactaccagtagngcaagagaaagagcgatatggatggcaacgacgccaaccctgtatgtgaacgaacacgagcgagccgacaacacaccac

SEQ ID NO: 532750 - DNA, 499 bp, Homo sapiens
gaccagaatgtaaaagaaacaactggggggaaaaaacaggtccacagtgatagagcaagcatcaaagaatctttaagggaggttaaaaaaaaaaaaaaaaaaaaaaaatgggtggcctctgccttggtgaccctgagtccaaaagggtccacaaggtgtttttttggtgatgtccctcacctaaacaaccagaggcgggcttgggggctaccctccaacccaggggcttctcaaatgcctcggtgggcatcagtatgtcactcgggtccctttaaaagagcactccgggaaaaagcaggaggggagggggggcttggctgtggtggggacagggcattctagacgggtagcagcgctcgctgacggctggggaggaaccctgagatcggggtttttaaattggatcgtcctccgggggagtaaaaaaggcgggtcgggagtgcgtgattgtggcttaattggtgctggaggctggtcccgcggggggaccctctagagt

SEQ ID NO: 532751 - DNA, 379 bp, Homo sapiens
  misc_feature (51)..(51): n is a, c, g, or t
  misc_feature (78)..(78): n is a, c, g, or t
  misc_feature (161)..(161): n is a, c, g, or t
ccccaaaaaaaaaaaaaaaacctcccccccgggttttggataaatggattngtggttggaaattcccatagggggcangttggggggagtggttggcccataatggataggtaaatcctccctaatcctatgagcagggatgttttccccatttatttaanctttaaatattttattattttagatctattgagaatggaattgttttccttaatttcattttcaaattgtttgttgctagcatatagaaatacaagtgattttgtatattgctcttgtatcctgtgactttgctgagcttattttagtagttttttttcactgaattctttaggattttctacataaaaaattcatatcatctgtgaataaagacagt

SEQ ID NO: 532752 - DNA, 297 bp, Homo sapiens
agtctgactctagagatcccagtggagagagaacggcaactatctgacactccagtgctatgggagcatcggtactgctgggtgtgtcttccccaacggaacggagtccccaacaccagaagccgcggcaccataactgcagtgagtcactggaactggaggacccgtcttcttgggctgagtgtgaccaagcaggatctgggcccagtccccattgttgagagcagcagaggcggtcttcaacatcctgcacagcccacagagctacagatttcttgctccttttctctctccact

SEQ ID NO: 532753 - DNA, 376 bp, Homo sapiens
  misc_feature (61)..(61): n is a, c, g, or t
  misc_feature (73)..(73): n is a, c, g, or t
  misc_feature (81)..(81): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (134)..(134): n is a, c, g, or t
  misc_feature (143)..(143): n is a, c, g, or t
  misc_feature (163)..(163): n is a, c, g, or t
  misc_feature (166)..(166): n is a, c, g, or t
  misc_feature (168)..(168): n is a, c, g, or t
  misc_feature (171)..(172): n is a, c, g, or t
  misc_feature (184)..(184): n is a, c, g, or t
  misc_feature (202)..(202): n is a, c, g, or t
  misc_feature (255)..(255): n is a, c, g, or t
  misc_feature (325)..(325): n is a, c, g, or t
  misc_feature (353)..(353): n is a, c, g, or t
  misc_feature (368)..(368): n is a, c, g, or t
cttcagtcctgcaagcaaagtgtacaatggcattttggagaaatcctgtagcatgaaccanctttccagtggnatcccggngcctaaacctcgccacacatcatgttcctcagntggnaacntcagtaaaccangttcaggangccccaagttgttgccagantangnagnnatcccacatganctttgtcataatggaganaaaagcaaaaagccatcaaaaatcaaaagcctttttaagaagaaatctaagtnaactggctgacttgatggaatcatgttcaagtggcatctgtaaactattatcccccacccttcactcccnaccttttttttgggttaatttagggatntaactccattggggntttccagg

SEQ ID NO: 532754 - DNA, 215 bp, Homo sapiens
gtacggatcagccgctggtcagaagaagcggctgcgccgttatcgatgaaacgggcaccctttgcacgatatttgtcagcgcggcagaagaggattggaagttgaattgccagcggcggtgttggctgaacatcaccccccaggccaaattcgcaccgatctggggggctgatattcattctttgaagtctatgaggatcaaatgggtaacagac

SEQ ID NO: 532755 - DNA, 163 bp, Homo sapiens
ctctagacggatcccccgacggtctttaccccgaagactctccaaacgaccagcatcaaccagtttataacaaatattaataataaaagtaacaacgactctcatttcttctgtgttatacattgtgctaagtgccttagattacctcggtgtcagaccgtcg

SEQ ID NO: 532756 - DNA, 640 bp, Homo sapiens
gcatccctgggagggccatgtgtcccagacagataccagcctccgtgggcacctcctctgccaatgcctgtgatagaggagtttctgccatagccccatgtcccatcctgtgcgcctgtggggacctgggtgactcgggtgcttgtgagtgtggctcctgtgtcgccaggagtgtctggttcctgagtctcagcgcctgaaccttctggtgacatggtgtgagagtctagcttatccaccctctgcttcgcccttggtccatctgtgcagttggcctgtaggataaagaccttccagtctcctgtgtacttagatctctgggggataagggagtccaggttggattatctcaatctcccgtgggcagctcaagccccaaatggttgggggaggggcctagacaaggctccaggccccacctcctcctccatacgttcagaggtgcagctggaggctgctgtggggaccacactgatcctggagaaaagggatggagctgaaaaagatggaaatgcttgcagagcatgacctgaggagggaggaacgtggtcaactcacacctgcctcttcctgcagactcaactctacctgcccccatcataagggcactgagccctatccaggctggatactaagcaaa

SEQ ID NO: 532757 - DNA, 606 bp, Homo sapiens
ttttttttggaaaagttcatttattatataccattttacactttctgtaataaaaaagaagcctcccaatccattgcgccatcttatacatgaaatgcgaaaataaaattttcatctgtttacaaagggggttaaattaatcagcacaagctatcatatgtatgtctgccctgcagtatatatgaattttaatgaagacatgtggagaaaaaaatggtgctttattatttggcactataggatgctcttgaacattgagaagataccttattccactttttatttttgtatactttttagatgagtgaaaatgtaaatatatcctaaagacgctctttgacttattttactcaaattaaaaaatttgaaaaggacgtgtttgacacttgtaccttcataattggctttactaaaatataaaacacacaagtgatctttgctctgatttgaaaaaaagggtcggaactccagaagttttaggctgtgagttggaattttaaatccattttttgttagctttgttatgaaagtgaccaagaatgaacggtggcattttttcgcaggggtaccccttatacttaaaggtggaccacttatttatttttt

SEQ ID NO: 532758 - DNA, 180 bp, Homo sapiens
tacactaacatgggagtggggtcacgaaaatatgccatttgcaatcaggagaaaaaaatgggaagtttcactacagcattgttcttttcagtctggctcaaactattccctatcgactatgggctgaaaacagatctcggacagggtgagaaaagaacatttctaggggagggggaacag

SEQ ID NO: 532759 - DNA, 186 bp, Homo sapiens
tagtattagaggatctttggaggcaggacactgaggagactggagatagtgctgctgtccccgtgttggtgtgcggactggaggagccgtcctggagggtcttccccttgctgggcctgactgagcacgagcagggggcctcccctgtgggctccccggaggagggctgtgacgtgggtgctggcc

SEQ ID NO: 532760 - DNA, 422 bp, Homo sapiens
  misc_feature (92)..(92): n is a, c, g, or t
atatgacgtcagaaataaatcaagaaactacccaaactggagacctaggcaataaaaatttaaacattgtactttttagcatcaggcgcttnttggcatgtgctgattgccttagcgtgtgtgttggccctgtgagttaggccacctaatctccttcctaatgtattttggcaggaaaataaaataaaataacaagaagaagaaagaaagaaatcccacagaaacagataacctaacacagcccgtgcaacgtattttatacaatgctctgaaaatcatagtctcaatctagacagtcttttcctctagttccctgtattcaaatcccagtgtctaacattcaataaatagctatatgaaatcaaacactctctgccgtatatatgaagaccttcagtattatttatcccaacagcgcctgg

SEQ ID NO: 532761 - DNA, 193 bp, Homo sapiens
gaggattccgagtgtctccaagagcacagtatcctaggacactggtttacgatacaccacataggtccagtaataccctgggaattcccaatgcaatcaccaactttttctttttataaatatataaaacacaacaaaaagtcagcaaaaccagcattatgatgtagcaaaacagagtataaactctgaagtc

SEQ ID NO: 532762 - DNA, 580 bp, Homo sapiens
  misc_feature (127)..(128): n is a, c, g, or t
  misc_feature (148)..(148): n is a, c, g, or t
  misc_feature (164)..(165): n is a, c, g, or t
  misc_feature (347)..(347): n is a, c, g, or t
agcgggcaagccggcaagatggcggcggctggggctggccgtctgaggcgctggtgtgcatcggctcctgctgctgcggagcccccgcctgcccgcccgggagctgtctggccccgtgcccgaactnnctatcacaagaacggttgtntgaatcattatgaaannatcctagaaacgtggggtcccgtttggaacgaaggggggaaaaaagggtgaaaaaaggggttttttttccccggggttttttaaagaggagaagaagttggttgggagacttggcaactgggtgtggggctccgagcggatgtggttgacggtaatgcagaattgacagcagttccaagttngggcacttgcaaaacaagcgggcgcaaaagggaatcttgggagctgtaggggggtgaaacccttttttgggcgccctttttaaaagagtgtgaggggtattttgtggtgtgtgttatacaacgtgatcgatactgagataaattgggtaaagaggttttttttagacgcgatattggaggatgggggtgcccccttttttgggggcatttgggacgggcgacattttgtgacc

SEQ ID NO: 532763 - DNA, 634 bp, Homo sapiens
tacagactgctgcctcggtactagaccgagggttcccagaagctgtcttaccattgcaaaaacgttatagcaacagcctctgattacgacatgcctgagcatcaccaatatccgacctaccttcagactgtgtcaccggctggtggccggcctcatcggggcctctgtgctgcgctggtgctgtgctctcggtgaccgctctttgctctggctcactgctgacacctagcaagcgcacgagaagaagcacagagaacccaccatacaagtttattcacatgctcaaaggcatcagcatatacccagagaccctcagcaaccaagaagaaaatcatcacagtgcggagaagacaaagatggtcctgggaggagaaggtgagacgtaggaacctgtaggtggacgccacagagagctggcctagctaagccgagacaaagatcccaggagagcctagactctgcgaatcttgtatagaccaattacccatcaaaatggactatgagggaagaaactaaggagccctattacaagcctgaccctggggagagcaaaccactctccatcattccacaggagatgtgagccagatccccactctcgcggccttactcccgagaacccgtcgcaaacagg

SEQ ID NO: 532764 - DNA, 261 bp, Homo sapiens
tttccaagagcgaatgctgtgctgctcctccttgggctccgtcaagtcgagggcagaaggtgcgggaaggtcggtgggcatgtgcctcggacctggtacttgtaccctgtatgtgcggcccagtacgcggatcgtagtaaagaggtcggcgtcttgtctgctgtgtccccgactgcatggagggccatgatgctgtccgcttcgtgacgaacgcgccgatccccgatctcgtgtccgagctccgggcgtgagtcgtgcagc

SEQ ID NO: 532765 - DNA, 379 bp, Homo sapiens
tgagctcgtacccggatcacaaaagcggcaagccaaggttcatgggccaaggatctaacccatcccacagcagtgacctgagctgctgcagtgacacccaccagatacttaacccaatgcccaagaggagaactcccaagaaagcagattttgtttgttttttgttttttagggccgcactaccgcttttgtgtggaacacaaaagcggaaagaaaccatggcagagttcccgtcatgacgcagtggttaacgaacccgactaggaaccatgaggttgtgggtttgatccctggccttgctcagtgggttaaggatctggtgttgccctgagctgtggtgtaggttgcagacgcggccgcttttgtgttccggtgatcc

SEQ ID NO: 532766 - DNA, 88 bp, Homo sapiens
agggaaaggggggggtttttcttttcccaaaggccccgaggccccccccaggagggttggctttaactttttagggccgccaatttcg

SEQ ID NO: 532767 - DNA, 876 bp, Homo sapiens
  misc_feature (177)..(177): n is a, c, g, or t
ggtttggcagacgctagcggcgagtaaaatcgtgtactattagccatggtcaaccccaccgtgttcattgcagactattgccgttcgacggcgagcccgttggccgagtctccttgtggagctgtctgcagatcaggtcccagagatggcagaaaattttcgtgctctgagcagctngagagaacgggatttggttgatcagggttcctgctttcatcacgaataattccaaggttcattgtgtcagggtggtgatcgttcacaacgccataagtgttgactggtggcaacggtccatctatggggagaaatttggaacggatgagaatttcatcctagagcatacgggtcctgcatcttgtccatgggcagtatgttggacccaatagcagaatggttcccagttctcccatcgtgcactgcaaagactgagtggtggatggccagcagtgtgggtgttgggcaaggtgatagaaggcatgcgtattgtggaggcatgggcgcttgtgggtccatggaatggcaatgagcagcaagaagatcaccatgtgctgactgtggcactcgacttaagtggactgtgtgttgaatcttaaaccgaccaagatcattccttctgaaggtcaggaagagaaccctccatcccaatagggtcgcagatcctagagtcttaggtctcgtggaggccctgggtccatgttgctgggtgccttcccatgctagtggttgcgagtgcggttttgctgtgaattacactgattggcacttgtgagaagagaaagaagtgttggggcggccgaaggattaacacggtggggggccagagtaaaaggccaggccgaagggaaggggccccaaaaggggagggtagacagg

SEQ ID NO: 532768 - DNA, 984 bp, Homo sapiens
ctgtctcgactgttggtgatggtcaacccccctgttaccgcgtgtttcccaccaatgttttggtgtgtttcttgttttgtgtttctcccccccccccgcctgttttgttgtgtgtgttccttcaggtgtttgttcgctcctgtctcgttggttgttcttcttgtgcttggttacctccgtgccccttttgaaccgcggcttgttttttagattttggccccccttcttttttttttggtgtggcctctttctttggtggttttcttcgcttggctccgcccttgttcttttgggttgtgtcccccccctctataattattagttttgtctgatatatgtgtatattgttttcttctgtgtctttgtctcccccccgttggtgtatttccatccgtttttgtatcttttttgttccccctcggtgattttgtttgtggttgcgcgcctctctgcgtcccccctcgctggatgccctctttgttcccctctttctctcctccctctcttcttaagtggctcccccccgcggttttttcgcccctcttttgtgttgttttcttgttttgttttttttttgttctttcttttgttgtaaaacacactctgtttatatgtaggtggtggccgcgctttattggtgggaattttgtcccaatataccccccctcccctccctatatttctttgttgttgtttatgaaattgatatgggaggtgtctcctcccttttttttttgtgtggttgtatatttctcccgccttgttttctttgtttataagtggggaatatgtgttttctctcctcgatttttttcttgttagatactgctctctcttctccccttctctcctcttctttccttggtccccgcgagactctctgctctcttgtattcttcttgattttttttttttttttccctctttttataggcgctctttcttcccttaaggtgggggtaaaaagtgtgtcccctttttata

SEQ ID NO: 532769 - DNA, 1441 bp, Homo sapiens
  misc_feature (563)..(563): n is a, c, g, or t
  misc_feature (1132)..(1132): n is a, c, g, or t
aaagagtgtacacgcaggatgtaattgttgaacacgtccttgccccccggtgtgttgccgcggaagggccaccttgcgtgggggaagtttgagagagaagttggggtggccctgtgtaaccccctttgctgtgggtgaacggccctccctcttttgtggtgctgctgttgtgtgggccttatattggtagtcgctttctcctcccccatggggtgcccacacttgctgttcggcgcaatttaaattccggggcgctttggggggcggcccaattattattggtcgcccaccggcgccgcccaactttggtgctttgcggggcgcgagttcttgtgtggaaaccccactttgtcccggggtgggttccctcacggaggaagtgttgttctctgggtagaccaccacaaacgggggcggggtcccaacaggcccccaacaaggggcctctttgatgggggaaattccatccgccgcggggtaatttttctccacggggccacaggaagttgttttgtgtgttcttaatcccccccgttggaggaccattgggcgttggccccccncaaatctctggagagttgttcaagttccgcggtctgtgtgggccctgggctcccccgtgaagcacaccctgccacatcccgcagggggaacttctttgtccaacccccacggagacctttcttctttcccacggagatagagatgatagggggaaacacacagcgctggtggtttcaagtcacacgcaaactcacagccacgcgggggcgaaaccttcggtgataaccccacgcgagcgagacccttgtatcacccgggcccctctgtgccccacagctgggtataagagattgtcacacgctgttctggagatctcgtgagatgttggagacgagaggccctcacgagaactcaccgtgtcctcatcacaaaccaccgcgctctcttctctcgagaccctcgtagaagagaactcgtgtgtgagttttctggcccgccacacacattgggccacgctggccacacccaccagcggagtaccgcgccacacacacgccacatgttctcctctgtttgggcacggctaacacacacactctggctcgggctcgcgctctcgagagagagnggggagagccgcagatgcctctcaagtgagaactcccaaggctcgtatagcccacaccacgctatagagagagatggagagggcccgcggagaagcacaacccgctgccccctggtatttgtcacgacaccaccccacggcttgaatttggagtccaccacggcacgaggcccaagggagaaggtgtgatttcttctgagggagaaagaagtgagttttgaataataatgtaacttgtcacacacttggtgttggaacacatttgcgcccaaagtatggtaattttattattaaataatttttctgaga

SEQ ID NO: 532770 - DNA, 841 bp, Homo sapiens
gcgcagctggtgctggtgacgaaggggacgggcagacgaccgggagcacatagcggccgggagcccggctgcacaccaggctgctgctttgtccgtctatccagccgggcagcgagccacgcgaagcgcaaccggtcatacgttacaggtgcggggcccggagaacgcacagcaccgccacgtgagaccaggccgacagaacatggaccagctacgatcctgtttcaaaaggcagactcgggaactgcgcgtgaatgtggcttgtgggacacgagagcctcatcatacttgagtgagcgaacaagcaagaacatttcctccctcccggtcctttgaattgaacactggcacagttaaggacttgtcagcgagcttctcacatagggactgggagacctcagttccgttcacacccagcgtagtcagccagcctctggagtccaggccaggaggcacccatggcttcatccggcacaaggcaaacaaaacgcctatcagcacgcgctagactagatgggagcaccattgccatattagtgagagcgcaagcagcccaagcccacattcttggcacccgtgcacgcaagggagaatcagcaccaaaggtaataagagccctggggagcaaacacggaagcaagaaactggagcagcgagacattgcgtcggtacacaaagggtgaaacgaccacttgtggcccccgagtggaggaccgatggcatagtaaaagcgtagccactccttaccagtcttagcccaagaatatgccccttcgacatagaattacggagaggatggaataataacacgcggaagtaacactatcagatacaaaatagc

SEQ ID NO: 532771 - DNA, 145 bp, Homo sapiens
tgagtagtagtattgtattgtagacatctgttagtctcataatacagtatggccaacacacagaaattacaagtagaaacaaaatgagggcacacttgctccctgtccttgtgttgggccctccaacctcctattagaactggct

SEQ ID NO: 532772 - DNA, 250 bp, Homo sapiens
ttttcaaaaagctttttttttgttgggaaggtggggttttggggggggggggggtattagcccgtggccagaaaaagcttcctttaaaaagaggggaaggcttttttttttgttttgggatttttttttttgaagggaaatttaactttttgggcaagggggactattaacccccttttcggggttttacttgggggggttcccattccaacccccccttttatttttaataaaacggttcccttgttta

SEQ ID NO: 532773 - DNA, 746 bp, Homo sapiens
tttatttggggtacatcttgatttaatttacaaataaaaagccaaaaccctcaatgcgaaaggaaaactgcagttaacacttattctggagatcattttaaaccacagaaaatgtgcccctgtagcactgttttaacatggcaagtgctatgattggcccagattatccataaactgcttgtgtggaactccataagatgaagaaattcataagtgaagaaagattgggtttctagtcttgtctctcctaggtcacgaacaggatatttcccacaaaatgttttgacctgaaaggaatgtatgatcccagtacttctggtcttacctcttctgaattacactgcaagctgaacttcgggtaaacttcagccacattttcttttatcaccattttccatgtagcttgggcttaaagccctctttgcgtgtcgaactcagttcctcctgtactctgtgtcggatcatttcttcctcacgccgcgatgcacctcttcatgtctaagtagtattaggctcccgttttagcaactctgtggtttcttgagttcttcccaagcgtctgagatccttcttgacgcctcattagatcttgcttcaattagcacttaatggggtgttcaagcctagcgtgcttccatttctgcctcccaggtctcttcggcttctctgaagttctatcacctgctccgctgctgtttccattcatcagacttcctcggatctctccattctttccgttgcccctg

SEQ ID NO: 532774 - DNA, 102 bp, Homo sapiens
catgcttgcacgcagggtgcgtgtgggcatcctactgggcgaggcgcccgtcgtgtgctgcttcacgtgaccgggctgtcgtgtgggcctggcgcggggtcc

SEQ ID NO: 532775 - DNA, 149 bp, Homo sapiens
tggaggatactctagaagtcgacagctccagcttaacgatatttggaggtcagcactggtgctcacgtagtcgacggaactatgtacagggaggcatagcaccgcatggtaaatacacgtcgaccaggctacatgtatacgtatctttg

SEQ ID NO: 532776 - DNA, 350 bp, Homo sapiens
gaggcactaggaggttgaacaggatcattcttcacgataatatatctgccttgacaagcacagcggctactagtacccaggaaagtgagctacaggagaccgagtctttctttgtcgtaccgttccacgagaacaaattttccccaatccatcatttgactgcgctgtttgggagggatatctgatgtttgttagcaccgttctcttctttaagactttttaagtaaatcagggacgctagatgcacgaaaacatgtatcaaatactgatgtattccggtgcataatggtccctatccacacttgtaaccgcactacctctcagaattggagaacagagttcgagcagtg

SEQ ID NO: 532777 - DNA, 303 bp, Homo sapiens
ggtgcatcgggacggccaccgtgcaccggtgcctcacctcctccctgtccaccagtgttttcctagtgagcaggtgaaccaggggccacgtacactctggagtctccccgactgggacccgggccggccgcatacactctggagtctcctacactgagacccgggcctggctgtctcaggcggctcccatgttggctctgggtacagcccgggaggcgtgtccagggccgtgttggcgcctcccctggagccactcacctgtttgctttctcacccagtcctcctcatgcagaagtaccggcg

SEQ ID NO: 532778 - DNA, 205 bp, Homo sapiens
agcatcaaagaaatacactgatatcctctgtagaatcttgaggattccatcttgacaaattcctctaaatccccaggggaagagttgtttcgagactcctggatgccctgagggagcggctccagagcttgccttccctcctctgttttcacaacggtccagcgataggcactgttctctgacaatccttcttggcactgtttat

SEQ ID NO: 532779 - DNA, 468 bp, Homo sapiens
  misc_feature (177)..(177): n is a, c, g, or t
tggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagaatagggagcccaggtctccnatgggggcaaggaagcataagaggatgtttttccagggaagggggctcagaagctgcactaggccccgaagtcccctatgtggtctcctctgaatatgatgaagagtgctcctgggaggggatgacgtgacatatgtggatgttgtcacccggggactgcaaacagtctccgtggcacgcccccagaagagagtgacccatgaggctcaagaccagtgctttgttgtcactgctctgcagtatacctgagattataaactgaattgcatagaatgaagaaaaataaaaaga

SEQ ID NO: 532780 - DNA, 235 bp, Homo sapiens
ctctagaggacccccttgcgggcttcatattcaggtcaagctctaagcactcctgcagccaacttttacgtagactggctttcctaggctggggcttgaactacatgtaaacgaagccatggagttcagatctagatagcagagaagtacgtctcattctaaaacattgcaactactgtcagagtcctacccctatgatgctgtagcagagtggtgatatcttggacctgaagtt

SEQ ID NO: 532781 - DNA, 256 bp, Homo sapiens
  misc_feature (14)..(14): n is a, c, g, or t
  misc_feature (16)..(16): n is a, c, g, or t
  misc_feature (58)..(58): n is a, c, g, or t
  misc_feature (81)..(81): n is a, c, g, or t
  misc_feature (136)..(136): n is a, c, g, or t
  misc_feature (174)..(174): n is a, c, g, or t
  misc_feature (217)..(217): n is a, c, g, or t
gtcatttggaactntnttaccaaattttaaaacagctgctatttttcctgcccatgantgatagactggataaagaaaatntggcagatatacaccatggaatactatgcagccataaaaaggatgagttcatgtnttttgcagggacatggatgaagcaggaaaccatcattntcagcaaactaatacacgattagaaaaccaaacaccacatgtnctcactcataagtgggaattgaacaacaagagcacatga

SEQ ID NO: 532782 - DNA, 694 bp, Homo sapiens
gcattgaaattttgcccaggttaacctgttttgttctggaaagggggcaaagcaaggtcaattactttctaaaaataaaagcccatttggacccacaaaggattgggaataaccccctccccctccttgtttaaagcccatgagcccccacgccatacttttcttagttgcagccccttgggaaaagaaggggtgcatgaactccccatagtccacaggcgcctccttatggcccaagtccttcttcacaatcaattttgtagcccgagcagcagctattttcaaaaaagtgtaaagctgttatggtcccacatttcatggtatgtacaggggctcgtagtaggaataatgcagagctttcccccggaagatttggaggggtagggggtatatataagagtagcagcctttgaccaggagtggtggctcacgcgtgtaatcccagcactttggaagggggaggcagtcagctccatatgtcaggagatcgaaatcagggtggccaagataataacgccccgtctgtactaataaatacaagaattacccgcacgtggtagcgtccctttgtttcccacccccaccgaaatcgtgaggcagagagaatggcgtcaactggacgggaacaggttgcagtgagccaagttcgcaaccctgcactatagaatggtggacagagccagactccgtctca

SEQ ID NO: 532783 - DNA, 132 bp, Homo sapiens
ccttctcctgaatgtgcactggcaatctggctcagagagtcaaggaagttttggccccatgtgccattgggtgtcatccagagagacctgggccaagactggctgtgttagattgactatcactaaatctgc

SEQ ID NO: 532784 - DNA, 136 bp, Homo sapiens
gtaaagagataactgtaaaatatatactagcagtattattcatataagctaagaactagaatcagcccagatgtcggtcaatgggtaaagattaaagaagggggtacataccatgaagtatactagtcaacaattt

SEQ ID NO: 532785 - DNA, 531 bp, Homo sapiens
  misc_feature (64)..(64): n is a, c, g, or t
  misc_feature (75)..(76): n is a, c, g, or t
  misc_feature (85)..(85): n is a, c, g, or t
  misc_feature (130)..(130): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (160)..(160): n is a, c, g, or t
  misc_feature (162)..(162): n is a, c, g, or t
  misc_feature (168)..(168): n is a, c, g, or t
  misc_feature (196)..(196): n is a, c, g, or t
  misc_feature (220)..(220): n is a, c, g, or t
  misc_feature (237)..(237): n is a, c, g, or t
  misc_feature (243)..(243): n is a, c, g, or t
  misc_feature (249)..(249): n is a, c, g, or t
  misc_feature (269)..(269): n is a, c, g, or t
  misc_feature (271)..(271): n is a, c, g, or t
  misc_feature (284)..(284): n is a, c, g, or t
  misc_feature (288)..(288): n is a, c, g, or t
  misc_feature (298)..(298): n is a, c, g, or t
  misc_feature (320)..(320): n is a, c, g, or t
gaattctttatttgtgatatccataaacgttgctattctctatttctatccagaaaggcaattntcacctataannacttttgtncttctctaataaacaacaacttgaatgcaatagcaggaaagggcnanaaanananatttgtaaaccaagcagaananacaganattttgctttacaacttgcacctaaaanaccagtatacgtagctggttcatnagttgtaatagcaattnagggcnattgcncaagcaatgcatagcagtananattttcaaacctnaaanagaaagggcnattgtgaaatgaactggcaacnacattcctgtaaagcccatctcagtaacaagcaaatgtgtaaacttccaattctgcaaagaattttgatggcaaaacttccaaatctgatgcaattgtcttaagcaagtatttaaacaaattgtttcgcagcaactctgccattctgccagtagatggtgcaacaaagatcgggaaagggatttccatgaggccaacagttcggatatagg

SEQ ID NO: 532786 - DNA, 742 bp, Homo sapiens
gggcgcggcctgtcctactgctgccggcgccgtggtcgtcatggcgggttcctgaatactgattgagattgagaactttaatctcgtacaagggtcgagcagattatcgtgaccatttcagaggttcaccgccatcattggacccaatggctctgggtgctgtggaatctattgccatgaagaaccccaaatagaggacagctctatttgaagagattagtcgttctggggagctggcgtcaggagttatgacaagcgaacagaaggacaactggtgaaggctgacatgaggacacacaggtgtctaagttaccagtcgcaaagaaacaatattgcggctgaacgcaacggaagcaaagcacggagcaacagacagtaggctgagccggtaccaagcgcctgaaggatgacggtagtacgggctcaggtacaggtgtctagctctttaagcctgttaccagtaactgaagtggaacattgacgaagctcaacaaggaactggtctcagagaaccaacggagatcgagaacgacacggtaagcgtactggacacaggctggaggactgaatcttgtcgaggacgcacaggaccgacacgagcctcggcgcctatgtattgacttgcggggtatacagtgagccagcggattggccgtaaggatcagtccaaggccagaagtgacatgagtaatagccctgcaaaccgggggacctccagtacattaaaaggcacggtagaccc

SEQ ID NO: 532787 - DNA, 286 bp, Homo sapiens
tgcaggacgttcacttgggtgacaccgaggtgatgccacggtcctcggcaccagatgaagaaccactgtctcaatgaggtccactgctgtgtgtgtaatggttaccgtgagagcttccctacaatccgaatttgagtgactcattctcagtgacaccagtgatgctgttaaacaaggacaatccggttcatggattgtgacaacgcacgctgacatcaagcagaccctgccgtcacgtacagagggcaccacagtgaccaggaactgctgtcctttcataccaggt

SEQ ID NO: 532788 - DNA, 710 bp, Homo sapiens
ccacgcgtccgctgccgcggtctcatgaggggcccgagcagaagcaggatagttgctccgcctctgctggcacatttccccagacctgagtctccccatcaccccaggtggtcccctccctcctctgtccctagtgtcagcttgctgccctaggctcgcgtcagtatcaggcctgccagacggacccacccagcacccagtaagctccaattaacaagaaactcacccccaaggggcagtctggaggggcattgtgacagtcagcttggcgttagaatgcggaggaatggagagaaggggaggagggcggggggctacctactacatcgcctccacatccctgattcctgtgctaatggaacctgtgccagagatggaggttctctccggagtatctgggaactgtgcctttgagtttcctcaggctgttggaggaaaactgagactcatgacacggagatgggaacggccccacagagccaaggtacgccctgtgccaggaggctgtgtcgagtctcagggttggcatgaggtgggatatccctatgtctgcctaggcttgaccgttgaactcctggtgctctaagcagtcataccgcgatcctcaagactcgctgtgtacgctgggatccctagcatgggagccagcaatgcccgagtcacagggtggtctccctaggattgaccttgatcagtctacgatgggtcgg

SEQ ID NO: 532789 - DNA, 127 bp, Homo sapiens
gctgtatcttatttgctattacaagattttcaaggctctactggtcaaactgctgaagagtcatgaatctaggcacccagtgaaccgtagctgatgatccccgttactctcgagttcccgtgacctt

SEQ ID NO: 532790 - DNA, 247 bp, Homo sapiens
  misc_feature (158)..(158): n is a, c, g, or t
  misc_feature (216)..(216): n is a, c, g, or t
tggaagtagattattggtgagtattacagaggggggcagcacattggaagccctcatgagtgcagggccggcacttgtccagagggccacgatgggggatgtacttgacccacacagccatctgggatagagccgcttttcagccaccatgtcttcanaattcatcatgcattgaaccttggtgaatgccccaactatctttgagagtgtggatcnttactggcggccagggaaactatgaactttg

SEQ ID NO: 532791 - DNA, 106 bp, Homo sapiens
tgttctgctttccttccccatccaccgcttcctcagcactctgtgttgtagcctggactatcctgtcttcaagcctccgctgtcccttgtaccttccgctctacct

SEQ ID NO: 532792 - DNA, 795 bp, Homo sapiens
ggagaccaagggctaaagctgggagactgaaaaaatgcatgaccgtcacgtgggcattattcatttctccagtctctggtaaggtgccgcgccgcggtgctctgtagttaccaggtgtatggtgtggacgccatcagtgtttaatgaatgaacccaggggagcttggcgtcctgatgatgtaggctctttgaggtggctgtaggatcgtgatgaacggtaacccctgtttatctggtgcctgtgaaccaagctatcattggctttggaatgtggtcagagagtctggattggatttttatccccagtctgtcctggccatagtagacagccctactaatacacagtggttttcaacagtggctgcacgttagtacatcatcctagggaactttttacaatatcctgatgcctgagctgcaccttagaccatttgcatcagacttgtgggaactgggggtggaacccagtgctatctgtatcttcttacagacttctccagatcgattccaccgtgcagccaaagtttgagaaccactgcaactaaataattatctgtcatcagaaagccatgtgacacgatgcgctctccttggatggctattccagtacggctttcctggggctgactggggccactccattcagggtgtgtagctgtgagtgtatatcagcagacataagactttctcccatctgatttacttggtgatctgggtataaagctttactgtacctgtttggcaatcagtgtgggtcttgtaccattctgagaagctgattacagctgtgccaag

SEQ ID NO: 532793 - DNA, 833 bp, Homo sapiens
aagctggtgttatcggccgaggcccagatctggaggtgtgtcattgctggcgcttgacctgcgagcggagctggattcgctggtcctgcagctgcttggggacctggaggagctggatggggaaacgaacggtgttgaacgcccgggtggaggagggctggctctcgctcgccaaggctcgctacgcgatgggctgccaatgtcgtgtagtgtgcccctgcagtatgcttcaacacatggatgccccagtgtctgcctccacagccagctgaggcccagtgagggactccagaagttcaatggtggtgagagctggtgtccacagacccaagaggaggtgagagcctcgctgaagcaggtctgcgtgaggcgcaagggacccactaaagaccccatgaacactggatgtcctctgagtgcccctcaggaccccctgaactggttatggaatcctagttcctcacagtctacagtcagtgctcaatgcaagacttccgggattggactgaagctggccagaagacattagccaagcctccatgaacacgcattgactgaggtcaaaagccaagctccaggaactccaagagaaaactcaagcaagctggagcctgaagactgactgaacattgcgcgcaaagaagcagtgaaagggagccacagatgtactcaagaaattgatacgtaattctcagagccttattccttaaaaattagctcatgacctaaacaaggcaaataatgccctctgggtcatgtctgatgtaccaaacctaagtgaatagaaaaggaaaaattgaaacaaatgaacaacagctaccaagaactctagg

SEQ ID NO: 532794 - DNA, 355 bp, Homo sapiens
ggcgaagccgagatccagccaaggaaaaccaatgatttgcggcagcaggtgccgtctgtcaaggtgggttgtacgacgctttcggtcaaaccgcggtgtcggtgggtttgagcagaattaccgggttgattaagcttggttcacaggggttgcaaagcacaaggtcgacatcggttttgaatcctactcgcccaatttttactaccagaacagtcgggtaacagcagtctatacagccgacatcgataagcttcgggcgttgatgccaccgcaaggtactggccgccgtgcagcccttgcaaagtctggccgggtcgcgggcttgatcgcgtttactgcgtacacctatgagcat

SEQ ID NO: 532795 - DNA, 547 bp, Homo sapiens
gcaatctagaagggatatggctacttccataggcttttcttttttcagggttggaggtaggcatgggcttacatcccccaggtacatactttatacttatggtgggataaccgggcactagtaggcaggtaaagtcacaaatggggtgtcttttcacctttggacggtggacttaatagctcctctcactcggccgggagatacttccggcctcagatgaggagccagaagaaacagagcccgacttgaatgacctcagctcagagttctaaggaccagcattcggggggccattttctctacaggcaaagggaatggcttttccataacatccaaatggtaaggtggttgctgctgaaggaggaggcagcagcgaggtcctgcggaacccagggggtgatgctacttctgcatgcatctacggggcatctgacacctaacatgagaggtggcatgtgagatgagactgggcatgtgagacatagggtcactagagacccttcggggtcagaggagagagatggaatgggactaaacccgtcctcgg

SEQ ID NO: 532796 - DNA, 149 bp, Homo sapiens
acctcgaggatccccatcacggcgaagactgtggttaccgttctgggatgtatccgggctggctattagtgtcacctgcgtgtcgatgtgtctggcatgtacgtgtgatcgtatttgctggggtgtgcgtgttgccctgatgtctgtcg

SEQ ID NO: 532797 - DNA, 269 bp, Homo sapiens
  misc_feature (52)..(52): n is a, c, g, or t
  misc_feature (266)..(266): n is a, c, g, or t
ttaagggtcccaagactgctctaacaacaacacccatttccataaatatggntcaataaacacttattcattctttataattagactctattgttagaattgttttaggtttatagaaaaattgagcagatagtacagaagattgccatatacccctcacccacagaatttcacaatttaccctgcgattaaagtctaatgttaatatgatatatttagtacaagtagtgggattatattgatacattattattaattaaaatccncaa

SEQ ID NO: 532798 - DNA, 506 bp, Homo sapiens
tgtgatccctgctacactaactacactgtaccacactcctgggccctgcttaaaccactcatccaagccatgtaatctcgtactacaggttaattcctgtcatcaggagaaaagaccaggttcccctgacagcctaggcagaggcatgttgagacccagcctctcaaatgtctgtacacatttctcctctcctttaggttgagaagtcagtggccagattcaaaggagtcaccgatacatcgaacctgagccttcacgccactgagtcactgcttaattgcatcataacagactgtccgctgcaggtatatcatccagcagctaacaatccaagagcatttgcaattgctaccacgtgggtctacatccacgtctctgtgtacaaaacaatcctgatatgtcaacgctcaatatcacctgaatttaagctatggctcacgttaaatgcccttaggccattttaccttacgtactttgaccacataccgtatccaccagtgggtgga

SEQ ID NO: 532799 - DNA, 481 bp, Homo sapiens
aataggtcttttattgcgtcatttaaatatcaccagtaggtcttaagtgtcaactggctcttctttctgtaacccaggtaactccttagatcttattcatcaaggctggtgaacagttcctttttcagagacatagatacccatccaaaaatttcctgatatccttgtttttaacttgttgtggcttgctgaatccaagccggtggaatttgaaacaagctcaatgtcatttcccttcaagattaattcatctttctgggcttgagatactgaacaagcaacaactgggtctcatccgaaacctgcggctgtatttttcacccaagaaaatttcggactttaaccaggaagaccattctcctggaataacaacggttgatggggaacgtaaagcatacacagaacctcatcttgtaacggaagcccagtgtaaaaacccttgaatcatgttctggtacatgaacatacaaaaaaggcgaac

SEQ ID NO: 532800 - DNA, 148 bp, Homo sapiens
  misc_feature (91)..(91): n is a, c, g, or t
  misc_feature (142)..(142): n is a, c, g, or t
gggggtcagtaggaagccgcggggtggtgttgagagaggacccaggtgtcctggcagtgtttgccgcggggcacacgcaagacacgtcgcnggcggtttttgcgggagactgctcgcctttccctgagtactccccccttgnttctcc

SEQ ID NO: 532801 - DNA, 631 bp, Homo sapiens
  misc_feature (258)..(258): n is a, c, g, or t
  misc_feature (385)..(385): n is a, c, g, or t
  misc_feature (530)..(530): n is a, c, g, or t
  misc_feature (558)..(558): n is a, c, g, or t
gacgccaccgaccatcagctgagaattgcagctgagggctccggggtaggtgggtgacggcggtcggaggtcgttaaggaagtgtgagccagtgtggagtgtcctacggtagactcgctttaggaaacactggtcactagctattctggtactcggaaaattcagcagaataaggatacatcgaacgcatgtcattacaacttccgaggaggttagggttgggttgacccccgcggtgcccaagattgagggccccancgacgggagtacttcattactaaaacatgtaccaagaaatgagtcaaccaacaatgtgtttgcttgttggtgacacatatatcatagaggaagcgtcatgacaattcaagcgttgagatagtatacntcaaagaattcgatctatgacactctgaggggccaagcatagtttgcaagcgatgaaagcaagccaggattactaatcctatctgtgacctaatagaaaatcagtatgaagttacattagatagcagttgtgcgaatgctgctgntcactcatctcaaaccccgccagctggnagagccagtcgtttccacacacggggagcacattgaccagggaaagggggaatccgggccgtttaaggctggg

SEQ ID NO: 532802 - DNA, 118 bp, Homo sapiens
gtagggggtttagagggttggtcctaaggaaacaaggtaacattatggaaaaaccctggtgaagaatgggaagggttaaaaaacaggactaaaagacccagacccttttaattgaaaa

SEQ ID NO: 532803 - DNA, 271 bp, Homo sapiens
gagacagagttgtttccctgaatgttagaattgctatgtgacgcgatctcataggagtccacttcggtgacatttcgccatctgttccattgtggatgtgggtttcccacttcggagtgagacactcgggttagacttccggactcctgttaggaactctgaagcagatctggcatgcttttcctctgcaacaattggctcgtttctcttttttgttctcttttgataggatcctgtttcctatgtgtgcaaaataaaaataaatttgggc

SEQ ID NO: 532804 - DNA, 416 bp, Homo sapiens
tgaacataaggtgaatatggctgtggttttcagaactggttccagggtttcataaaccttttagaaatggatattgattattactattcaactaatctgctttctcagaatctgttttgcttgtatttgatgccataaaggattgtttgccctataatttcctagagattatagcacaatataactcacctagcccataggttgctatgggtttctttgtgagagagagagagagagagagagagagagtgtgtgtgtgtgtgtgtgtgtgtgtgtccgacatgcttcatgcttcgttctttctttatgttcgcactcttcgtggctgtcactttctgactcctcttcatccttgcccactgtctatccacgctttcccatcatgctcattccctcatgtacagtcgtctctcctc

SEQ ID NO: 532805 - DNA, 108 bp, Homo sapiens
ggccctctggctttatacttctcaacgcttcatacttccaaaagcgcttctacttcatttcccggtatgaagtataaagcgttgagaggtataaagcgttgaggaagt

SEQ ID NO: 532806 - DNA, 441 bp, Homo sapiens
tgggggaagccattgacggtgtaccaggcgtcagtggggttggtgtgtgagatggtagagaggcctcagcttctccgggttgggtggtgcttggcctgtgtcccctagctcatgacccttctccagttgtctggttcgcatataacatttgagctcttgacacacttgaacctgtgggggccttgctcatttgaccatgtggcccaggccaaagcccagtgttggcctaacgcatggtcggcaggagagtcagttgtgtgctctgtggaagccccacagagcaggtgtggccaatgctgtggtccgtgcagaagcgggaaaactcaagggtgtaggagtggaggacagggacagagccctctggggtggaacgagcccatcttgaggagcttccgtgagagttggccaaatatgcgattgactggggggactttgaggtaa

SEQ ID NO: 532807 - DNA, 125 bp, Homo sapiens
cctaaacaagccctgaaccagccagcaggaggactgaagcagctgaagtctctatcatctgggatctcctgtttcagcagtcttcattctgtctcctcattcagatacacgtgtattctcaagaa

SEQ ID NO: 532808 - DNA, 155 bp, Homo sapiens
ctcgtcatagcgatgcgcctgtcgaccattggttatttgcacgcgatgctaaagcgcttgtgggttacagacaatttcaaatgaccgttctggctcgatcttcgctgacgggtcgtctgccccctacctgcgctcttcgatgctgcgtactaaca

SEQ ID NO: 532809 - DNA, 104 bp, Homo sapiens
  misc_feature (6)..(6): n is a, c, g, or t
  misc_feature (61)..(61): n is a, c, g, or t
tgcaancacctcctccatcaaatgtcttcaaattcctgagaaactagaacttactaatganacttcagaaaaccctactcaggtcaccatggtgttcacagtat

SEQ ID NO: 532810 - DNA, 136 bp, Homo sapiens
tctaacatgctgttaatactctgacgtatgtttacacggcagagtggatgtgatgctctgagaatgaagttgggcttacccacccatctgagagtcttaactgtgtgtgccaatatgcataggaatccccggtcga

SEQ ID NO: 532811 - DNA, 116 bp, Homo sapiens
taacatgtcagtgtacggcgtggggaaggtgggtgcctgctgagtaactgggactgctgtctgttgtgatgtgcactgttgcagctcagtgtgtgggctctagggagtgcggaggc

SEQ ID NO: 532812 - DNA, 333 bp, Homo sapiens
cgtcaagtgagcccttactgttcaccatagctcgtttcctgacgaaaaaacctcccccaccaaactggaaaaaaaggccaaagcttttttcagcagaaaactacatgtcgcttttctaccaggagattctttgcgttatctagaggaacacactggacttacatacagctggacatgaaagtaaccaatttaagtgccttttccttcaacaattttaacttcagttgcttaaggatgatcgagccaccgatgtcaacaaaatatcctttacctttaaatagtttttctttaattaagtttaaagaaaacctatttaacgagtgatattaccgg

SEQ ID NO: 532813 - DNA, 907 bp, Homo sapiens
  misc_feature (487)..(487): n is a, c, g, or t
tctcgcttggtccgccgcgtccagggtccccgccccaattacggagcaaccttccctcagccttgggaccagcaagcggtcttgtacgttcgttttctcgcgaagtttccagagtaggttacacctgtgggtgcgcttggggtcttggttgtgacactttttaacagcgccccatcttctcaggacgcacattctccgtgaggacctgtttttagagttctccccctgtccgtaatatctcagtgtacacccacatctggggctccccccagatgtttggtgttccccgccccagaaaaaaaaggggaagtgttaatttaatccccttggggggcgtctcccccgagagcacagaggatttttagagccctgtgcattctcatgagaccctgtcgtgtggaaagcccccgacccccccctacaatggcgctgttgaacaatcgctgggggccctgtgacatgcggtctcaggaacattggtcgtgcnctgttctcttttttttgtccgggatagggattgtgaaaagagattgtggataggtataggcgtcggaatgtgaccgctgcgatgtgccggctgtggatagcgcccagatgcccttgcaatgacaccccaacccagagtggggaagcgcttttgttgtagccatggaccagacctgcagaccagggaataataatagtgtgccttatattgtgtgggcaccacacaaataaatattgacacacttagggtgttgggagacttatattcaagaagagggaaaatttcccgaagccgcttaaccacagggctgggcaccctttggattttgagatttcacaaatgggggcacgggctgtgcttgaaggccctcctgagttatttgtttgggccttggttccataaagccctgagccaattgga

SEQ ID NO: 532814 - DNA, 787 bp, Homo sapiens
  misc_feature (474)..(474): n is a, c, g, or t
  misc_feature (558)..(558): n is a, c, g, or t
  misc_feature (632)..(632): n is a, c, g, or t
ctgggcgcggcgaggtctggtgtggcagatgtggatagctggaccctcctgggtgcctctgcgttatgtcgtaatggtagatgcatttggagagaatctgtgctctccacaactgcaggggcaacatgctttcctggcctcttcagatcagggtggctgttcttgggtgctgcaccaaaactccagcagtgggctttcttcaaggtgagctgcaagatggaatctgaggcccacccgtcagtaagagtttcctcctggtatccatggaatctactggtctgtctcactttggcctttgacccaggcaggggttcctaacatctacatcggtcattcggacagccttgcttttggttcactgccttacacggggcttccagatgttgacctgcttcattttacagtatcaggaaatcactttcccctcagaaatggccggctcacctcattcctgccaagacccaggtccgtgtnctcacagtgctgccatctttcctccgtgtgagcgtgggctgtgcggagagtggacctcggtgtgtgcggggctgcgtgcactgncatcgctccctctacacgagccggcgtggacccagggctgagctgtgaccacgagggccatcccgacgagccgncatggacccagggctgagctgtgaccatgagggctatcccgacgagctgccgtggacccagggctgagccgtgaccatgagggccatcccgaaactgtgattgtatatctgatgaagaaaacaaggctttgtgactaactcaagcccttcagaag

SEQ ID NO: 532815 - DNA, 218 bp, Homo sapiens
tgagtctacatcgtcgtgtacacataagagattagttgatgcatcagtagtggagaaaagtccgccagggcgcggtggctcacgcctgtaatcccagcactttgggaggctgagacgagtgaatcatttgaggtcaggagttcaggatcagcctggccaacacggtgaaaccctgtctctactaaaaatacaaaaaaaaaggaactcggtcagaggtg

SEQ ID NO: 532816 - DNA, 567 bp, Homo sapiens
  misc_feature (246)..(246): n is a, c, g, or t
  misc_feature (330)..(330): n is a, c, g, or t
  misc_feature (404)..(404): n is a, c, g, or t
ctgggcgcggcgaggtctggtgtggcagatgtggatagctggaccctcctgggtgcctctgcgttatgtcgtaatggtagatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgtnctcacagtgctgccatctttcctccgtgtgagcgtgggctgtgcggagagtggacctcggtgtgtgcggggctgcgtgcactgncatcgctccctctacacgagccggcgtggacccagggctgagctgtgaccacgagggccatcccgacgagccgncatggacccagggctgagctgtgaccatgagggctatcccgacgagctgccgtggacccagggctgagccgtgaccatgagggccatcccgaaactgtgattgttttctggtatgtgggggatgtgccagaaccagggctgagctgtgaccacgagggcaaaa

SEQ ID NO: 532817 - DNA, 516 bp, Homo sapiens
cattcagaaagggataaacagcacttccagggggagaaaaaaaatcatgttatcagaaagcaaagaagggtgagagcttcacatttccatgtatgccttttccccgccgccctagctcccttcgtcttccttctcttcctcatggctttcattccgtctttcgttttggtttgttttcagtcattctgccttccttctttctctttcttcgaggaggtggtgggatctctggaagaaggaatgtgtggttttttttctttatttttttataggattttgattgtttggttctctgtgatttcttccattccagaaagggataaacagcacttccaggcggagaaaaaaaatcatgttatcagaaagcaaagaagggtgagagcttcacatttccatgtatgccttttccccgccgccctagctcccttcgtcttccttctcttcctcatggctttcattccgtctttcgttttggtttgttttcagtcattctgccgtccttctttctctttcttt

SEQ ID NO: 532818 - DNA, 553 bp, Homo sapiens
  misc_feature (2)..(2): n is a, c, g, or t
  misc_feature (51)..(51): n is a, c, g, or t
  misc_feature (55)..(55): n is a, c, g, or t
  misc_feature (88)..(88): n is a, c, g, or t
  misc_feature (134)..(135): n is a, c, g, or t
  misc_feature (160)..(160): n is a, c, g, or t
  misc_feature (180)..(180): n is a, c, g, or t
  misc_feature (190)..(190): n is a, c, g, or t
  misc_feature (273)..(273): n is a, c, g, or t
  misc_feature (421)..(421): n is a, c, g, or t
  misc_feature (445)..(445): n is a, c, g, or t
  misc_feature (470)..(470): n is a, c, g, or t
  misc_feature (496)..(496): n is a, c, g, or t
  misc_feature (505)..(505): n is a, c, g, or t
  misc_feature (548)..(548): n is a, c, g, or t
cncggctgcaccggcgcacacgaacgcaccttcctggccgtgaagccgganactngcagcggcggctggtgggcgagattgtgcggcnttcgagaggaagggcttcaagttggtggcgctgaagctggtgcaannctccgaggagctgctgcgtgacacntacgccgagctgcgtgaacnccgttctacngccgccttgtcaagtatatggcctccgggcggttggtggccatggtatggaaggggctggacgtggtgcgcacctcgcgggcntcatcggaaccacgaacccggccgacgccccgcccggcaccatccgcggggatttctgcatcgaggttggcaagaacctgattcacggcagcgactccggtggagagtgcccgccgcgagatcgctctctggttccgcgcagacgaantcctctgctgggaagaaaacgctnggcactggctgtatgagtagccggnaaatgcgcgtcaaaaaggctttaaantccagctcntcaaagggccaagttgcggggctttttgcccaacccaaagggnttgag

SEQ ID NO: 532819 - DNA, 197 bp, Homo sapiens
agaaggcaagccggaagagcgaagaagaagtcgtggagagagagacgggctagagagagagaactcccagatgagagagagataagggagagagatagagagagagagatataaggccccctagaactcccagagagatagcgatcaacgcaagcaaaaatggcatgcgtccctccacacttgtttgagcttttgct

SEQ ID NO: 532820 - DNA, 443 bp, Homo sapiens
  misc_feature (2)..(2): n is a, c, g, or t
  misc_feature (11)..(11): n is a, c, g, or t
anagggcctgnaaagtccacctaattcacattcattcattcattcatattctctctctctctctacacacgcacacacacacacccagtcaaaagagggagagcaaggagaccccagatattgaaataaaaagtggtaaatagtggttatcactccctggaaaaaaaatttaagaaaagggcctctgccatgcatgtcatggggtgagggagtatttttaaatatacatatgtctaactaagacgcctctaccctcaccaggtggcctgagcagcacatgctcaactctggagcaagcagctttgcagacacattttagaaaagggattcctgcatcttctctatcagaatgcatgatctctggaaagaacaattggcacttttttcttagttcattcatttcaagaaataaataaggaactggcaattgctgaaaaaaaaaa

SEQ ID NO: 532821 - DNA, 853 bp, Homo sapiens
  misc_feature (1)..(1): n is a, c, g, or t
  misc_feature (246)..(246): n is a, c, g, or t
  misc_feature (442)..(442): n is a, c, g, or t
  misc_feature (653)..(653): n is a, c, g, or t
ntgtgctgccccgccgcactgccctcggtggtcgtcgctctgccccgtggggcgcccccccgtcgaggttcctcccttttggtcgcgcgccgtgggatagacctcgcggctcgcgcgctataatacactctctctggtatgtgttcggcgcgccctcccctgctgtgttgatcgcggcgagtggtctctcccgcggttgtgcgcgcgcgcgggtggatctcctgcgagcacaacatatttgtctcngccccggggatatgtcgtcggcgcgcgccctcttatctcccgccccccggcggtgtcacaatactctctcgcgcacgagcgcactgctctccccacaatatgatttgtttaagcagaataaggaggatccacgcacactcaggtagtgttcattttgtgcccgaacatatctcgttcgcgccgctgagcaagagantttctctataggagaaagaacaattttgtggagacactctcttcgccgccgcataatttgttaaaaaggctctctcctctgtgaagtggatttgttgtgctgtccctccctctcctgtagagatattctttgtgagtgggaaagcgggccgggcccccctcgcgggttatatatcgctgtggagtacattagacactcgtctgacgacacnccttccccgatgcctgtgtggacaacacaaccgacgacctgtgtgttgcaaaaataggtgcccccaccacgacgtgggcgccaagcttctcttattaagtcgctttgtgatacacactctttgcggccaatcttcctccggctcactcgtgtggcgcccaattacacccgcgatttattcccaaagagaaactaatagaa

SEQ ID NO: 532822 - DNA, 305 bp, Homo sapiens
  misc_feature (63)..(63): n is a, c, g, or t
  misc_feature (122)..(122): n is a, c, g, or t
  misc_feature (131)..(131): n is a, c, g, or t
  misc_feature (141)..(142): n is a, c, g, or t
  misc_feature (147)..(148): n is a, c, g, or t
  misc_feature (232)..(232): n is a, c, g, or t
ggttccaagaaggtcctcctgctcccagagcgacctcctcctctaggcatggaggtttccctnagctgggcatctgggccatttgcccctaacgtgctgccccaggatggcctcctcttganaggcggganagggggtgtnnccccnncggggcatctccaaaggaagcttttaaactcagcagctgcaccccagaatctgtatgcctgcacctgcccaaggatttattcantagcttacctaagaatttcaaatttcttaccataacacttgaataaagtttgacatttttgaaaaaaaaaaaa

SEQ ID NO: 532823 - DNA, 534 bp, Homo sapiens
ttaaggatcttagctgacagatgcaggcatgtatctcttccattccctacactcaggctcacagcaggtgaggctcaggtgaggtagggggtgggagcacatggctacattcccccagtacacatggcatctgaagcttgatgggagagcagaactggtgagacttgagggaagggtcatggtctgtattcagtcagaatcactgctggaagaggaggaggaagaggaggaatgcttgccatgcttgttggtacttgtggtgcttttggtgctagtgcatctttttatgagctttcttcattttcttctgcatcttcttgtctactatcactgctggtccaaccatgccaggagccaagggattcacaggagggaattccaggggcaggcggtgggtatggaggagggtagggacccaacggttgggatcctggataccctggctgttgcacaggatgagggggcccacctggtgggaaaggctggattgccatggggagctcctgggggaggaggacaggcgctggggaaaag

SEQ ID NO: 532824 - DNA, 473 bp, Homo sapiens
aaatcgagctcggtacgggtgtggagagagaaagagaaatacagatgagagagaggtaacattctaagtggccttatgttttgattctgccccacctttgttaccctgccatgtttgtgtgcattcctgtggatgggcgtgcccactgcctccctcacctcccatccaggctttcagaatgatgggaacatgacacgcacagagaattctctctaacccatcctctttctgttgagcatatcttttgctccctctgcttgtctatgggagtgacctgtctgagggaggttgagggtcaatgtgtaacagatacatacaaatggaagcagaaaaactcccccactaacttatcacctgctcttggtgccttcagagagcctggtgtggggacacgtagagttcaattgtttactaatttgaaattagaatctaaccacttctctccacttccattgatacattctctctccact

SEQ ID NO: 532825 - DNA, 364 bp, Homo sapiens
  misc_feature (153)..(154): n is a, c, g, or t
  misc_feature (162)..(162): n is a, c, g, or t
  misc_feature (192)..(192): n is a, c, g, or t
  misc_feature (204)..(204): n is a, c, g, or t
  misc_feature (210)..(210): n is a, c, g, or t
  misc_feature (212)..(212): n is a, c, g, or t
  misc_feature (353)..(353): n is a, c, g, or t
ttaaattctaaaagcttcagaaaataaatgcacgtaagggaaacatactgagtaaccaagatgtgtcttggaccatgaatggtgctaccacttactgagcagccctgtgtgctgggaaccttgtcctgtggtcagtgccctcggccgtatccnntaacacangggtttcatgggaaaccagggtttcaccancaacctggggcnttttangncttcttttgtctgcttgggtccatttcacttgggattgtctcctcctcctcttggggatgttcattgtcacctatgggatggggagtgtttgcattttgtccatccctgggaggggtgttccacacggcatgtttcccctngctgggctgtt

SEQ ID NO: 532826 - DNA, 144 bp, Homo sapiens
ctatctgcctacgacaaacagacctaacaatcgctcattgcgtactcttcaatcagtcacatagccctcgtagtaacagccattctcatccaaaccccctggaagcttcaccggcgcagtcattctcataatcgtccgagcgga

SEQ ID NO: 532827 - DNA, 170 bp, Homo sapiens
cttggtgctgtgggtgacagagtatgatggggtggtggttgtggtcaaactttcaatcagtgtcaggcaagctgcaataatttcatgaaggcagcaggggtcagagttatgatacggagaggatcctcatggtgcgggggctttgtatgattatgggcgttgattggtag

SEQ ID NO: 532828 - DNA, 431 bp, Homo sapiens
gtgaattctccaaacatctcaaagaagaattaatgccagttcttcttaaactatttttaaaaattgaagaagagggcacactccaaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaaaa

SEQ ID NO: 532829 - DNA, 275 bp, Homo sapiens
  misc_feature (263)..(263): n is a, c, g, or t
gagagacagtcttgtatttttctgtatgtgtgtatatatatatattatggtacttctgggcaattctatctgtatttaaaggatgtgcacatcttggacaccatttttaaggatgagctgtggagaccgatttaaaggataattccctacccaagtgaaaattagatgtgtgtttaagagggtacaggattatcaactgatttggtcagttgctcccaatgctggtggatttcctcattgtgtaaacattgacaggtatgtgnacacatggcgaa

SEQ ID NO: 532830 - DNA, 84 bp, Homo sapiens
ttttcctgtgtgtcatgttggtttttggtacttgtattgtcatttggagaaacaataaaagatttctaaacccaaaaaaaaaaa

SEQ ID NO: 532831 - DNA, 693 bp, Homo sapiens
  misc_feature (644)..(644): n is a, c, g, or t
gggcagggggaccatccgggattgattttatccttgccttaaaaattctgattagggaaggaaatgcaagtcagtccggtcccaagccaggtggagcaaccctaaaatcgccagttttttcgccctttttgacttaaagggacaaagggttttaaaggccctttgttttttgaatcaaacttaacagggcccccggagtttggtttcctactttagcaaggggggaaaaaacactgataaatcaagttttgggggggttcgagcctcacacctaggcagcggagtgtaggctggggagcttggggggacctgctgcactggcccaggtgtcctgccgcccccacagagcacttaacacagagcttaaagacagggggtatatcacacaagatgcacttccggaactgggcctccacccctgtgtgtgtgaaaggaagagtgttccttttttccttttattttaacagttgacacttgtaaaatagttcacatgagggctgggtgcgggggctcacgcctataatcccaacacttttggagggcacaggcaggcggataacttgggggtaggagttcgagacccgcctcgccaacatggtggacttccgtctctctaaaaatacaaaaaatagctgggccgtgtnggcaggtgccttgtatcccagcttctcgggaggctgagattacaggcat

SEQ ID NO: 532832 - DNA, 179 bp, Homo sapiens
  misc_feature (9)..(9): n is a, c, g, or t
gtgagttcnatgagatctgatggttttataaggggctcttcccttcacttctccttcctactgtcttatgaagaaggttcctggcttccccttcaccttctgccatgattgtaagtttcctgaggcctccctagccatgctgaagtgtgagtcaattaaacctctttcctttaaaagtt

SEQ ID NO: 532833 - DNA, 726 bp, Homo sapiens
gagatcatgccagtatactccagcctgggtgacagagcaatataccatctccaataatagtaataataataataataataataataataataatggttggaactactgctttatacgatcttaatgtccttaatctttatctgggaatgtctggtgttgccttgattcttttttttttttaaaggatagttggcgggatatagaattggtgcctgacaactttttcttggactctcttttaatgtcatcccagtgcacccggatttccattactttgggtgcaaagtcagctggtaataattttgggtctccttggtgtaattgttttcctcacggctttggggcttttttttccggggcctggtctttaaaacagttggactaaggacgttttaaggtgtggatctcatagtgttaatccatactggggttggtagtcgtaggttttggtggtttaagcttctgggatatataatggttttttataaacattggagagattttgggacattattctcttagttacattttctggcccttggctcttctgtgattggccttatgcatttgtgggacatttcctgtgacccgtggtctcaggctcgtgtccattttttccagtcttttctccctcatattctcaggttgtgtacagttgatttttcctcaaagctcaccgatgcgtttgccatctcaaaatctacttgcatggttgggttccgaaag

SEQ ID NO: 532834 - DNA, 1066 bp, Homo sapiens
gcggcgatggcggcgtgcggcggctggcggcagcagcagcgtgggtgctgcgggctgggtctgcgggctccgggccgaggcggcgtgcgccatcttgtgcccggggccggtggggaggcctggggagggggccccgtggtgggcgctaggtggtgactacggtgaactggaccttggagtctgaggaacttgaatgcctcgatggagcttgcttgctggagcactgatgcctgaagccccgagcccagaataggagccagcaccgaggcccgtgcacagcacctgtgaatgatccgtaggcacttggggcaccatggataggagatgcccgccgagacagctcaaagaacatgagggaagcgaaagaagacactaggaactagggtctgagaggggaatgacaccagtgcaaggacagtacagactaatttggagagaaacctcagagaaacatagaaagcttagtcaaaaaagcttcgaaagttaaagggggaaacgaatagagaagctgaaaatgaaaaggccattgaggaaaggacattaaacaacggtgaagcataatcgagataaaaaggtacgcgtttaagaaagtaaaggcgaaggaaagttgaaagtgtattgaagaattcatcaacgatatacaaatagagaaaaaaattgcaagtgggtgactaacagagaaaagaattcaaaattaggattacacaacactattggacaagtagataatgaaacagaaatagaagagaaggagagaatataacaattaacaacaagaattttaagaaaaaaagaaatgaacatagaattaagaaaccacaagatgaattggagtaaaccataaaaatgagagagagagaaaaaacaaagttaaaaagaaaaaagaaaataagctggaagaaaaggaaaaaatcgagagtaatatgagaaattaggaaacagatgatatgagattatacaaagctaaaagaaatagaattaaatgacaaaacgaattaggacgaatgatgtaatgaagaacatacaaaaatgacatgaaatgttgagaaaaaacgaaaaaaaaaaa

SEQ ID NO: 532835 - DNA, 182 bp, Homo sapiens
agacatctgtacaaagtcgcttacgtagctaggaagaggtttatcctctattcctataggatatgctattctggctccgctacggagccaatacagatccgctacgcttataacaaggctccccagcagctaagcaagctaacattcttaggtttaaacgaggaagtatctactatgtcgaa

SEQ ID NO: 532836 - DNA, 273 bp, Homo sapiens
  misc_feature (87)..(87): n is a, c, g, or t
tactggcatcttacaccgtcgtgagaatcgctctacccggttagcaggttgcagtgagccaatatcacaccattacactccagcgtngccacaagagggaaactccatctcaaaaaaaaaagtagttgggtatggtggcgtgcgcctatagtcccagctactcaggatcagagaattcttctggcctttggtaaaaatgttggatgcagtgttgtgctaagaggaagaagcatctccaggctcaaaactgtaactgtggtctttccagggtac

SEQ ID NO: 532837 - DNA, 101 bp, Homo sapiens
gtgcagtccccggcccccccccctcaggtttgtgtttcttggtttttaaacgactggttgggatagaaccctaaagaaataaacttccagtgggttccgga

SEQ ID NO: 532838 - DNA, 502 bp, Homo sapiens
  misc_feature (30)..(30): n is a, c, g, or t
  misc_feature (62)..(62): n is a, c, g, or t
  misc_feature (93)..(93): n is a, c, g, or t
  misc_feature (97)..(97): n is a, c, g, or t
  misc_feature (113)..(113): n is a, c, g, or t
  misc_feature (120)..(120): n is a, c, g, or t
  misc_feature (134)..(134): n is a, c, g, or t
  misc_feature (152)..(152): n is a, c, g, or t
  misc_feature (177)..(177): n is a, c, g, or t
  misc_feature (197)..(197): n is a, c, g, or t
  misc_feature (206)..(206): n is a, c, g, or t
  misc_feature (208)..(208): n is a, c, g, or t
  misc_feature (220)..(220): n is a, c, g, or t
  misc_feature (222)..(222): n is a, c, g, or t
  misc_feature (234)..(234): n is a, c, g, or t
  misc_feature (254)..(254): n is a, c, g, or t
  misc_feature (262)..(262): n is a, c, g, or t
  misc_feature (285)..(285): n is a, c, g, or t
  misc_feature (307)..(307): n is a, c, g, or t
  misc_feature (317)..(317): n is a, c, g, or t
  misc_feature (438)..(438): n is a, c, g, or t
  misc_feature (484)..(484): n is a, c, g, or t
tgggggaccaccttcaagaaaccctgtttnttgccaattcgggtaaacttcccgaaagtttntcgcgggcaggagcaaagggacttagcagtnactnttccaaagtttaattnttttgtnattttttagcgcanagaggcgatgatgttttntgttgggtgaaaagctgttgaaatnacgaaatctgtttggctttntagtttttntntaattttttttntntgaaggttccanatgtaaacaaggttatactntgagcaanataaaatccactttccaccagtnaaaaaaaaattggaaaatatgnagtatttctnattcttgtggccagtgtacgttttcaggtattttcccttgctgtatgttccagagcttcaaagtgttgttagcgtggcggccaggatgtatttgccgttcggggagaacttcacaaaaganacgggggggttgtcgtcatcgatgagcgtcttcaggcactggcctnaggcggtgtcccagaagc

SEQ ID NO: 532839 - DNA, 1162 bp, Homo sapiens
gctcgggcaattgggggtatggggttaggcttcgttatcttctcttcgtcgagttaggggttcaggtgccccagctgcttcgggctgacgagggaccttctgggcccccacattaagtgaggcagccaccatggcgagtctgacatggctgtcgagcgacgcgcgtgtctcccatctgttctccacggttcgcgtctggcccggcgggaagggagaagacactggcgtcaagcagtgtgccccgaataactcgctggacgggaggagctctcaccgatcgagtgaaagcgactatccaccgcagatgctatccacggcccggccgcactattgacgctggacggcgagctgagccgtgggagcacagaactcatggtagagacgggcaggaagcacgggtagcagggctttgacggccggtgatgtctagacctgggtgtgcccacccttaaccctacggggtaggatgcatgcaacactgattggaaaggtgtgcaagcggaattcttacacttggtacatcaccttgggaaccttttgtattatactacttcacgaaaatttcccgactttggactcacaatacgcattacgcgggtaagtattcgagggtgtgttgcccggccataatcccgggtggattcacgtgcgagtacgaggccggtacgagggaccccatgcgcatacattttcgagtgccgatacgccacggatgcgtaagtaccagtcgggccgacgcttggaccaaggtcgagcggtgcacattcccaagcgacattgtccaagggcgtggtccgaggccttgatattcctgaaggtccctgggagtctccgcgggttaaaagccgaaacgctcagagggcccgtttggaggcctggctccgaggggccggggaccaccgaggtgaccgcgcaagtagtgcccattcggcattccataacgtggcggaccaaaggggtgtaaaggattcaccagggaggttccacgccgccccatacgacaggaaaccggcggacgttaccccgggtgttccaaatatcccctgggggcgcggcggaaccgaagatagcaagagacgcagactgatttggaagaacccccacaattcgtgcgggcccaggggacataaccggagtggaggcccaggaaggaccgatgcgc

SEQ ID NO: 532840 - DNA, 167 bp, Homo sapiens
gtcatagtcatgtagcccacacctatacattgtcaccacccatcatagtaattacgggaacaggctgcccatcaaatgtagcctccttgtaattggtggccagcaatctgggtatcagccccttgagaagagctcctaacccttaaccagcgtagaacgggaatttt

SEQ ID NO: 532841 - DNA, 143 bp, Homo sapiens
acttgaggattctgtgcgcggatccttcggcgcggatccttcggccgcgtgatccttcggccgccgtgatccttcggccgcctggatccttcggcctgcggattccttcggccgccggattccttcggcctgccgtgattcct

SEQ ID NO: 532842 - DNA, 7725 bp, Homo sapiens
gtgggggacaatgaggatgcaggcacactgggcaagagggggttaaatgtcaggcaggataggtctgattgatggtactgggtgggcatcttatctcactgctgcaccatccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccaactgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactgccttgcatatggttctgaccagtcaggcaggctgggactgaaggtggctccctggtgaacctagcgctgtgggagttcatagtagaatcggcttaggtgctgccacccaactcaactccactccctccctttctctcttctgcaggcagccatgagctccagccaccccgagccgggtccctgggcacccctgagcccccgccttcagcccctgtcccagagctcttccagcctgctgggtgaaggccgggaacagaggccagagctccacaagactgccagcagcaccatgtggcaggcccagctgggcgaggccagcaccagaccccaggccccggaggaagaggggaacccgcctgagagcatgaagccagcacgggcctctggccccaaggcgcgacccagtgctggaggccactggcggagcagcactgtgggcaatgtgtccaccatgggcggtggtgacctttgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcggtgccaccactagacctgggggacacaactgcccacagcagcagtgcccaggctgagcccaaagctgctgaacagctggctaccaccacctgccatgctctgcccccagctgctctactctgtggcatgagggagatgagggaggtgggggctggtggctgctgccatgccctacctgccacagggatcctggcctttcccaaactagtggcgtcagtgagcgagtctgggctgcaggctcagcatggggtgaagatccactgtaggttgtctggggggctccctgggcactcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggcgccgtcccctgtgcgggatgtgcgatgggatgctgagggcatgacatgggaggtgtacggagctgcggtggacccggaggtgctcggtgtggccatccagaagcacctggagatgcagtttgagcagctgcagcgggcgcctgccagcgaggacagcctgtctgtggagggccggagggggccgctgcgggctgtcatgcagtccctgcggcgccccagctgctgcggctgctctggcgcggcccccgagtgaggagctgtggcccttggagctggcctgggcccactgacttagtcctagacctgggccagggacagtgggggctccgtgccccctggacccaccggcagctgggcacatgtctcacccgaatatcggctgcctccagaccacaggactgcagcctggggcttccggccccacacagctgggctgttttcttaagggcttgatttccaagggccacatctctgcaccttccaggctctgaactttgagacagggctttagcactgtgcagaggggagatcctgagttttctttaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccggctgagccgagggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatgacaggggaggatgctgaccattacggagggctgccaggcttccagggtcattgtgtcagaggctggtctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtggggctcgcttgcccacatgacctgacctaggctaggcagtgggggccaggggccttggagagacagaaacatgggggtttggcacagtctgacttcattgcccaaagatttctcaaggcctgtgaagaatgggagtgggcttgtgttcttgtcctgggtctttgtcttgaagatcctaagatcccgtgactcagccccccaatccacccttgtgagggaccagagggctagtgtggggtcatggcccatgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacctgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggtcacatgagagagaacaaatggctgtgggtacatggggagggacctttcacacagggccatagctaagtagggtcttgaggatgcaggggttagacaggtgggtggagagagggcaggacctgcccggcagatggaacagcctggtcagatacttggatgtgcctgtcctgcccgggccatgatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggacaaggtgaatggcatgttcagcaggtgcagaaagggccacatgccacagggtttggctgggaccagtgaaacctacttcatgaagagactttcttctgtgtcacatgcagattctcatgcattcacgctggctgggtgccactctgtgctacctccatgctgccctggcttgccaggatggcaggccgggctgggctcagccaagctcccactcacctcatcatcactgagatgagtatttgcagagcggtgctggaatccaacacctgtgtcttggctggggccccagacgattctcctggctaaaccacgatccttgtctccctagcccagttgcacagctgctgctgacaggtctacctgaagtgactgcagcctcatttctgattggaactggagacccctcccaaccccccttgctgtgccctctcctgggacaggcctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaatagatacaaatttggaggtgagagctttgccagaccccagcagggatggggcatcggtcctggctggtcttgtttattttgtcctggtaaattctgttctctggagcataaaccgtggagtcctagagccccttgtctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacatgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacatttaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcactgaggagggctaccctagccctcaccactcatcttgggctgggttccccagaagcttctgctgagatgaggatgctggagttattagggaggggagagcaagttaagggagggacagaaggcaaggcagggtgtgatttcagtccaagccagaccctaaaggggagccctggatgcagtcccacctcagagtaaggactacccaggggtgaagatgtagcctccaggcacttctgctctctggcaggcaggctaggaagctctaggagccccagggtaggtttctgcatggagttgtagggcctattttgggggaagttgtgcacagaaaccaccagagggagtcacaggcatctgggggtgcacccattgacatttgcatccatgtcatgccaaacttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgatgagtcctttatcagttttcatccaacttgtcaggcagggcagggctggtatgaagcccaggacatatcgctgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacggcaagcttagaagtgtggactcggcctggtacagtggctcatgcctgtaatcccagcactttgggaggctgaggtgggctgactgcttgagctcaggagttcaaaaccagcttgggcagcatggcgaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagatcctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggcttgctcactctttttgatgggtgtctttccaaagctggctggggacctccctgattgagagacatggggccagttctgttgctgtggctacacgggaataataaagcagaagaacacctgaggaaagctgatgtttacta

SEQ ID NO: 532843 - DNA, 1460 bp, Homo sapiens
cgctgctcctagccctccgcactgcgccacatcaatggcatgcgtgggtggaatctgatgcgcttccatgggcacgctggctgtgtgcatcctgcaccccatacgtctgctgcgtgctactgtgctgatgctgtgcttggcatgctgtggcttccctgacacacggatccacacgtgcatggcccctgtgatcactgtacatccggtccagtacatggtcatgctgtaatgtgagacagccgttcgtaggacaccgcgagataagcgttgagcgcgagcacatccagaaagcgaactatcagtctaagaagatcgtacacgggtcaaattgctcaataacctcacacgcacaccgaatgcatagtcctatgaatgcacaaaagcggcgagtctaaatccgtaggctaacagtcaatcatcacccacaagacttgtacaaggaaccgagtccacgggaggaacatccccaccgcacacgcacaaacgaggagccaaaaacaacaggaccacggcgaacacagccacgaagacgaggagacacccacacagccgaacaggaagacgggagcgagcgagccaggcgacaacacaacaagcgacacgcaccagcgacccaaccagagcacgataggcggggagcagatatgaacaagagacttgtagtcccaccagacgtagtagaggattgaggtagagcaggacagaagtacatacgacgcaggagagaggaattgatatgggagcagcataggtgcagtacggacaggagcgagtggcgggcaccaagccatacgacgataggagactctgaccaaaagactacacacaagaagagcagaaggagagacagatgagagggaaagtgcacacagaacttggcaagccaatcacagatgaaagttcgacgaggacattgggaaagatgaatgcaacacgacaataagaagagaagagtagaagatcaggcaataatccacgaggcagaacacggaagaaagaaagccgccgcaagcacgcggggcagagggacgccgggagccgcggggccagacgcccgggacggcggaacaccgggcggccgcaccgcggggacgggggcaccacgggggggggggggccgccagccgagtgcggagggaagggcggagcccacccgggcgccgagggaggagcgcgcgcgccaacgggggggcgaccacgcgacggaaacacgggccagacagccccgaaccaggagggccgagcgccagacaagaggaacagcgggcgccggaagggggggggggcagacagcaggacagagccgcgcggagtgacgggcgcgggagacggaagccccgcgggaccgagggagcgacaggggagcggaggagagggaacgcggggaggagaagagagaagagcgtagggggccagagcgcgccgccacgcgcgcagggacggcgggcgccgcggaccgg

SEQ ID NO: 532844 - DNA, 4959 bp, Homo sapiens
gtgggggacaatgaggatgcaggcacactgggcaagagggggttaaatgtcaggcaggataggtctgattgatggtactgggtgggcatcttatctcactgctgcaccatccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccaactgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactgccttgcatatggttctgaccagtcaggcaggctgggactgaaggtggctccctggtgaacctagcgctgtgggagttcatagtagaatcggcttaggtgctgccacccaactcaactccactccctccctttctctcttctgcaggcagccatgagctccagccaccccgagccgggtccctgggcacccctgagcccccgccttcagcccctgtcccagagctcttccagcctgctgggtgaaggccgggaacagaggccagagctccacaagactgccagcagcaccatgtggcaggcccagctgggcgaggccagcaccagaccccaggccccggaggaagaggggaacccgcctgagagcatgaagccagcacgggcctctggccccaaggcgcgacccagtgctggaggccactggcggagcagcactgtgggcaatgtgtccaccatgggcggtggtgacctttgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcggtgccaccactagacctgggggacacaactgcccacagcagcagtgcccaggctgagcccaaagctgctgaacagctggctaccaccacctgccatgctctgcccccagctgctctactctgtggcatgagggagatgagggaggtgggggctggtggctgctgccatgccctacctgccacagggatcctggcctttcccaaactagtggcgtcagtgagcgagtctgggctgcaggctcagcatggggtgaagatccactgtaggttgtctggggggctccctgggcactcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggcgccgtcccctgtgcgggatgtgcgatgggatgctgagggcatgacatgggaggtgtacggagctgcggtggacccggaggtgctcggtgtggccatccagaagcacctggagatgcagtttgagcagctgcagcgggcgcctgccagcgaggacagcctgtctgtggagggccggagggggccgctgcgggctgtcatgcagtccctgcggcgccccagctgctgcggctgctctggcgcggcccccgagtgaggagctgtggcccttggagctggcctgggcccactgacttagtcctagacctgggccagggacagtgggggctccgtgccccctggacccaccggcagctgggcacatgtctcacccgaatatcggctgcctccagaccacaggactgcagcctggggcttccggccccacacagctgggctgttttcttaagggcttgatttccaagggccacatctctgcaccttccaggctctgaactttgagacagggctttagcactgtgcagaggggagatcctgagttttctttaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccggctgagccgagggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatgacaggggaggatgctgaccattacggagggctgccaggcttccagggtcattgtgtcagaggctggtctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtggggctcgcttgcccacatgacctgacctaggctaggcagtgggggccaggggccttggagagacagaaacatgggggtttggcacagtctgacttcattgcccaaagatttctcaaggcctgtgaagaatgggagtgggcttgtgttcttgtcctgggtctttgtcttgaagatcctaagatcccgtgactcagccccccaatccacccttgtgagggaccagagggctagtgtggggtcatggcccatgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacctgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggtcacatgagagagaacaaatggctgtgggtacatggggagggacctttcacacagggccatagctaagtagggtcttgaggatgcaggggttagacaggtgggtggagagagggcaggacctgcccggcagatggaacagcctggtcagatacttggatgtgcctgtcctgcccgggccatgatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggacaaggtgaatggcatgttcagcaggtgcagaaagggccacatgccacagggtttggctgggaccagtgaaacctacttcatgaagagactttcttctgtgtcacatgcagattctcatgcattcacgctggctgggtgccactctgtgctacctccatgctgccctggcttgccaggatggcaggccgggctgggctcagccaagctcccactcacctcatcatcactgagatgagtatttgcagagcggtgctggaatccaacacctgtgtcttggctggggccccagacgattctcctggctaaaccacggcagcatggaggtagcacagagtgcacccagccagcgtgaatgcatgagatctgcatgtaaaggaa

SEQ ID NO: 532845 - DNA, 348 bp, Homo sapiens
tcaccacggtcccccctggctgctcaggtctgttgattgaatagtattgcttgagctcgccacagtttgctctaagtcttatgatactataacttggtatttaatagtatctcgaaatgtgcttcgttttatttttctttcttatggtggatcatagtaatgcagctgtgatgtgatttgaaatcaaaatgcaagatccgcagtcttcgttatgaggtcacaataggagcacatggaaattcagtgatttttctctatcctaaagactgtggtgtagtccttgtggaactggagcaagcttgatttatatttgcaagctactaaattaatagacctgagcaagccagg

SEQ ID NO: 532846 - DNA, 250 bp, Homo sapiens
gagagagagagagagagagatattcacctcgccttatttcgcggcagtctggggtttacatgtactgccctagtctactccttcctcggcttaggacattcgtcgtacccgactttcgccaggaattcgatatgccttggctcatcatcctcatcgttgcctgtcagcggatcgcctctcgtcagagcttgcgccccgacctggagaggccaccgcctgctgattcctctgcttccacatcggaccgtct

SEQ ID NO: 532847 - DNA, 111 bp, Homo sapiens
cacgcctgcaacgacacttgaggactacacgaatcgtcgacgcaacagtttacctaacgacaacttacacgctaagacataggacgacggaacgcctttgcgtactttaat

SEQ ID NO: 532848 - DNA, 178 bp, Homo sapiens
gagccccgtcctcttagaggcaggcacacgactggtcgatggggcagtggagatgggaacacggaggggggctcagaccatgaaaacattggaggatcttagcgggactttggctgatccatacagatatcgtagttgcttagatatgcttattgttttcatcccagggatcctctag

SEQ ID NO: 532849 - DNA, 526 bp, Homo sapiens
tcctcaaaccgtatagaactagtctttcctcctctaatgttatctttattgtttttttgagatggagtctcgctctgtgttcaggatggagtgcagggtgcgatctctgctcactgcaacctccacctcctgggttcaagtgattctcctgcctcagcctccccagcagctgggattacaggtgcgcaccactacacctggctgatttttttgtatttttagtagagacggggttttgccatgtgggccagactggtttcgaactcctggtcttaggtgatccacccgcctcggcttcccaaagtgctgggattacaggcaggagccaccgtgcccagccaaagggccaaaggttttttttttggtttttggtttttttggtttttttggagacagagtctggctcggtggcccaggctagagtgcaggggcgccatctcggctcacggcaagctcggcctccggggttcacaccattctcctgcctcagcctcccgagtagctgggactacaggcgcccgccaca

SEQ ID NO: 532850 - DNA, 187 bp, Homo sapiens
ctcctctagggtgaattctgcttcacaattgactaggacacgcgacatcgcatggctcacacagcgacgttgtctctgaactgcttgtgccggcacgaagccagttatcccggtgttgcgctcgatccttaacacccaaacggtcagaaggagagcgcaacaccgtggcggggcgcaacaccgggcg

SEQ ID NO: 532851 - DNA, 496 bp, Homo sapiens
gggatggacccccattcctgttgagcaactgattccatatgtggatgaagatggctcaaggaacgacgaccgggctggtccacctcgttttgctagcggaagagagacgagaaattgtagaagtaaataagaaactcaaacagaagaatcaacagctgaagcagattatggatcaattacggaatctcatctgggacataaatccatgctggcaatgaggaactaaagcgatatttaaatctcctgctctactcatgtgatgaagttgggtttttcccccctcttgagtattcctccctttgaaaaacgttatttatgtctttattttaacagctagcactaaagtttctgttttcactttaaagtatttactagctttttttttaatactgtgggttttatgaaagattattgtaatacctttgatagggtataaattttggttaatcttcagaaattgaataaattaaaaaatacaaataaaaatttaaacatt

SEQ ID NO: 532852 - DNA, 160 bp, Homo sapiens
ggccgcatgggtaccatactcctgtgatgcgtccatatatccgtgtgacctctcctactattcacccaacctcctccaggcattccggttcgttaagcagacgcgattgactggcctagcggtgacatcctcgtcctcattcttcacgcacggtaacata

SEQ ID NO: 532853 - DNA, 419 bp, Homo sapiens
ggaaattcggccattatggccggattgagccaggctggggaggtaccgtttgcggttgcccaccgccctaaattaatggaagggggggttgagttggcctttaagggggacttaagaaaggctttggaaaaactttttggatatcttggaaaatgtggcccaccaaggggttgttgaaacctaatggatttaaaggcctttggataagccttttgttaacattttggggaaggcctgaagtttttagttggggattatggccagagttttttattacctaaggcaaatttaattttttggtcctagaaaaaaatttgaccatttaagttctgggttttaaaatggttatttcagaattagttaaaggccttaattaacctaattaatagctttggccatttggccaggggtgtcctccc

SEQ ID NO: 532854 - DNA, 436 bp, Homo sapiens
  misc_feature (10)..(10): n is a, c, g, or t
  misc_feature (98)..(98): n is a, c, g, or t
  misc_feature (118)..(118): n is a, c, g, or t
  misc_feature (218)..(218): n is a, c, g, or t
  misc_feature (224)..(224): n is a, c, g, or t
  misc_feature (263)..(263): n is a, c, g, or t
  misc_feature (265)..(265): n is a, c, g, or t
  misc_feature (274)..(274): n is a, c, g, or t
  misc_feature (281)..(281): n is a, c, g, or t
  misc_feature (342)..(342): n is a, c, g, or t
  misc_feature (414)..(414): n is a, c, g, or t
gaggtgccancaatggtgtgctggggtgtgggagttgactttagaaaaagtgtgcactacagaccagtactcaatggaagaagtctcgtaggctaganggtgagggtggctccaggtngccatggcgctcagctagcaggacccgtaggcaggaggaacagctcattgggttactgtgtgagttatccagctgctgttggagtgtccgcctgctcgcntctccngctgcaccctcactcagctcactttctgacgtgtctcancntgtcttctncttcttnattccaaagcctggggaacgagtatagggagctctgcctgttggagctccctgtccttgtnctgttcttgttctttctcatcgctctccttgccagctttctcctcagggtctgtctcactctcaggactatncgacttgtgtcttctcttctta

SEQ ID NO: 532855 - DNA, 126 bp, Homo sapiens
  misc_feature (117)..(117): n is a, c, g, or t
  misc_feature (122)..(122): n is a, c, g, or t
ctacgaccgacccacgtacttggtactctggctctgtgacagccacgttacccttcggacacacacacgacgttggtacgctcttgactggggactcctctacgacgtcgaccctgnacggnacct

SEQ ID NO: 532856 - DNA, 306 bp, Homo sapiens
ctcggatcttcaattgtctctctcatataaatgctgtaggggttatagttaaatgtcctaaagaagtatagttgaggcgggtgacgggcggtgtgtactgcgcttcagtggcccatgatcaactaagcactctactctcagtttactgctaaatccaccttcgacccttaagtttcataatgggctcatcgtcagttttcattggggtagcaacatgtagcccatttcttgccacctccatgggctcactacttgcactcacttctatactgtgggtacttgcgcataatacttagtagcctatca

SEQ ID NO: 532857 - DNA, 126 bp, Homo sapiens
acccacccatcacgggcctacccggtgctagctagctggacactgtacccgggtatctgcggctgtatttgcacacccatcatcatcacctcctatggtgcaaggtagaacaaaccaatgttacag

SEQ ID NO: 532858 - DNA, 318 bp, Homo sapiens
tgtcccagagctttttggcccctgggtttcactcctgagtggggccagggtgggagggagggccagggggggggaaaggggcgggcccccccgtgaaagaatttgcctgtggccttgcccgccagcctcagggccccttgacattccttgtccccagcaactttttgggccccctgggtgtcccctgtccccccaattttgccctccatggcccccccgtgccccccgtgggcagcctttttgttttaagaaaagcagacgcagcagttggggcccctcccaccctcaatgccctgccttttaatccgcaaccagcca

SEQ ID NO: 532859 - DNA, 90 bp, Homo sapiens
gtggacacagccacatattactgtgcacgcagacaccgcgtttttggatattttgactcagtccccctttttgactactggggccaagga

SEQ ID NO: 532860 - DNA, 763 bp, Homo sapiens
  misc_feature (196)..(196): n is a, c, g, or t
  misc_feature (267)..(267): n is a, c, g, or t
  misc_feature (287)..(288): n is a, c, g, or t
  misc_feature (398)..(398): n is a, c, g, or t
  misc_feature (401)..(402): n is a, c, g, or t
  misc_feature (404)..(405): n is a, c, g, or t
  misc_feature (407)..(407): n is a, c, g, or t
  misc_feature (410)..(410): n is a, c, g, or t
  misc_feature (413)..(413): n is a, c, g, or t
  misc_feature (427)..(427): n is a, c, g, or t
  misc_feature (468)..(468): n is a, c, g, or t
  misc_feature (474)..(474): n is a, c, g, or t
agcggagtggacctgctgtgtggcaggctggctggcctcgacagcggtagtgccttctactccgcttttttagtttcctccgccccctcccgtgggacgctgttgtgtggctgccttaaaaaaaaacgcaactttattgttcctcagccccacctccggctcgagcgtggcgtcctcaggatgcactgaggctgangggaggggaggcggcggagggtcgaggtcgcggtccctctcctccgagcgcccggctggaggggagggagncacgatgtctggtagccgcnngccgggtcgggctccgctgggacaagccccgggtcctcggcggctcctcggtgacttccgcctcctcgtctttatcctcttccccgtcgccgccttccgtggcggtttcngcnncnncnctngtntccggcggggtggnccaggccgccggctcgggcggcctcgggggcccggtgcggnctgtgntggtggcgcccgccgtatcgggtagcggcgtgggtgctggttgtccacctggcctgtcccggcgacacagatgcgcgggcaaggcccagcgccggcgtaaggaggcagcagctccagcctaagcagcaggacagaggaagcgactctcctcgcccgccctctgcaacgggctcatcaactccctacgaggaccaacaggcgacgactacgtattgccccatctgctatgatatgattgacagaagcatacatgacaactgtggcacagcttttgctacacaggtgtatc

SEQ ID NO: 532861 - DNA, 2084 bp, Homo sapiens
  misc_feature (355)..(355): n is a, c, g, or t
ctatctgggtgcaggagaaatgtgtagtgtcttcaaattcattattccatcagtatcgttcaagtacagtcctgattgtcgtcataacttgtggttgaccgaatcccagtcggacatgcattaacgatatgttaacctggaaacgtatacatggattaactcaatcgccgcgtgaataggaagtggatgtcaatctcgtgattcgtgctagatttcgcttactcttatggctgaaaaacttggtcgattcatccctagcagctgcctatggtatggatttgtgggggaaccatgtgcggacgttcaagtgtggctcgtgtggaagtggctgtgaagtgatggcagggtgatttgntcatccaagtgaactttgaattccaggaacactgggaacctgacaagttgaatacgtgaaaaattggaaaggaaagtgtataacgactggtggttgacaagtgcctcatgcaatgtcattcgcatgctgaatagaggtattattaccaaagcagggtcttacctaggattaacgctgtggctggatctgtattgtagatccatgtgtgcacacatagatctatcccagggattcatcccgtgtcaacaatggtaacaggggatgtctggcgttgaagaatggagtctgaccgtggacccgttccattgttattcctcaatggcccgggggatttaagccagacgtttttcgaacctgcatagctaagggatctctgaagggttgtccaggtcgagaaacagtgaagaatacccgtggggcactccggaaggcgctcaaagaagcgcgtgtataaagtgagcccaggcgggggaaattcacacttcagggggttatcccgcgtgtgataacacgcggcatgtcaaacccaggggaaggcgaacccacaactcgcagttaactgtgcgcaaaacccgactccggtgattgtgactccgccccagccaaatatgctcttgggaaaaacgacgacgggatcgcccacccacaccaaatgcatagctggctattcgatgttgtatgtatgtatatatttattctgttattgtctattaccaccacagagctagcgacccatcgctcctagcactccggcacccaccgcccgtaccctacctgccatgccgcagaacctaataccaatgcatcatactagcgcagaccgaagacctagcactgccagacacgacctcgaccgagaacaacccaggtcacgaggcgagaatcgactaatgcagtgagcgagagcggggtggatcacgacgggcgtgctacgggtggagatgatggatgacggagcggctagaaggcgaagagtgggaggcagtgccgggctgcggtagcgggtggacagtatgcgacagacgctgacggatgctggagtggctggccgagcctctcgtgctcggctcgtgcgcagatgcgaccggcagtgaggcacgagggcgcgaggagaggaggacgggagcacggtgagacgcgcgcagcacaaccgcggaagagggcggcgaggggcagcgggcagagcacggaggggggagtcggggcagagcggggggagcggtacggggcggcgcgcgtgcgaggagcacggggaccagcgacacccgagagtgtgtcggacggccgacgcagcgataggcgccgagaggcgggacgggagcgcgagcagcagggacgagtcacacaacgcgacggcgcgcacacaggcggagcgccgatggacgatgagcggatgggccgcgcgagcggcagcaagctaggggctaacagcagcaagcgcacaggagcggcacaacgagcggaggcgaaaagcagtcgcgcggactgcgcaggccgcgcctgggcagcacgaaccgaccatcaggcagacgtcagccgaaggaccacaagcacacacgcacccgcagccacgcgctgcagcgcacgtcggacatagcgcccacgcaacgacagcagagaggccgagccggcggggacgccgtggcgggcgacccgacgccccacagaacactgcggtcgggcacgcatcccacgcagcgagcgaccgcactcgcgtaccgccgaatgc

SEQ ID NO: 532862 - DNA, 166 bp, Homo sapiens
  misc_feature (13)..(13): n is a, c, g, or t
ccccccggggggnttttttaaaaaaaaaaaaaaaaaaccccccccctggggtttttgggcccccccccccccaaaacccccttttttagggggggttttttttttccccatttttttccccccctttttttttttttttttccccccaaaggccctttttttttta

SEQ ID NO: 532863 - DNA, 160 bp, Homo sapiens
ccccggagcagggaggcagccggcaaggcctctagggagagagccccccactgcagacgtgacccgagtaacttggctgctgatgaacaaatctggcaccccgacttcgagaccgtgcggtgggcattacacaccgaccccgccatagccaccgggctcc

SEQ ID NO: 532864 - DNA, 120 bp, Homo sapiens
aagttccggaagtttaatattccccgaatgtggtagtaaaccttaagtttggcaaaaacaaagagtttgtctccctacctatgagagtctcgtgtctaaacgcgggtcttttttcacaga

SEQ ID NO: 532865 - DNA, 826 bp, Homo sapiens
agcttgtcttagaaagccacattatggagtcatcaagcctgctggaacctgatggggcagctttttgaacagcttactggaagtaagaacttcagttgaaaagcccttatgatcgcttcagcccgggacatgcccttcagatggcttattctcacgtaaagcttgtatgtagactgtgacactgtatatgtgtgactcgtacaagcagtgacgtgtgtctgaagtggtgtaatcgtataggtattagcttcttggtggaagtgcaattttgtatactaaaaacatggcttatttgcagtggaatatgttataaattgtggtttatattactggtattagtcttagcctaatgaacctaattattgcccatgtctgtattcttggcttcctcaaagtagcatctgcgagaaatggcatgagcaagatcagatcatgtgttcaagtagtacataggctgtaatcacaaatcacttgatcacagatgtatataatccctggatcatatggtgccaatgtcagtggtaactcccatttgcatcaaacctatgataggactggaagtaagaccacatggggtatgtgtcgtacagtgtttatcaaagccatagcaggcgaaccacaatattgtccacgacggaccaaacacacgacggagcccggcgcaaaagctacaaacccgaaagcgcagaaagcatccccgtcagccgcggacacggccaaacgcgcgcggaacagagtgacaacaccaaacgcgatcatacttacgctcagtacaaacacgcaaccgaacaagcaaaaaagcagaaacaacagaccccacaaacaa

SEQ ID NO: 532866 - DNA, 412 bp, Homo sapiens
aagcgcactggcaacagagaacttccctgagactgggtaatttataaagcaaagaggttgaattgactcacagtgccacatggctggggaggcctcaggaaactgacagtgtgtggcggaaggcttaggaggcatgtcttagatgacagcaggcgagagagagcatgtgaaaaaggaactgtcgaatgcttataaaactgtcagatcttggtgtgaactctctcactattacaagacagcatgggaggaaccaccctcatgatccaatcagctcccagcaagtccttccttcgacacatggggatgatggggattacaatttgagatgagatttggttggggacacagagtcaaactatatcaaagaaagtgatgcaacaggtaatatatcaccggtagcagtgtgcttccg

SEQ ID NO: 532867 - DNA, 229 bp, Homo sapiens
gtattactctcctcccatgatgcgagaggaagcttcgtattctgatctctgagtgaatcccttgttctctgtttaaaaaaatctaaaaagaaaaaggaaaaaaaaaagaactgctgtgggattggtcaaccacgcttacctggcaggaatgtttcaagttctagataaactccgtgatggaaactgggtatagatcagaaattcaggtaccactccacattgtggaata

SEQ ID NO: 532868 - DNA, 1042 bp, Homo sapiens
cgctgtttaccccgggggtcccacatctcaccggaagtaggggccatttttctagacacttggttcctctaagggggcccctagacacaatgtcaattgtttagaagtggtagcaccctgggcccatgttcttaattcttggtaacgttaccttgttgggggaatactcctcgccctgtttgaaccacacagtcttaaaggctttaaacaatgtctggtttttgtctttttatccccgtttttttttgtggagtgggaaaaagttttttaccaacaccaccattgtgtgtatttggggggccccccctgttgttccccggtctgggggtgtcccgtggggtgcctggctcgtggcatctccaggcgctaatcgtcacactcgtgtaccccccttggaattgtggggaaacacttaccgcgccccacgaaaaggaatttttgccactgagatttcgggatttcccacgtgccacttgttccacactggagagggtggtgggtgaaaccccacctatctggcaaatttttgtgtgcctccaatacgctcccagacccaccccatcttgcggggaatgtggcctatattagggcctcccctatagaatctccacgattccctcggggagaagccccacggcccctctcacggtggcccccaccaccaccactcctttccctctgaacgccctgaccactttttagggcacacacacgtgagggcactctttccctggaggaccccgaagccacgaccccgtccctgccccacgggcacgcactggcacctccacggaagaaaaccacggctggaacactcggggcacactcgtttctggggaaggcctggcctatacacgccaccccaccctgaagccctcccggccacagcttcgtgctggggtgggccacagtgccacggaaccacgaagggtcccccgcggaaagccagcccccggagctcactcgtgaccacttgagagtcccccactggagagggtaggggtggctaataaacttttcccaacgattgttgtcattttta

SEQ ID NO: 532869 - DNA, 1341 bp, Homo sapiens
gcttcagtgtgttttttcggctggcttgtctgggctgagctgtggtgcgagcccgttttagcgatgcgccgtgtaagtcgcctttctccatctgtattacgggttagtcttcctcccgttgggtgggtcatctttttctttgtttagttctctcggcgggtgcgcccgccggaggcgctcctggttcttctttggggggtgcgtaataaccgtggtagtgctgtttgttggttcgcaccagacggttgtgttttcacctcggggggagttctcccgtcggccattgctgttgggccccgctcgttaccccggggcccaacatgtgggcgccaactgtgggtcacagcgccccttttgccaccccgctgccgctcctgtgggagagtgtgtgtcgcccactcgccctgcccagaaaaagtgtggaatataaatggtgtgttatcccccgacggagttgtgtgcacaagtttttgtcccttctctaccacaagttgttgggaaaccactcgtcgtctccgtgatgatttggcgcatctccccaaaagtgtgccctgtggacacgaaaattgcctgaattgttttctggaattggcccaagaggagacttcccctcgcacgggtttttttgaatgccaccccaccacaaggctgtgtctggaatgttccagctgagaagaggcgcactctgagggcacaacacgccacggttatccccgccccacaggttcacataaggtccgattcgcaaaggaatggttctccctctttaacggtgtcaccgctggtttccccgtccaatatggagccttccctgaatgaatgatttactccaagtaagccaccacgaccgggtatattcttgttttttagggaaaagtgggaaagtcccacctaattcctaaggtgggaaaatggcctgtttatactcgagtggcaccacattgctataatgcaccacaagagagatataccacaacccaccatccctcctttcttgttcttggagaggtgccatttgacaccccagatggagactgggattctgctggccagggtatagcccacattcccaaggcgtccaatctcacccaaacccatctcaaccagggacccccagtctacaagccctaccaccccatttacaccccagtccagtgcccttttcccaccaaattttccccaggtaactagcgttcatgggatgttgctgggttacccatatttcccattccttggggctccccagaaatgggaaatacccccaccccggttcggcacctttattgccagaattaccaattaccaccattccaattaaacttaaatatgaattcatctgtt

SEQ ID NO: 532870 - DNA, 406 bp, Homo sapiens
tttgtttttccacctggggttttcaaaggagttcagggttttgtaatctcatactggccaagccgcgccgctgcctaaatcgtaagaactttaatggacagtttcaatgaagggggctgttgtagacttaacccccagtgaaggcccagccagcaggacaagtcgttgaatgttctcttaagaaaatgatgctgctcatcgcagcttcagcatctcgtgtttgggagtgcggggctccctctgctgatctcagtttcctggcttttcctccctcggcccctgctcaccgctttgctggcgtgtgtagtgatttggtgagaaatcgttgctgcaccgtgcccccagcgccagtgtatgagtctcaagttttattagtgcaataaaagtgctttatgccggcttttct

SEQ ID NO: 532871 - DNA, 269 bp, Homo sapiens
  misc_feature (74)..(74): n is a, c, g, or t
tattggaattgtcaattgagattttatgttatccaaaacaaatatttttctttgtttttaaacatcctacttcncattacttatctacttatttttacttttatttgtaacttaattccatcaaggagagagagtgcattttctgttattctaaatttttgaagaatgtattgattttttatgacctgatatatggatgatatgtagatattacatgtttgtattatcaaatttcatggtgataataaaataaatacttataatattta

SEQ ID NO: 532872 - DNA, 985 bp, Homo sapiens
  misc_feature (495)..(495): n is a, c, g, or t
  misc_feature (977)..(978): n is a, c, g, or t
agctgtaggactatacatcatgaatccagtgatgatccgccagagtaccagcctcacttggactctcgcagtgagactattggagctgtatacatgctatggcggtgggaagagtttgccattgtgtacataaaagtgcgtattaccaggcgattatcgagcatcacatgtgagatctgttccctggaccacgagcgtgatacggggcattatctcacgagatgaccttatatgtgcctattcaccgcctgtgttcaatacatgctcagcgtggtgctgtcccctagtggtaaatagtgcgcgtccaaacagctatgtgcatgtagccctcagagttccaagatactttattaatatcaagagttgagttagaccgcacaagtgtggttcacttggaaactgttgtgtcgatcccctccaaatgcaagctcgaagcgttgtggctctgcgggcatggggattgtcctgagcatgagtcagtagcatgagatcccncggatcttgtaacgctgtgcagtcgtgtgccagtccagcagctttggcccttcgtagtggcaggtcattcctcagtatggcaggggtggtgctataatacctggcaggggtcgccctgaccactatggataatactctctatgcagtgagtggattatctgacatgagcaaagaggaaatgtcggtcggcacgccatatacaggaagtcgtcaaagcataccgtggccggcgacagtaacccagatagtattgctgcagagcccaagagactcattgcggcgtaaggtggcgttgccgaaaaagagcccgggaaggcagtctgacaccgcaagcggagtctcggtctcacgggtccggtaaataaccccgctgatgaaggggacactatccactacgcctcacgatagcacatcttctgacacaccaaccagagtcgcacgtagagatacatcctctcttcatctagatctactgtaccacnncacctgc

SEQ ID NO: 532873 - DNA, 146 bp, Homo sapiens
ctaacacattattatgtttattaactttgagacccagaaataaattcttcttctcttcttgattcttgctcttaaaaatacaaaaaaaaaaatgtctgtctcgtgttattttgggttgcttattggggggctttttaattgtcagg

SEQ ID NO: 532874 - DNA, 1091 bp, Homo sapiens
taaagtgaactatgggttgtagagatgcgtctgaatgagtggcagactagtacatggtagtgtctgacttatatctggtgtagtgcgttccatctatttgatgagggtcttcaagggagcgcagaaaaaaaggcgcggcgggggcaatatcctcgggggaggcccattttgcaacgggagtcttcttttgtcgaagtgctgttatccttaagagatgaggagctcgggatagataggtttaagagcaaacgtgtggcctgacgtgttgtaacaaccgtgttgacgctgggggacactagcggggaaggaagccaaacttgggtggaggggagccttacttgtggggagtggttaacctaacatgggatcaaaggtcatctaggggagaattaaaaaggctcctaggggtagtataaagctgtttacacgttgttttacaatgttggttgcttatttggcatttggggtgcgcgctgggacaaggttctgccgcaccgtgtagtttatgacctcgggggaccattttttattaccccccgcggacctagtcttgaaaaaacagcccaaccaggagaacaaccagaggcaagcaacaactaacgagccgccatacacaacacacacaacatagcccacacacacccacagcagaccgcatccaccaaccgccaccatagatgcgcgcacacaacacgcgcagagaacgaccgatacaccaagaacaggcactagcaaccacaaaaccacacccacaacgatataccaaacacggaggcagacgacagggcacgacgggacaggcaaacgacgacaaggagaaagaggacatcagagacaggacgagcggacgagcggcaggagccaaacgcaagagcagctgagaagaccagcgaggcagaagcgaagcaacgcaagaagcagagacggacagggggcagagaacagaggaggagacagcaaagaaaacagacagtggaaaggtcgagcagcgacacaggcagacggaaagaaaaagataaaaacccagaggacagagagataagaagagacgaaagaaaaaggggaaaaaacaaaaaagagcggaaggcaat

SEQ ID NO: 532875 - DNA, 293 bp, Homo sapiens
taaaaaaaaaatttgggtattacccatggttttaggtttaataaaaaggcccccctaccactggtggatttcctccccaggggtaatccttctataaaggggggggctggtataggatattaccggaactgcctggggcccccagggttttatatccgggtagggtaacctaaaggccggaatttttttaatgataaaattaatttaatggaaattaactctcctgattaacccattttttccctcctcagccctttccaggattttaataaaaaactgctgggggctgggga

SEQ ID NO: 532876 - DNA, 687 bp, Homo sapiens
  misc_feature (29)..(29): n is a, c, g, or t
  misc_feature (90)..(90): n is a, c, g, or t
  misc_feature (114)..(114): n is a, c, g, or t
  misc_feature (166)..(166): n is a, c, g, or t
  misc_feature (237)..(238): n is a, c, g, or t
  misc_feature (255)..(255): n is a, c, g, or t
  misc_feature (261)..(261): n is a, c, g, or t
  misc_feature (268)..(268): n is a, c, g, or t
  misc_feature (280)..(280): n is a, c, g, or t
  misc_feature (309)..(312): n is a, c, g, or t
  misc_feature (316)..(316): n is a, c, g, or t
  misc_feature (318)..(318): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (338)..(338): n is a, c, g, or t
  misc_feature (342)..(344): n is a, c, g, or t
  misc_feature (348)..(348): n is a, c, g, or t
  misc_feature (353)..(353): n is a, c, g, or t
  misc_feature (356)..(356): n is a, c, g, or t
  misc_feature (359)..(360): n is a, c, g, or t
  misc_feature (370)..(371): n is a, c, g, or t
  misc_feature (373)..(373): n is a, c, g, or t
  misc_feature (403)..(404): n is a, c, g, or t
  misc_feature (406)..(406): n is a, c, g, or t
  misc_feature (409)..(410): n is a, c, g, or t
  misc_feature (413)..(413): n is a, c, g, or t
  misc_feature (487)..(490): n is a, c, g, or t
  misc_feature (545)..(545): n is a, c, g, or t
  misc_feature (555)..(555): n is a, c, g, or t
  misc_feature (562)..(562): n is a, c, g, or t
  misc_feature (620)..(620): n is a, c, g, or t
  misc_feature (647)..(647): n is a, c, g, or t
atataaacatcgataaaaatatgcttttnagccaggtgcagtgactcagcacctgtaatcccagaaattttgggaggctgaggcaggaanatcatatggggccaggagttcaanaccagcctcagggagaccgtcttcacaaaaaataaagaaaaaagaaaaccangttcccgtgggacagtgagatgctacgttggggatctatgtggacatgttgggggagtcgtgttgtaatgnnggcaacgctaggctgcngttagngaatgangagttagaagtnaccaccagcttctcttccactgcccacannnntttntnagcaaagangtngccaancncttnnngttncggtnggnggnngttgctttgnngngatgtatggtcgtgtgagggaagggtgagnngnggnngcnaggaaggggctttagaaggtacagtgatgagcctaggactccaggagtccgccctggagctgggaggatggctnnnnggacggggtgggctaacacccagctgagtggagccgtcttgcagggctgtgcttntctgtgcctnggctgangagggcgccgacgccctgggcccttatggcaaattgctccactcggatgctttcccgncaccccgcgtggttgatacactgggantggagacaccttcaatgcctccgtcatcttcagctctccc

SEQ ID NO: 532877 - DNA, 210 bp, Homo sapiens
atcccccctcacacacctgaactctacactacatattttgtcaccaagatccctacttctatcctccctgttcttcataattcgaacagcatacccccgattcctgctacgatccaatctcatacacctcctcatgaataaaaacttcctaccactcacctctatcattacttatatgattatgtctccagtacccgattacaaatctcc

SEQ ID NO: 532878 - DNA, 156 bp, Homo sapiens
gagagagagagaagagcgcctcagacctcggtacccgcgagcggggaggaggcaggaaagaagacgcgcgtctgggagcaccaggaagcaagacggggcccgggcttcgcaagtggggaagtgttacggcgctttggaaaagcaagagcgccaccg

SEQ ID NO: 532879 - DNA, 362 bp, Homo sapiens
acttgaacaccacggtttgggctttggaaacttgtttggccgctgctttggtcagtgcagttaaagacacggattcaccattttccagggcatgctgcattaccccacgctcaacagcatcactccagtggatgtagtgcgagtaagtggtcatggtagacatttgctttccctttaaggtgaaggtctaagttacgagccctcattatagggttttccctagtcgaaaagcaagggtaaaccctaggggttggtttagcctgtggtttttaggggaaaaccctagggtttattggaaagggaaattaaatcaaaggtttatgggggtggggtttgtggggttttgcgggttttgtcgacgc

SEQ ID NO: 532880 - DNA, 397 bp, Homo sapiens
gggggaggtgggcggcgagggtcccggcgggagccaataaagttggtgaaaatcgttacaaaaaaaaaaaaaaaaaaaaaaaaaaaattttgggggcccctggccccaaaaattcaaaaaacacactgcgttggtggcgccgggagtcacccagatgagtaaaaaggagcaatcagggtgtcacttaatgcggtgttctcctaaagagaaaactcgcggggccgtcaggcaagcggtggcttggggatttctacccaaaatataaaaaacacgcgggggggcacaacccggacaggttttggaacaaaatcccagaaggagaggtatggagggctattagcgggcctatatccacagggggactcccaagagactgactataaaatatcccccgcgt

SEQ ID NO: 532881 - DNA, 192 bp, Homo sapiens
agtttgaataaaatgtaaatggaaaaggtgtaaatgtaaaagaaaatgaaaaaatgaaagtattaggagaaaaaatgaatgagttaagttatataaaataagagtatggaagaaataagagaaaaggttgataaatttaagtaaatttttaaaaagttggatgaaaagaagaaaataagaaaataaaatgat

SEQ ID NO: 532882 - DNA, 475 bp, Homo sapiens
gtgtatgatcacgatggtaaaatcattccatgaatactcgcctacccccacccctagagggaccatcgatgtcatgcgtgaagcagttcttttctacgctacctgttgcgcaataaggaatgtcaaaggaatattaagaaggactcctagaggtagcccagccctatccccttgtctccttggggacaacgtgatcacgtgtattcagctcgtggtcaagaatggtccaggcttcttctatatgatctgcacaatgtggttcctctcctccttcctgatggtctgccattagcattggaataaagttcctgctgaaaatccacatctcccctgggtccggtgttcgtggaagtgagagagacaatgtcacacttcaaggaggcagctctctagaccggaaggttattcacgtcccatgtcaagtctaggtagagttcagagcaattgagaagtgcaattttatctcctgcctttc

SEQ ID NO: 532883 - DNA, 270 bp, Homo sapiens
  misc_feature (1)..(1): n is a, c, g, or t
ngacaaatataaaacaaatagcaagatgatttatgcccaaacatgtcaataattacattaagtgtaaattgactaacacttcagttaaaaagcagagataatagaacttaaatttacaaaagcaaagattgccagtctggatttaaaaaagctagactcaaccatctgttgtctgcaggagaatagtttaaatataaagcacagatagtttgaaagtaagaggatggaaaaagatacatcacacaaatagtactataggcaccctggagt

SEQ ID NO: 532884 - DNA, 188 bp, Homo sapiens
tcgagctcggcaccccctcggaacttgtcaattccgaggggtaaagtttgtgtgttgcccactggctgaaaaaagtgacaatgtggattctgctgatgcggaggaggatgactcgcatgtttggtggggcggaccagacacaaactatgcaaatgggagtgaagacaaagtactaaaagtagcagagg

SEQ ID NO: 532885 - DNA, 653 bp, Homo sapiens
  misc_feature (49)..(49): n is a, c, g, or t
  misc_feature (63)..(63): n is a, c, g, or t
  misc_feature (89)..(89): n is a, c, g, or t
  misc_feature (91)..(91): n is a, c, g, or t
  misc_feature (93)..(93): n is a, c, g, or t
  misc_feature (99)..(99): n is a, c, g, or t
  misc_feature (106)..(106): n is a, c, g, or t
  misc_feature (118)..(118): n is a, c, g, or t
  misc_feature (122)..(122): n is a, c, g, or t
  misc_feature (138)..(138): n is a, c, g, or t
  misc_feature (142)..(142): n is a, c, g, or t
  misc_feature (163)..(163): n is a, c, g, or t
  misc_feature (167)..(167): n is a, c, g, or t
  misc_feature (171)..(171): n is a, c, g, or t
  misc_feature (205)..(205): n is a, c, g, or t
  misc_feature (250)..(250): n is a, c, g, or t
  misc_feature (254)..(254): n is a, c, g, or t
  misc_feature (299)..(299): n is a, c, g, or t
  misc_feature (302)..(302): n is a, c, g, or t
  misc_feature (333)..(333): n is a, c, g, or t
  misc_feature (342)..(342): n is a, c, g, or t
  misc_feature (357)..(357): n is a, c, g, or t
  misc_feature (376)..(376): n is a, c, g, or t
  misc_feature (394)..(395): n is a, c, g, or t
  misc_feature (478)..(478): n is a, c, g, or t
  misc_feature (499)..(499): n is a, c, g, or t
  misc_feature (568)..(568): n is a, c, g, or t
  misc_feature (631)..(631): n is a, c, g, or t
tgtcccttaatgaccccatcccatcccccacttagaggaaaactttganttcctgatcgtgtncagcacgggttagatgtggcattttnangnagccanttttttngagcgggatgcntggntccaggccatcgaganttanatcctagccagtttgcaatgntgtnagancagcaaggtcaaggtaagatttttttgtggagtngaggattggccgcaggaactgaccctggtgctgacggccattggnaacnttacggccgaagttgttttttttgagagcagaggtgttttttttnttngtggggcttggaggcaaagtcagttccaacntaaattttntttgcagctgcgcanagacagccaaagcgaggtngtggccatccaggttatnnggaacgccaaggggaattcaatctgcgtggactgcggggcccccagtgagttccaggaggcagcggaggggctagggagtgtngtgaatgccggggtgcctgtnctgcccggctgggagccgacctctacgctccttccgcagaccccacgtgggccagcttgaacctgggcncctcatctgcatcgagtgttctggcatccaccgcaacctgggcacacacctgttccgcgttcnctcgctggacttggacgactgg

SEQ ID NO: 532886 - DNA, 238 bp, Homo sapiens
cttatggctcagatctctagcaggatcccctctctacagttgcggcatctcaacaagccgcaatgttactaacgatgatatcacatgctgccgagcttaattgttaagcggatttatgttatcctggtagaaagcatgcctctgtttttctgtattgtttccaaaattataccggccacccattttgttcagattattcgcggcattctgctataaggtgtcgcgactcctgtagtta

SEQ ID NO: 532887 - DNA, 162 bp, Homo sapiens
gtagagacaaggatcttgctatgttgcccaggctggtctcaaccttcttacctcaagtgattctcccaccttggcctcctgaattgctgggattacaggcatgagctaccatggccagctttttttctgttttgtttcttgttccccttctgtcgtcttctc

SEQ ID NO: 532888 - DNA, 593 bp, Homo sapiens
  misc_feature (48)..(48): n is a, c, g, or t
  misc_feature (61)..(61): n is a, c, g, or t
  misc_feature (71)..(71): n is a, c, g, or t
  misc_feature (81)..(81): n is a, c, g, or t
  misc_feature (94)..(94): n is a, c, g, or t
  misc_feature (97)..(97): n is a, c, g, or t
  misc_feature (104)..(104): n is a, c, g, or t
  misc_feature (144)..(144): n is a, c, g, or t
  misc_feature (163)..(163): n is a, c, g, or t
  misc_feature (173)..(173): n is a, c, g, or t
  misc_feature (186)..(186): n is a, c, g, or t
  misc_feature (193)..(193): n is a, c, g, or t
  misc_feature (197)..(199): n is a, c, g, or t
  misc_feature (205)..(206): n is a, c, g, or t
  misc_feature (232)..(232): n is a, c, g, or t
  misc_feature (234)..(234): n is a, c, g, or t
  misc_feature (238)..(238): n is a, c, g, or t
  misc_feature (240)..(241): n is a, c, g, or t
  misc_feature (243)..(243): n is a, c, g, or t
  misc_feature (275)..(275): n is a, c, g, or t
  misc_feature (278)..(278): n is a, c, g, or t
  misc_feature (293)..(293): n is a, c, g, or t
  misc_feature (299)..(299): n is a, c, g, or t
  misc_feature (309)..(309): n is a, c, g, or t
  misc_feature (328)..(328): n is a, c, g, or t
  misc_feature (386)..(386): n is a, c, g, or t
agtgaagcctttttcagcggggaaggcgcgaaatatttatttgggttnccttcattgtttngggaaatttngtttgggttnataaaacataaanatngccaccncttaaagcaaacattcaaaaccccagggggacaaattatngactttttgggcaattaanaatccatatntgaagttgggctnccaagtngggnnnttacanngacaattctttagggcaagccctgtngngctngnntntaatacatgtcctctacagaccccaaaacagntgntttaaatgtccaaangacagntcaattcagncaaatggggcaaagactcncaataaagggaactgctgttaatttcccaaattaactttaaaaaatccctggagaagngaatcccaggaaatgaactttccagatttctacatcctagaattttggcttgtcaaacacatttcatagaaatcaggtagcattataagaacatttgcttattacttgccatttcaataagcactcaagtttatactcccttaataggcttaaagaaatgcttgcctgagagtttattttttggggaaaaaggcaagttaatccccc

SEQ ID NO: 532889 - DNA, 523 bp, Homo sapiens
gacagtggtaaagacgctgaaaatgacatcatccccaaccctcaggaacgtaccctgacttggtagacacaggcagtggcatgaccaaagctgatactcataaataatatatgggaaccatagccaagtctaggtactaagagagcagatcatagaagctctatcagaacctaatacagacaacaccagagaaaaagaagcagaatgaaataggaaagacgaaagaagacaagccaacgagaagaaacagagacagaaaagaaagagagaaaagacacaagaagcacaacaagagagagaacaagaagaagcgagatatatattacttatcttatatcttaatatattatattaacctatgacagcgaagtagctataatctaatacctataaattataatccctattaaaatgcgaaataagagtaaccaagatataaatacctacctatactatttttattttaataatacattatctaatatataaccttaatatttattaaatcattagacttgattat

SEQ ID NO: 532890 - DNA, 428 bp, Homo sapiens
  misc_feature (94)..(94): n is a, c, g, or t
atgtgaaaaaaactttggtgtttcccttatgaaaataaaggattgtaagtaaagtttcctgcgccccttaaaccaaaattcagtataaaacccncctttttgttttcaaacaaataaatcaaaaaatagtcgggattatcggtaagatctgtcttgtaaaccccattttttgcaaccatttgcctttgagaaggtttggattttaaaatgggccttttgtcttgaaaagaagtaaacccataaacttgtgcaaaacaagtttcaagtttataaaaattaagtttgtaatgtgagcatcaaatgggtatgtaaaaaaactttttcccagtttggaacttgggaaaatccagggaattttaaacataaattttaatgagggggtaaacccaaatcatgtcaataaaggtagacaggatcttttatcctta

SEQ ID NO: 532891 - DNA, 236 bp, Homo sapiens
ggggaaggggggtaaaaaataaaacgttttttttttcccccctgaattgcctttgtggtcaaaaaaaatgttttaatcgctaaaggaaaaaacagtaagggctttaaaaattaagggcccaaaggcccaaaaacagttaaatatgttttttttttcctttgggaattttttggttggttttgggtgttttgtttttcaaacaaaaaaaaagtggggggacttttttttttttttta

SEQ ID NO: 532892 - DNA, 762 bp, Homo sapiens
  misc_feature (738)..(738): n is a, c, g, or t
  misc_feature (758)..(758): n is a, c, g, or t
gttgggactacaggtgcatgccaccccatggccggctaatttttgtatttttagtagagatggggtttcaccatgttggccaggatggtttcgatctcctgaccttgtgacctgcccgccttggcctcacaaagtactgggattacaggcatgagccaccgcgcctggccctgatatccattttaatcttctttggaagggcccatttttatcttaatgaaatagagcagagtagttttcaaactaaattttttaaaagaccggcctatttcagctcaatctaaaaagtagatcatatccatatgatatttgattatatgtttagaaattaaagttcaaattggcagtctagatgttaattcattaaaaaaattgtcataatgtgaagaaaccctttaattggatagcttttccttgactctgtcaagctgtggaaatggttaagatctaaaaatgctgggaacaagttagtatgtttgaaggtacgtagctattccacacacgtgtgcacttgctgaggatatctgaggtcactttgtcattaggtgcagatagctggcatccagctaggacaacagttgatgccagctgaaaacacagaccccttggctgttaatacacaagcagaaaagattcttgtgttcaccatgcagcttgggttttaaatttaatccaagttgcagttttcaaagtatagttttttgaaatcctttcatcattattttgggcacttttacnggtgtggcctttaatttttnggag

SEQ ID NO: 532893 - DNA, 411 bp, Homo sapiens
gatttttgtaattagaggtcatttttccaaacaaatgattcttaaggtcctgctgtctctgaatattatttttatagaacaagcataagtataattggatcaatcatctaacctttcagatcctcaacttagtcttccattaatgagaggattaaatccattagttaaatgttctctaagaatcagtgtgtctccaacttcagtgtacaaacagcgggtcacccagggatcgcagtgggacgcagacgctgattccgcagttgtggacttggtggaggtgggcgctgtctcagtccatctgggccgctatacagagtgccacagacagagtggcttacggacaacagatgctcatttctcactctctggagactggaagcccaagatcaaggtggcagaaaatgccgtgtc

SEQ ID NO: 532894 - DNA, 1039 bp, Homo sapiens
ggagatgcgcggggagccattgtgctcgtggcctcggagcaaccatccctgagcatatggagctactactggtatgcattcgggcccgagtcgccgtccaatcgtctgtacgcacggtgatgctccaagacacattgtatgattacttctggatgggaacgtctgtgcgactagccattgattacacttagaccgttgggaccgtactctatcaatgaccgtatgatggacgttgtctacgccagaaggctcaggatctctatatcaggctgcccctggctttgctgcttcgctcactcgatatcgactacgtatcgtttgaggctgtatcgagtggttacaccaactggctagccctcattgaacatataaggagaaaacgtcggctgcgtggcacctcccaacgccatccttggaagcatttctacctgaccagtggcaagcatgcccaagccaggtggaagtagagcttttgtccctgtgcatagctgggctctctggccgccagtgtagcgcgttggttcccgtcgtccgtccgactaaccatggacctggtgccagtctcctcaatgaaagttccgagaagccagctggagattcacattttacctgattgccgttcattgcctggcatggccgtcattgtggataaaccctggttctatgacatgaagaaagttgggagggatatcccatacagagcactatcccttcccagtattggtactacatgatttgaactttccttctactggtcctgctcttcagcattgcctctgatgtcaggcgagaggatttcaaggaacagatcatcaccatgtggacaccatcattcttcatcagtttcctggtttgccattacgtccgagctgggattctaatcatgggtctgcttgactcttcggataacgctgtggagtccgccagagtttaataacgcgggatggagaaacctggcaaaacatcttaaccggcttcgcattgtgttatcataacccgatgggtctctgcctttgggtctgattgccctgttgttccc

SEQ ID NO: 532895 - DNA, 158 bp, Homo sapiens
aatatcctgctgctagtactaggagaggtcttatccttagacttcagttgggtcaccagattaggtaagaaagaaaagtgtggggggatgggggatggcagaatgggtacgtgagttggggatgctgagcaaaacatgaagacggagaaatgaaacaa

SEQ ID NO: 532896 - DNA, 113 bp, Homo sapiens
cgctactgtcgctggcaagctactgccctgtgtgagttgaagaggggtacataggtttgccatgggctggtctgtgtggacactcttctctttggtgggtggcacagcagaga

SEQ ID NO: 532897 - DNA, 242 bp, Homo sapiens
ttgtggtatttttagtagagatgggggtacaccatgtgggccaggctggtctcgaactcttgagctcaggtgatacatctgcctcagcctgccaaattgctgagattataggcgtgagccaccatgcccggcctgggtcacctttggatagatggacacatagcctttaagagcgcaggagacctcttactgtgtacaccaggtgcacacagtaggtcctcactgtgattttgaactgagca

SEQ ID NO: 532898 - DNA, 376 bp, Homo sapiens
gtagaggcagcgccaagaagaggcctttgccgctggttgtgattgggataaccatgaacacagtggcggcggcccgcttccggaaggtggacgtgcgcttaatatgacgagaacaagttcgtggacgaagaagatgtagcagacggtagtccgttcccgacgagggcgaggtgcactcctgcctgcggcaaggaaacatgacagctgccctacagacagctctgaagaacccccctatcaacaccaagagtcagtcagtgaaggaccggccaggcagcattgtcttgaaggtgctcatctcttttaaagctaatgatatacaaaaggcatgtcaatctctggacaagaatggcgaggatctcctaatgaagtatat

SEQ ID NO: 532899 - DNA, 856 bp, Homo sapiens
  misc_feature (471)..(471): n is a, c, g, or t
  misc_feature (548)..(548): n is a, c, g, or t
aagtgctatctgggaaagagagcaaggtgaaaaagattattcaggagcttcctgtccaaggtgaacacaaatgccctttactgatagatgtcagaagaaaacatcacaataaagttaaaacagactaaaagctgaagctaatagcatagagaataatagcttggtaaactgaatatcatgttcacgacatagaacacgttacgtacgtgattcagacatcccgagtaatggcaactgaacggtagtattgcataagctattgctctgctaagtaggtgctctcatattggtgtttagtattagcccgtttgtctccatagttggttacacgtgtctaggtgcccgagtgggcgtatccaactctaatctaagattactgttagatacctagtcttcttacttctctgcacggcacatgtttgtccaagagagtttggttcatcttgtgcaagagagactgcagcagcgtgntacacctggaggggacgtgtcttgccagagtttgacctagttatggggcaattgacactaacatgtcgcactgtggncttgtaaacttttcaatagaagtaaacacaatgcatggtaaggtttgggtggggaagagactttcacagataaaaacataaggacaagatctcccggaagaaatctgaatattacttgctcccatgcatctcttgtcttctcgcgtcactgggcctatggtgatgttgacggtcgcgcgcggtagaaaattgacattttctttgatccgctccataccctgttgtttttagaagctgggaccctttctttggcagtcttgtcctgggtccttggaacgcccatgggtggcttccgccggggggggccc

SEQ ID NO: 532900 - DNA, 939 bp, Homo sapiens
  misc_feature (14)..(15): n is a, c, g, or t
aaacatatttctcnncaactagtaacatattatcactgcagcacactcccacatgatcttttcccgcaatgttttcccggtattttacactaaagacaccccttgtttaacaacaacgtggttttaagtgctgcacttatatagcatgccctcgtgatacaaatcgttcccctttattaccagcgaaaccccctccacattttggtaatacacaccggttccgcctggaacaactctgccactatctttactgtgtaaacaaaacccttttgcgtaacaccggcacatccaaggctctctttaaataaagcatttttaattcacgacacccctgactatctatttcccctgttgacctcctcccctccctccccccccccttttagttaaccagtcccatattttggagaaaatccctctgacacaagacttgacaagcactcattcttttttcggaattaaacccttctaggatttgttatagacacctttttatgcaaaacattgttagaaggacttttctatgctcaaaccgacgtaaagaaaattaaatcatgttctacagcaaacgtcttgtcgcaggagagtaaccaaaaagaacatcgcgagagctgtcttgtttgatttcaaacaactaggcgagatttttctagggcatacaaggaaccaccacggctatgtagatcttccaccggcagggacacactcatgtgaaagtttctcgccccaacgtgttggttcacacagtgaaaacggccatcccacgatatgattctactaggtatggtcatcctctaataccgttcatgagcccacacaggtgtcgccacccgtaaaagtgtgacacaccgggggaaagtgaccaaaagatgtagcacacttacaatggtttcatgtaagaggggagttcagtaaaaaatttaaccccgcaacaaaaca

SEQ ID NO: 532901 - DNA, 103 bp, Homo sapiens
  misc_feature (66)..(66): n is a, c, g, or t
agttttataacaggagagaaggcccccgaagtacagaatgccgggtagggctgttaatggaggtcngaaaaccgccatccagacagacagcctcaagtgaaaa

SEQ ID NO: 532902 - DNA, 249 bp, Homo sapiens
ttaattcatgttagagtgagaaaacagctacaaattagagttcaatacattcttaatttttttagtctttaatataagcatatataatcaaagcactgtgctcaaaatttactcaagttagctccctccctcacccctttaagtgtggttatgttatttatttgcaatacaaatggttaaaatctggaaaaatgtgaacattaaaataaatagtgaaagtagtgaaatatacaaaatatagaatgaaat

SEQ ID NO: 532903 - DNA, 295 bp, Homo sapiens
  misc_feature (1)..(1): n is a, c, g, or t
  misc_feature (92)..(92): n is a, c, g, or t
  misc_feature (122)..(122): n is a, c, g, or t
  misc_feature (128)..(128): n is a, c, g, or t
  misc_feature (143)..(143): n is a, c, g, or t
  misc_feature (152)..(152): n is a, c, g, or t
  misc_feature (248)..(248): n is a, c, g, or t
  misc_feature (256)..(256): n is a, c, g, or t
  misc_feature (262)..(262): n is a, c, g, or t
  misc_feature (264)..(264): n is a, c, g, or t
nttaaacaaaaatgcaaaaaaagcactcctggcgttcacttgacatgatagcaaatggaaagaatataaatgcaacaggtgttaacatttanaacagtacttgtaaacctgctcatttctanaaaaanccgggaaactcgctncgaaacacntcatctatcactgcatgatttcctttgacatgaaatatgactttatgaaaatcttcctaaacctcactctggctgcacctgagtggttcctattcnaaaggcgntggcanangatgtaagagaaaaccactatctgtttcgtt

SEQ ID NO: 532904 - DNA, 1007 bp, Homo sapiens
  misc_feature (114)..(114): n is a, c, g, or t
  misc_feature (135)..(135): n is a, c, g, or t
ggagaaaggggtgcgataggcaaaggcaccatgccctctgcgggatgaaaccctccgagagtgtgggcctctgacagtgggcatgaagaagaaagcctgagcccggaggcccgnggcgccccaaacagcgaccgncccggcagagaggctaaggaagaagaggacggaggcctcgaatcttctgcgccacgtggtgatccaagccccggaagctcggagctgggacagggacggggaggcggtgggagggagccttcccctagatcctgtccaggcccgggcgcgctgcagacggtctacgccctggttcctcagggatcccgaggcaagaagccgcgacctcgggaaactttctggtagctccgttgcctccagacgcggatgacgatggaggaggaggaagaaggaggaacgactgatgctgatggatcccaggtccagtcgcaagggggcccgacgagagtggtaactgggcactgtcgggccaaggacacccaaccgtgaccccgcacaagcatccagccaaacccttaacggtagcagcgtccggaccgtgccggccacagtgcgcccgtggcacaacgtgccgcacggcccatgccgcgcatcgagacatcatttagcgctcgttattccttctgtgtcactgtcttccacccaaggatgtcggtgcaggccaaatcgccataaagcacaactcaacgcatacgaggcctctagcacgcccgcgagcgggtaacactaccagtggtagcaccaggtgccactgtgagacataaagatcaggacgtggaccctcttgtcttcatgaacgggtgcctcatgactcgcaagtgtacctcgaccaacactggcactcacaaatgcaaaccgacagatgactacgtgtagaaccatgccacagtgcgctacagcacaccaaaggacagccagacatggagcccaacagagagctcacccagacacgagatcgcagtatgcggcgcgaccatgtcgagcacaatgaa

SEQ ID NO: 532905 - DNA, 1107 bp, Homo sapiens
cccacgcgttcgaatgtcctgcgtgcccagacctctcctcacgctcgcgcagtctccgccgcgagtctcagctgcagctgcaggacatgagccgtgcacccggaggagacccccggaggaggcgacaaaacttcgcagtgccgcagaccaaccccagcccatggcctgcatgacatggcccagcgtgttccgtgctcccatgctggtagccctgtgtccatggctccaggctcctgcagcatttagcagatgttctggaaggagacagctcagaggacacgcagctttttacgctgtgctgcaatcgcgggactgacagcgccaactgcaggggcgtgctcagagcggacgccctccaccgatccctttgcacaacgtacaattaacctagcggggccaaccggaccagatgccgacaggggaatggtgcattggagcatcatcctgcagaggctcaaaggtggacctttatccttgtcccctgtgtggcccgaggcagcgcaaaagagtgcactgcgatggggggccagcgaggaagttgaccaccggatccaaacgcggtgccaaccggacgagaccattacccggtgattttccgacgatggacaacattgacccttgcagtataacccatagacagatcagacatcaacacagaaacgtatatacaccctgggacggcatgtacgcaggaagacattggacgtcccacaaagcagaaatcaaggggtaatacgtaatacagcctgcatggaagggatccacggaaaatgggacaattcacaatgcacgcacgacagacgatacgacagtacggcacgggatccaaacgtgatcaacaaagaagggcgatcagacgatatgtacatctaacaccccggacaaaaggggaacatcttgtcaccagcgaaaaattcaacttataaataccaataaaatacattggagggagaacacaagaggtacatgcccatgtgtgcacccccgccaattagggacaaccacccacaataagttggaacacgcaccccatggaagcaaaagactataatgcacaacagtataaccttgagtagagacaccatgacaaccaacaaggtctactgc

SEQ ID NO: 532906 - DNA, 571 bp, Homo sapiens
ggatgggtgtccttatcaaaagaagagaatgtatatggtaggacaaaatggaaggtcgatgtggtatataaagaaaatattagtggggagtggtttatgatgtgtatagtggtttcagttcaagcacttacaaagattggagttggtttctgcccttgtaacacttcaacagtcatatgagttggctttaccattttgctgggaagggaactgagactgattcagtagtgcaaggtgatgagcagacatgctcaaaaagccagaaatagatgggtgggcttcggactgtgagaccaggtgctctctccattgaattattctgctgatgggactgttggcttggctttaaaaaatagtaatgcacagttcggaagtgctgtggacggtgagataaagtcagtgtagatctataagtaatgcacattccaaccaaaccaggcaagggaacaaaacgcgttacgagacagtggggtggggagatggccccctcccaggaggggactgtattctcatcatcccccagatctgtcgcatggtatctgatgctggaccagggtcctgtctcatgcaa

SEQ ID NO: 532907 - DNA, 1142 bp, Homo sapiens
  misc_feature (32)..(32): n is a, c, g, or t
  misc_feature (61)..(61): n is a, c, g, or t
  misc_feature (77)..(77): n is a, c, g, or t
  misc_feature (84)..(84): n is a, c, g, or t
  misc_feature (206)..(206): n is a, c, g, or t
  misc_feature (669)..(669): n is a, c, g, or t
agcggatagccgcgcgaggtcagggagctcgncaggctgctggtacctgcgtccgcccggngagcaggacaggctgnttgggtntgtgacctccaggcaggacggccatcctctccagaatgaagatcttcttgccagtgctgctggctgcccttctgggtgtggagcgagccagctcgctgatgtgcttctcctgcttgaaccangaagagcaatctgtactgcctgaagccgaccatctgctccgagcaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccgcgagcgtgtaacgtccgactgancacaggctgtggactctgacacggagtggggccagctgccgcacttctggggtggatgatgtgaccttccttgggggactgcgcgaagggacgagggttaccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtttaggccctgccccaaatccagccagtcctgccccagcccacccccacattggagccctcctgttgctttggtgcctcaaataaatacagatgtccccca

SEQ ID NO: 532908 - DNA, 138 bp, Homo sapiens
  misc_feature (119)..(119): n is a, c, g, or t
gagtaagcagggttatgtgctaatatcttgtggctcttctcttctcttgcatgcttacttccacactgtcacttctttcaagctgctgatcacaagttcacctcttacacggaagttcntccatgcagtacgcttact

SEQ ID NO: 532909 - DNA, 1106 bp, Homo sapiens
  misc_feature (32)..(32): n is a, c, g, or t
  misc_feature (61)..(61): n is a, c, g, or t
  misc_feature (77)..(77): n is a, c, g, or t
  misc_feature (84)..(84): n is a, c, g, or t
  misc_feature (633)..(633): n is a, c, g, or t
agcggatagccgcgcgaggtcagggagctcgncaggctgctggtacctgcgtccgcccggngagcaggacaggctgnttgggtntgtgacctccaggcaggacggccatcctctccagaatgaagatcttcttgccagtgctgctggctgcccttctgggtgtggagcgagaagagcaatctgtactgcctgaagccgaccatctgctccgagcaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccgcgagcgtgtaacgtccgactgancacaggctgtggactctgacacggagtggggccagctgccgcacttctggggtggatgatgtgaccttccttgggggactgcgcgaagggacgagggttaccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtttaggccctgccccaaatccagccagtcctgccccagcccacccccacattggagccctcctgttgctttggtgcctcaaataaatacagatgtccccca

SEQ ID NO: 532910 - DNA, 699 bp, Homo sapiens
  misc_feature (10)..(10): n is a, c, g, or t
  misc_feature (66)..(66): n is a, c, g, or t
  misc_feature (273)..(273): n is a, c, g, or t
  misc_feature (609)..(609): n is a, c, g, or t
gcaggcaganaggccggaaagaagcaggttgggagtgtggcggccgcagcttcagcagctccgcgntgaccatggccccgatcaaggtgggagatgccattccctcagtggaggtatttgaaggggaacgggaaagaaggtgaacttggcagactgttcaagggcaagaaaggtgtttttgtttggagtccctggggcatttacacctggctgttctaagacccacctgcctgggtttgtggagcaagcctggagctctgaaggccaagggangcgcaggtggtggcctgtctgagcgttaatgacgtctttgtgattgaagagtggggtcgacccaccaggcagaaggcaaggttcggctcctggctgaccccactggagcctttgggaaggcgacagacttattattggatgattctttggtgtctctctttgggaatcgtcggctgaaaaggttctccatggtgatagacaacggcatagtgaaggcactgaacgtggaccagatgcacaggcctcacctgcagcctggcccccaacatcctctctcaactctgagccctggccagatgtcctctgactctcccatctctcccacccggctctagncaaaaggctcggtacctccttactgggagccacgtaaatggaaccttgaccatatttctgcaataaacagtttaatttgtgtctttaaaa

SEQ ID NO: 532911 - DNA, 302 bp, Homo sapiens
taatctcccatcttagacttatttgtttggctcgtttttaggaaggaatttctcactgtagtgccaaggctgaaatggtaattgtgtttgagcaagttccctgaacataaggcggcgaggggaggaagaggaacgatccaggccatttttgttgatacataatagttgcacatattttttcatgtgatggttcgatatatgcatacaatgtgtaatgatcagatcagggtaactgagatatttgttgcctcaaacattttttctttggtgtgaatgtttaaactcttctagctggtttgaaa

SEQ ID NO: 532912 - DNA, 1189 bp, Homo sapiens
  misc_feature (32)..(32): n is a, c, g, or t
  misc_feature (61)..(61): n is a, c, g, or t
  misc_feature (77)..(77): n is a, c, g, or t
  misc_feature (84)..(84): n is a, c, g, or t
  misc_feature (206)..(206): n is a, c, g, or t
  misc_feature (669)..(669): n is a, c, g, or t
agcggatagccgcgcgaggtcagggagctcgncaggctgctggtacctgcgtccgcccggngagcaggacaggctgnttgggtntgtgacctccaggcaggacggccatcctctccagaatgaagatcttcttgccagtgctgctggctgcccttctgggtgtggagcgagccagctcgctgatgtgcttctcctgcttgaaccangaagagcaatctgtactgcctgaagccgaccatctgctccgagcaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccgcgagcgtgtaacgtccgactgancacaggctgtggactctgacacggagtggggccagctgccgcacttctggggtggatgatgtgaccttccttgggggactgcgcgaagggacgagggttaccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtttaggccctgccccaaatccagccagtcctgccccagcccacccccacattggagccctcctgttgctttggtgcctcaaataaatacagatgtcccccaaaaaaaaaaaaacggtacgagggggggtcccgtccccaatttcccct

SEQ ID NO: 532913 - DNA, 1142 bp, Homo sapiens
  misc_feature (32)..(32): n is a, c, g, or t
  misc_feature (61)..(61): n is a, c, g, or t
  misc_feature (77)..(77): n is a, c, g, or t
  misc_feature (84)..(84): n is a, c, g, or t
  misc_feature (206)..(206): n is a, c, g, or t
  misc_feature (672)..(672): n is a, c, g, or t
  misc_feature (681)..(681): n is a, c, g, or t
  misc_feature (684)..(684): n is a, c, g, or t
  misc_feature (691)..(691): n is a, c, g, or t
  misc_feature (693)..(693): n is a, c, g, or t
  misc_feature (699)..(699): n is a, c, g, or t
  misc_feature (710)..(710): n is a, c, g, or t
  misc_feature (729)..(729): n is a, c, g, or t
  misc_feature (736)..(736): n is a, c, g, or t
  misc_feature (745)..(745): n is a, c, g, or t
  misc_feature (765)..(765): n is a, c, g, or t
  misc_feature (784)..(784): n is a, c, g, or t
  misc_feature (802)..(802): n is a, c, g, or t
  misc_feature (819)..(819): n is a, c, g, or t
  misc_feature (908)..(908): n is a, c, g, or t
  misc_feature (922)..(922): n is a, c, g, or t
agcggatagccgcgcgaggtcagggagctcgncaggctgctggtacctgcgtccgcccggngagcaggacaggctgnttgggtntgtgacctccaggcaggacggccatcctctccagaatgaagatcttcttgccagtgctgctggctgcccttctgggtgtggagcgagccagctcgctgatgtgcttctcctgcttgaaccangaagagcaatctgtactgcctgaagccgaccatctgctccgagcaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccgcccgtgcacctccacctgccccngcccgggcntgngccccgngnggggcnggggggcgtgnggtctgggggggggggtgnggcctgngtggggggncgggggggggggcggggggncgcggggggggtgaggggnggacgtgggggccgaggnccaggggcagggggacnggggccccgggggggccggggcgggagggagggggggccggggggggggacggggggggggggggggagggggggggaggggggggggngtggggggcagggnggggggggggggggggccagcagcctggagagcctcagtccctgtagccccctgccctggcacagctgcatgcacttcaagggcagcctttgggggttggggtttctgccacttccgggtttaggccctgccccaaatccagccagtcctgccccagcccacccccacattggagccctcctgttgctttggtgcctcaaataaatacagatgtccccca

SEQ ID NO: 532914 - DNA, 180 bp, Homo sapiens
accctaattactgatactctctctctccttttttaaaagcctaggcattcttgaccagtagtagtggaggcaagaaaatgtttataaacacaattctgaggtcagactctggacgcaagcaaattgtggcacctgtcattaggatacattaggatgtattagccctttactgcatacttg

SEQ ID NO: 532915 - DNA, 135 bp, Homo sapiens
gtcgaataaccacaaaatgcccattaacctttctcatgcttatagactgattacggaatataatagcaagtcaatattaatgaaattagatcttcgacttcacttcgggttaaatttggaggcggtaaaagctta

SEQ ID NO: 532916 - DNA, 143 bp, Homo sapiens
cttccttttggcccagttctgtcccgtgaaattctaagaaggcctcgggagctgcgctgatgtatcctctcctcgtttgttagctcatcatcagaggataagcctacacacttcagagggtgacaggtttctacttggagact

SEQ ID NO: 532917 - DNA, 292 bp, Homo sapiens
  misc_feature (145)..(145): n is a, c, g, or t
  misc_feature (175)..(175): n is a, c, g, or t
tgcgaatatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccanaataataataatgctatacttaaattactngtgaaaacaacacatttaaagatacggcttctggtacagttgtgatgacagtatcgtatgctgtagtggcatctaataaatatatcgcagtggatatcgcactgaggtccttagatc

SEQ ID NO: 532918 - DNA, 551 bp, Homo sapiens
  misc_feature (150)..(150): n is a, c, g, or t
  misc_feature (269)..(269): n is a, c, g, or t
  misc_feature (283)..(283): n is a, c, g, or t
  misc_feature (295)..(295): n is a, c, g, or t
  misc_feature (303)..(303): n is a, c, g, or t
  misc_feature (315)..(315): n is a, c, g, or t
  misc_feature (341)..(342): n is a, c, g, or t
  misc_feature (358)..(358): n is a, c, g, or t
  misc_feature (364)..(364): n is a, c, g, or t
  misc_feature (371)..(372): n is a, c, g, or t
  misc_feature (387)..(387): n is a, c, g, or t
  misc_feature (395)..(395): n is a, c, g, or t
  misc_feature (434)..(434): n is a, c, g, or t
ttcattcgtacgcataagacagcatcgtctttaaaccctgcctgccaatccctgacgcaccgtcgacatgcccagggaatgacaggacgcacctgcaagtccaactacttccttaagatcatacaactattggatgattatccgaaccgncttattgcgggttcatccggtggtgggtccaaacagacgcaatatctccaaaaaaacctcccaaggttgttttttttgcccctttcatgaacaccatgatgcccaaggccatacatggnaacatgggaaacancccggccttcgnccattttntgcctcacaacnggagggattttggccttttcttaccnncaaggccaacccaagnctgctntggccanngaccacccccttttntttccacntttagctgtctcggggtccatacagcccttattgttccnatcatccatctcttactctcacccctcctaacaggcatcttttcttcctttccatcattatattattttatcatccttcctatccttccctagtatttcgctctctctttttatgtc

SEQ ID NO: 532919 - DNA, 118 bp, Homo sapiens
aaattggtagccatggcggcttggcccagttggtttcttgtgcccgcgttttggctacggttttttttggcgactttgccttaagcggtttctccttttgggcaaatttcacgagcta

SEQ ID NO: 532920 - DNA, 1123 bp, Homo sapiens
gatctcgccaacataagggggcaaccgttatgggccgggaaactctgcgtgtatccctctgtgcatgcccagggatgacttgggaaccggagcccagagggggcccacccccccggaggggaaaggtgggccccaaggaaactccggccagggttcccgggcgcgttgcccgttcgcggaaaattcaacagggccaaaagaagtagacgcccccccgaggttggggaatggttggaaataaccgcagacacccccctgggacagacattccccgggagaattaggggattggggggtaattaataggtgcctcaggtctaaggggtgaagacgagtgggaatagaaaccccgaagtggcccgggagtccaggccgtggtcaagccctcaaaacccaagggggccccccgggaagcactggcctgcttgaagccctcgggcttcccctgcagaaaaacttggggggacaggagggagctttgttccccttcacgtgtatgaattctttttcccctcttcccctcgctgcctttcgcttcccccttataggctcttgggaagccccttataaaggttaagtgggaacaaagaacacctcgggggaataaaaaagcttctaattggctcgtctggagaagagaaggtttgaaagtctgtggtgtgtggcaataatgcaaaagcaaagtgttgttgtgttgtgtggtggtgcctcaaatttggcaagaaattcttggctaaccacgttaagggtgtgttataagagagcacttctccacactgggcggagaacctggcacatttgttttccacctcgttaaagaggagatgagcaccaccccccctgtacacatgtaaagggagaggaggctatattgaggttaagacacatctttccctaatgggaaattcctcggtttggtttgtgggaaaaggaggggagaatggaataaagtgagttgtttaatctctataatcgtcacaacaccacgctgtttttccacctgaaatttgtgctatttgcaataacacatgtatgccactcttttttttcacctgcacagcagtgtttatcagtagttccaaatgatttatttgctcctggggagtaaaaccttttttattta

SEQ ID NO: 532921 - DNA, 582 bp, Homo sapiens
  misc_feature (248)..(248): n is a, c, g, or t
  misc_feature (289)..(289): n is a, c, g, or t
  misc_feature (374)..(374): n is a, c, g, or t
  misc_feature (383)..(383): n is a, c, g, or t
  misc_feature (390)..(390): n is a, c, g, or t
  misc_feature (393)..(393): n is a, c, g, or t
  misc_feature (398)..(398): n is a, c, g, or t
  misc_feature (400)..(400): n is a, c, g, or t
  misc_feature (410)..(410): n is a, c, g, or t
  misc_feature (417)..(418): n is a, c, g, or t
  misc_feature (430)..(430): n is a, c, g, or t
  misc_feature (450)..(450): n is a, c, g, or t
  misc_feature (462)..(462): n is a, c, g, or t
  misc_feature (465)..(465): n is a, c, g, or t
  misc_feature (479)..(479): n is a, c, g, or t
  misc_feature (513)..(513): n is a, c, g, or t
  misc_feature (538)..(538): n is a, c, g, or t
acctggtgttcctggccttgagcagcatcattggcatctgtgacctgctgaggtagcactgggttgccaacaacctttttggcctggccttctcccttgatggagtagaggtcctgcatctcaacaatgtcagctctgtctccatcctgctgggcggactcttcatctacgatgtcttctgggtattggcaccaatgtgatggtgacagtggccaagtccttcgaggcaccaataaaatggtgtttcnccaggatctgctggagaaaggcctcgaagcaaacaacttgncatgctgggacttggagatgtcgtcattccagggatcttcagtgccttgctgctgcgctgtgacatcagcttgaagaagaatacncacacctanttctacnccnagctntncagcctacancttcggnnctgggcctttcnatcttcatcatgccatcttnaagcatgctcanccngccctcctataccnggtccccgcctgcatcggttttcctgtccgtggnggcgtggcaagggagaagtgacagngatgttcagttatgaggagtcaaatcctaaggatccagcggcag

SEQ ID NO: 532922 - DNA, 1291 bp, Homo sapiens
tcgaacccacgcgtccgggcttggtgcttcctgttcgcagcgtgcgcgcagctgagagaagcatggtataaactgggtccaatcaggtgacaaacgacattgaggcccagaatagctaataaccgagacacctggaacgatggacccagcggtactattcagccaacaaaaacattatctgtagaaacttgtgacacaacgtggtcatttatcaaaaagagctgcccctgtacgcacgaacaagtatcgtcgctgacttcctgatggctccaggagcaggacactcgtcctgctattcctgatccagggcccccatttggcggaactacttgtccctgtagccatataggatgtctggaccgacctcactgtcgttctctcagcaacacttccctgaggcataacaccagccgctgacccgactgctcactactgcgtagcgccgactactacacggactggccttgcacccaggaaactcctggcacggcgagctaatcgaccgtaacgcaccgaacaccctgggaccacgccaccaacagccgcaagcaccccccttcaacgcaccactcacgcccttagccatacttgcctactcactggcgcgcacacaacgggccactcactgcgacagccgacatgtcccagaacagagaacgtggctactgacccgttctccagctaatctaccattcactcctgcctactaatgactgacccacctcactgacacacctccaggcacgagcagacacgcgcagaacctaacacacccgccgcacactcaaagctagctccaacgacacacacacgcggcgcctaatacccgagaaggccaattcccaaaggccacgccctgaactactgaacacagcccagccaacacctggagaaacccgctcaccagtgcaatgctccgcgccccggcgcccccagccctccactggtagaccgccaacccggcgtagccccccaaagacaacctccggaaccctccagcccaccgcccccgcacaaacacacgcacaactacagaccgcgcgcggcacacgcccccaccccaacgccgtatcaccaacctcacgggcaacacgcacaaaaggcgacacccccacgggaccccccccccaaccaagccaccctccgcaccccactcccacacgacagcgctcaagcaccgaacaccgcccagccacaccaccaaccgcaagacaaaagaccccccccgcaaactaccgccaccccctcacccacgccgtcccacacacacccgacccacgacccccacacc

SEQ ID NO: 532923 - DNA, 1115 bp, Homo sapiens
catcgggattgtccgagtttaattccggcgtgcgcagggtaagctatctgttcgagcgttgactggcccaagtaagtcgctctggtgttgcaggatagttaggcgattgttggcgctgatatgagctgtggccgatattatccatggatggacgtagttgccataccaggcctgatgcacattgcgtacactatttgatgcaagtatgcgactcgagactgtccctgaagtagagatatgcacctgtgaactatcagcagctgtggatcaagcctctgacgccattgtctcagatataatcacctggttccattttggagcagggaattcaacaagtcattcgatcgtgggtgactggggtatcccgcagaaccgagggcgtgtacaacaggcaagcttgctgacgactacatcaccagtgctagtggaagtgtccatctagccatggggactgcgaccgacgttcattgaataggacccgcacttatgttggacatctttcgtaaggcagaagcgcattcgactgatccaatgccgtgttgggaaacactagctagccaatttccctttcttttacgacaattttagaaggttgcgggcatagagacttgagtagtggcaaccacaatatttgttctatgccttgacaacaattcccgcctgaatacatttagaccatgccaagttggttactatacctaatttttcatagcctcatggtgtcatgactaacattggaaagagaaagcgaatgctagagagtattcagagcgtgtaggcccctttggtagaggttgaactttgcctgtccgaagcgcacgctgcaaagcaataaaatgcgagcagtccatgtctgttttcgagttagtgtacacctaggtggaggcaagtacagaggagtgatataacactagaagctgtgtcttgcctagagattgtacacgctacgcaagtggtccaaggcgaaatgacagccgtgcgctttcgggagatatccagaacgagagaagtaccggcagtaaagtattgcccaaagcccaaggagtttggtggaagaccccttcggagactacggctgcataagctaccattcgccaggaatgtcttccccgtct

SEQ ID NO: 532924 - DNA, 1571 bp, Homo sapiens
cacaggtgtcgagaacaactacccctaaaaggccaaaaggggaaaggaaatagactcatactctaacatcgtgcgtcatcggcacgacgatcagacatctcgagtggaagatccacacacatactctgggccgagtcctgcactctatcaagaatgccggatggtcatcgcacagagaagacaccgatgggacaagaagtgtgcagcaaggaagagactgtatgtagcatgtggagaacgggcatccatatgcataggttactgaccgtaggagatgcctttgcgcagtgatagaccgtcgacagaggactagcacggcgctacgtagaaccagtcgggctaattacgagccgactttagaactaaatccttcgcgtaatgactgggggaaacagttctatgggacggacccgaaggcacatggtaaccataaatggctcggatcctccactgcccattgtggcattaggctcacacgcacgtagtgacaaaccgatgacaggcactatatgttcagtcccacaagcacacaccaatcaggagtatacacgcaaggggggcacccaatacctcacaaggatgccatcgcaagcattagccaggctgttacgtccgcatgaggaaataagaggctaacgcataaggcctatgcggtaagattaaaggggataaggacgactctagagggaaaagacacagcggtggcgttacattgtcattccaccgaatagggcaaacgtaggtggcgccgcaggccatccgcgcccggggatgggaacggacccacttagacaccaaccttatataccattaggtggggcgtatagacacacaaccaacactatagggcgacgatctcggccttggtgccacatacactcctaggaagcccgttaaccacatcattaggttacccggcgactatgatatatacacagcacgagcaggcgacacagatgggtgatcagctctcccaccacaaccaatgagtaaaggacaaccgaaatacccgccatatataaacccaaaggacgagcgaaatgcgaatacacgggacagcaccggtcacgtacggaaacgacggaacaaaaacaaatatagggagggacgaaaacaggacgcgacaaggcactccgacggacccggagccgatgataccaagcgaaggagtggtacacgacgagcaacacgaaacaaggtacgtgcgaacaagactagacgccgaagatgaccagccacccagggacggcaaaaccaacgacacaaaagcgacacaccatataacaggccatcggacccagccgacaaaacaaagagacctatcgggggcgcaataagaagaaaacagagtaggggaaaggagaccgacaaaacacaaagatgcggcccatagagaacaagaccccccaacaggaaggcacgagagagcaccaatgagccacagactgagacgatgagacaaaacgggagcgacacttggcgaacaaacaagaatacgagcccccacgaaagaggcggaaatcagggacaaaatgctcccaagacaaagtgcgaccgaaccgcgcaccagc

SEQ ID NO: 532925 - DNA, 140 bp, Homo sapiens
ggacagcacgcgcttacaactccgatgaccaaactcatggacaccgatgcttgttgtgaccagaccagcaggagatgaaccttccagaagtgggcagctgtggtggtgccttctggagagagagcagaggattcacatgt

SEQ ID NO: 532926 - DNA, 453 bp, Homo sapiens
  misc_feature (404)..(404): n is a, c, g, or t
  misc_feature (410)..(410): n is a, c, g, or t
tccacattttttgcttgtggaaagactgttttcatatgttctacttggataaagaatttaaatggaattacgtataaattaatataaaatgattacctctggtgttgacaggttgaacttgcactcttaaggaacagccataaccctccgaatgattgcattaatttctgaccgccctcagcccgttggaagcttggtttagaggacttgttgggctcattttggttttattgaaatgccatctaaatatgttagctgtagataggaggtgcttctggtgaactgaaagtgtctgactccgtgaggaacatggtaggttcctcacttatcactgtagatgattctatatggacacaacagtaagaagaatggggcctcgtcctgtcgacttgaatattatcccnatgtantgcatgagaagggtctccctcattccatcagagtaatacactt

SEQ ID NO: 532927 - DNA, 185 bp, Homo sapiens
tcttaaaggagtaaattctttttaactgatacgtgaggacagggtgtggaggaaacatattacttacctcatatctaaatgtgaaatatctgcaactccgtacttgataggattatgatattacaggagctggtatgtgatagcattctttcttattttattaaccccgcacctggtacggcggg

SEQ ID NO: 532928 - DNA, 164 bp, Homo sapiens
tcgcccatataccccctaggctgggaagggtagggggctaagggtagaagacagattggtcaatgggtgtaaaatacagttagaggccgggcgcagtggctcatgcctgtaatcccagcatgggaggctgaggtgggcggatcacgaggtcaggagttcgagac

SEQ ID NO: 532929 - DNA, 689 bp, Homo sapiens
tagtcatcaaatttctcttcagacatcaactgaaataatcatatggtttttatccttccttctattgacatgatgtatcacactagattggtttgcatatgtagaatcacccttttattgcagggataaatcccacttggtcatgttgaatgattgttctaatgtattattgaattcattttgctagtattttgttgaagatttattcatcaataatcaatattaaacagagaaactggtctatagttttcttttttgatgtgtctttgtctggttttggtttcagggtaataccgccttcatagaatgagtctggaagtatttcatcctctatttttcagaatagcttgagtaggattggtattaattcttctttaaatgtttggtggaattcagtagtgaagccagtgggctgcaggcttttaatcactgagagaatttattactacttcagtctcattacttcgtattgatctgtacaggtttttgaattattctgggttcatcttggtaggttgtacatgtctggaatgttctatttttctggatttccacttattggcattattgtctagtaacatatgatcttgattccgatatcgtgaagttctttaatacagatatataaatatcctttgaccggtaggtgcattgtacttcaaaactgtatgctatgtcataaaatgggg

SEQ ID NO: 532930 - DNA, 432 bp, Homo sapiens
  misc_feature (332)..(332): n is a, c, g, or t
  misc_feature (422)..(422): n is a, c, g, or t
  misc_feature (427)..(427): n is a, c, g, or t
  misc_feature (429)..(429): n is a, c, g, or t
  misc_feature (432)..(432): n is a, c, g, or t
ttctaatcatcttcttactcttacttctcctcaatatccttcactacatttcttaattccacctttttattcctctccttcttcttactcctcatacccttcctacattacattatacttactcaccttttatattttcattttttttctctcttttcaacacttctttccataataactttatattacaatttctaaattttcccccttaacctatattacaccaattcttattcaccctttctcaataatacaatataaattcttctttttcttaatcaaataccctttataattaaacttcattttccattactatctttctcttattnttttcttatccgggcaagaggactttcttttttaacataacatccactacattattccttgttgtcttgtataatcaaaaaaataattcntcacntnccn

SEQ ID NO: 532931 - DNA, 652 bp, Homo sapiens
attagatgtattttatattgaagtggttacttattcttgcttctgagatccttggaaaattaaaggtggctgtggattggtgagaaaggtcatactggggatgagctatagcatcaacaacttttgaaatcatttccttaatccttgcagaattatcactgagtactgctgctcatgtgatagtgatacgacttagaggaaaagagggcgaaatggagagcatgatttattgtccaaaataatttttcttttcacttatgtaaattctaaagtaatttataaagctattccaaattatagtatatggtttttacattgaaatatactaaagtagacttaactaaatagagatatgtaccatgtttaaggaataaggagactattgtaaaaatgtcacttcttttcaaattgacctatagattgaagacaatttgaattaaaattctgaaagccttgttttggaagattgggggatcttgataagtttattctgaaatgtgtatgaaaaagtataatgaacaagaataactaaaatacttaagaataagaataaatgtatgtgtatgtacttgatttatgtggagctggcatttcagtggggaaaaagatgaacttcttaaaaaatagtgacgggaataatttgttagccatt

SEQ ID NO: 532932 - DNA, 253 bp, Homo sapiens
taatcgagctcggcacctattagactttcttcagtccaggagcttcgagaccaggttgggctaacatggtgaagcccatctctactaaaaatgcaaaaattggttgggcatggtggcgggtgcctgtggttcctggccgcttgggaggctgaggcaggagaatcctttgaagacgggagttggaggttgcagtgagccgggatggcgccactgtattccagctgtgggagacacagctgagactctagtctgc

SEQ ID NO: 532933 - DNA, 102 bp, Homo sapiens
tatttctgtgccagcagccacttggcccagggggcttatcctggaaacaccatatattttggagagggaacttggctcactgttgtagaggacctgaacaag

SEQ ID NO: 532934 - DNA, 116 bp, Homo sapiens
gcggccgcctactactactactgctcgaattcaagcttctaacgatgtacggggacatgatcccaccactgcactccagcctgggcaacatagcgagaccccatcactgcaaaaaa

SEQ ID NO: 532935 - DNA, 1171 bp, Homo sapiens
gtgaggcattctggcgcggagcggaacggcgcgtcggacgcattacgcgggtcggccgcggacgcgtatgtgcagctctggcttacccccggtctacccctcctagaggcgaggacagagagaagctactatactgccaacggtcacgaaacagaacaccaagggggaaaagaaacgtggttgagacaagcaaagaaaaaaacaaacaaagtacaaccacatcggggtattaggcgactaaacaaaaatattaaaaaagtgggaacaagacacaaaaacagaagaacggtggctaccacgtcacacgaagcccctcaccccaagcaccaacaagcctacagaacactggcatgaaacgaaaccaacaacaaaatacacacacaaacagccacccacgcgagggcgacgaaagcgagcagcaaacacacgaagaagagagcaacaagacaaaaggagcaagaggacacaacagcacagaaagccagagaggacaacaaaacgagcgcaccaccacacagagccatcccaacatcaccccacacgcgagaacggccgcgcaccacacacagaggaacgcgaacaacaagcaacacacacaattacgtggatcaccggacgacctcgcgcgcagcacacgcacaacaacaaaaacgacagcgctggaccacgcacttccggtagacaaacacaccacacaggacgccctcaacaccaggatgggcaaacaaggaacagagactacgcggcagagagcaaacaagacaaacacaacaacagccaataggaacacaggcagcaaaacaactaatgcatcaacgagtagcacacacagagagagccgcacacaccacacgacagaacaaacacagtaggagcacaccccctctcggaacaagaacgcacactcgacaaacaaacaaagtcagcaaaacgatacaacgtagatgacaaaccgacggcgcactacttgctgtgtcgtcctgtctccctgtacaacgaagcaacacgacaagacagaccaacaagaactacaacacacacacgaaccaagtacgtagaaccgaacagaaagaaacaagaactgacagcaaagacaaaacaaagacaagaagcaacaccaataaaccaacacaaacacaccaaaaacaaaagaaacacaagagaaacaaaa

SEQ ID NO: 532936 - DNA, 693 bp, Homo sapiens
  misc_feature (11)..(11): n is a, c, g, or t
  misc_feature (67)..(67): n is a, c, g, or t
  misc_feature (104)..(104): n is a, c, g, or t
  misc_feature (108)..(108): n is a, c, g, or t
  misc_feature (111)..(111): n is a, c, g, or t
  misc_feature (115)..(116): n is a, c, g, or t
  misc_feature (171)..(171): n is a, c, g, or t
  misc_feature (184)..(184): n is a, c, g, or t
  misc_feature (189)..(189): n is a, c, g, or t
  misc_feature (193)..(193): n is a, c, g, or t
  misc_feature (201)..(201): n is a, c, g, or t
  misc_feature (204)..(204): n is a, c, g, or t
  misc_feature (212)..(212): n is a, c, g, or t
  misc_feature (227)..(227): n is a, c, g, or t
  misc_feature (231)..(231): n is a, c, g, or t
  misc_feature (237)..(237): n is a, c, g, or t
  misc_feature (245)..(245): n is a, c, g, or t
  misc_feature (248)..(248): n is a, c, g, or t
  misc_feature (262)..(262): n is a, c, g, or t
  misc_feature (266)..(266): n is a, c, g, or t
  misc_feature (269)..(269): n is a, c, g, or t
  misc_feature (284)..(284): n is a, c, g, or t
  misc_feature (332)..(332): n is a, c, g, or t
  misc_feature (339)..(339): n is a, c, g, or t
  misc_feature (341)..(341): n is a, c, g, or t
  misc_feature (346)..(346): n is a, c, g, or t
  misc_feature (353)..(353): n is a, c, g, or t
  misc_feature (359)..(359): n is a, c, g, or t
  misc_feature (362)..(362): n is a, c, g, or t
  misc_feature (374)..(374): n is a, c, g, or t
  misc_feature (410)..(410): n is a, c, g, or t
  misc_feature (438)..(438): n is a, c, g, or t
  misc_feature (463)..(464): n is a, c, g, or t
  misc_feature (474)..(474): n is a, c, g, or t
  misc_feature (525)..(525): n is a, c, g, or t
  misc_feature (546)..(546): n is a, c, g, or t
  misc_feature (590)..(590): n is a, c, g, or t
  misc_feature (693)..(693): n is a, c, g, or t
acggctcagancgaggcgcacaggctcgcagctccgcggcgcctagcgctccggtccccgccgcgangcgccaccgtccctgtccggcgcctccgcgcgcttcnaaanaanggtnntgggtgggcgctgcggggcgctgctggcgtgtctcctcctagtgcttcccgtctnaaaagaaaaattnttgtnaaanaaaaaagnttnaaaagtantggttaggaagcgtngtgnaaattntttaattnaanaaaaaaaaaagggnaatnttnaaaaaaaataaatanaaaaaatgtgaaataaaaaaaaaacaagggaggtatttgaaaataaancggaaangnattanttttatnaaaaanaantagtttgtcttngctcttttcaaactgggttattcactgctgaacgtnagtaaaataatgcttataatgacctaanaagctgtgtcaatgcaattccagannagtgtagtcntctgccatgcaatgaaaatggatatatgagctgaaaagatggaaaagattnttttacttgcacttgtaaacnaggttggcaaggagaaaagtgtgaatttgacataaatgaatgcnaagatccctcaaatataaatggaggttgcagtcaaatttgtgataatacacctggaagttaccactgttcctgtaaaaatggttttgttatgctttcaaatan

SEQ ID NO: 532937 - DNA, 1626 bp, Homo sapiens
  misc_feature (195)..(195): n is a, c, g, or t
gcaagtgatgaagtattaaatctcatatacctacccacttacctctccttcacccaaacgtccgcataataatcacccgttagtagagcaaaccacggcaggaaccgacacaagtgcaagccgaagacatcatgattcgccttacattctctactatgccccccacatcagatccctagtgtccctatcacgtcncgtcgaggatatatgaatcactatctaattatacacccctcatagtctgcaatcctccacactccaacatacttcctcatctacaacatagcccgcaactgaatttaactccaacaccaataccatagtagactaaactacactatctaatagctctaccataagactataatagcattatgcccatacaactaagctaactagatggcactgcatatctggatacttcttattactaagatacttccctctaaaatgcactccattgtattctagacgcaccacaccatatacgcctgcgcgtcgcagaattcatgctcatacgctcgtacacgctacattattattcagcacaaaacccaacgcgcaaggctatattcgtactaatagactcatacgcccatttcggaaccatttacctccctctaatcgaacgcccggggaccgcaagattgaactataatagggcgtatctctccgtctcctatagggattcttaaaacactggactcatgaggcacttaaactgtacctatagcacaagcaatcggacagcattgccttatacaagaccccatattaatggcacccatataacatatcgtgtttatctataattcgcggagaaaaccctcattctaagacctctacggtgcactattctagagccccaattctaggcacccttatggcggaccgcggaacttgccctctaaatcccaggaaatacacccactttgacctggccatggccccaggcgttaccaatcaagtagctaccctctaaatattttgcggaaatgcaagccggaacccctctaagcctacactatctcataataccatattttaactcccgtctctcccttacataacattctttatatttcaactcctatccagcaaaatttccctacaagtttccgtaacttcggataataattccgctaatgaaacaattcggggctggttccagcccttaaaatccccacaccgcctaaactgtagctttcaacccacgcattcgtaagtaaaaagccatctaaaccctttgcacagaccataggccgtttaacccccccaacaaaaataaaggcgcgggggggggacgaaacaacatctggccgcctgaagagggggccccggacctccccggggtaaaccaagtccgtcctgcccaacaatgggggcctcaaagatagcagggcaaaaaccgcgtaggccccgtgcaggcgattttcacccacacccaaggggggacaaacgcccacccggggaactctgtgaaggaccctcatacggggagaacccaccgtgtgcacaaccaatcccgatagatgcgcatgcgtactcacactaacggctggtggtctcaacacaactatgcgagaacatcagccgtacagctgactccatcgcactactgtcgcg

SEQ ID NO: 532938 - DNA, 274 bp, Homo sapiens
gtctccgtgtgttttgtggtaaggtccatgaaaccagcagcctgtaatgtcttgtgctgctgagcggggtagaggtgcagcgagactggggcttgggtgccatcgtgcccactccgcattttctcaagtcctgtcttcaggagaagagtcattttcttcattcctgctacctctgctggttttaacacgaaccccggggttggcaagggaaccttgacgctaggacttctgagtatcgaccgtgtgcacaatggacctttcgtgcaattgctgc

SEQ ID NO: 532939 - DNA, 107 bp, Homo sapiens
tgctgggagtaaggaggtcttttttaagcagctctaccagtgaggttgcagtgtagtgctgaaaatagttaaggccaggcgcagtggtcatgcttataatcccagca

SEQ ID NO: 532940 - DNA, 331 bp, Homo sapiens
attcgcggccgcgtcgaccaaacttttatttatgtttcaaaaaatttttgtttttagcttttgtgggtacacagtaggtgtatatatttatgggttacaggagctattttgatacaggcatgcagtgcatatactaaccacatctgggtaaatggggtatccattacctcaagcatttgtgctttgtgttatagacaacccagttatgctcttttgttattttaaaatgttcatttaaattatttttgactatagtcaccctgatgtgctgccaaatgctaggtcatattcattctttctatttttttctacccattaacccttcccaccc

SEQ ID NO: 532941 - DNA, 237 bp, Homo sapiens
tcagacagcggacccccagctgcacaggtgggatgagcaaacagtcccgagcgtactccagcaggaggaactctctcatgttggaaccgaaatagaggttgtgtgactggaggagcttgcagtggtccggcagctctgtcaggtggcgcacaaaccaccagttgctcagggcgatgctgcactctttgattacttgatggatgtcaaactcaaaggctagcaacaagatgttgtcca

SEQ ID NO: 532942 - DNA, 186 bp, Homo sapiens
cggtggagcccctgacctgggcctgtacgaccggacggcacccgtgtcaccactccggtgctccaacctgtgtgccagcatgtgcagtgctgtgctgggcatggtcacggtgtgcatggagtgccctgtgcttgtggatgcccagtgaatacgaggtctccagcaagcctcgatgtgcatcagcct

SEQ ID NO: 532943 - DNA, 122 bp, Homo sapiens
tctagaggacctggtgtcatcacccagtatcacctggtacacgcccggatcgtcatgaaacagctggttcatctcctcccttctgacgcccaggacgctccccggctcgtccatccaggatg

SEQ ID NO: 532944 - DNA, 763 bp, Homo sapiens
gacttggacctgaaccttgctcccgagagggagtcctcgcggtacgtcagcccaagattccagaatgactactatcttgacttacccctttaaaaatcttcccactgcatcagatatgggccctcagattttccatagagacctctgagctgttcctcccagctacgagctgccccagtctgtccgagaccaaaacgaagaatgacgttagccaaacccaatataagggaatgtctgtgcgtggtggatggtgttcgcactccatttttgcggtctggcacttcatataaagtacctgtagtgcctacatgatttggtctagagcagcgctatacgggtttgtggcgatcggaccagtgtccctaaggaagtagtccgattaatatcatctttggtacagtcattcaggaagtgaaaagaagcaatgtggctagagaggctgcccttggaagctggcttctctgacaagactcctgctcacactgtcaccagtgggctggtattctcctgccaaccaaggccatgaccaccagggtgttggcttgctgtgcttctgggcagtgtgatgtgattcgtgggccagctggtgttgagttgatcgttccgatgtccctatttcgtcactccgggacctgggaaactgtgcgtgatctcattgggccatctatggggcagcgatgctttatctctattccgattaatttctacccttactcctgcggtccgggttctcccccgacctggctctcaacgagggtacgtt

SEQ ID NO: 532945 - DNA, 359 bp, Homo sapiens
tttggggttgggtgagaaggaaattactattagtttctgttttgtatgtgtggagtattaggttatatactctgtattcgatatccaccccttctttgtgtactttagttttggagtttggaactttactttggtaggaaagcattgtagtatgtggggaagcaagatgttctggaatgaagtatgtagctttatggggggaggggggagggctgcttgaaaaccatccatttgtggaaatgatagtggggaaggtttttatgtgcctttttgtttttgtaaaaaaggaacacccggaaagactgaaagaatacattttatatttggatttttacaaataaagatggctattataatgg

SEQ ID NO: 532946 - DNA, 534 bp, Homo sapiens
  misc_feature (103)..(103): n is a, c, g, or t
ttccggccgatctatttttatttgaaaccaagttctgtgaaagagcacactcaacagtcatatatcttctcttcacggaagggggggagacagggttcttcangtcagtgcagaggcgacgatacatgcattgaatagcagggctcggcatgaatttcctcataagcattcccaatatgagcctggacaatcttcttcagataagcaagtgagatcctctgggggggggtcatcaatatactcaaatgggtctggggggtctggctcttgttcctcctcctcaatttttgggccatgtgctggcacaggtgccaccagctcctcaatgtcttcactggtatccttcagagtgatgatgcctccaatagagagtggggttgaaggctggtatctacagggctccggcatgggtaggaccttaagctgggcaggcataactcgggctgggttatccaataactgggaatttggctcaggggtctttttcttctctggtgtctcctttttctctggctgctcctggagcgggggggg

SEQ ID NO: 532947 - DNA, 383 bp, Homo sapiens
tacatctttggtgttgtggtaggccgcggtgtagctgaggtgagtgggccaggccctgagagctatgttctgtcaggggtgtggcgtggctttggcttcgggccaggactggagaggtgtaatgctggccatgtccttggggaagaggtctttccaagagctctttaacacagagtccatgttctgtgccacagccttatcacctccacgtgttgctctggggaggcctggaaccacatttttcgtcgtctgtgtccagagggtcccatggccctcagggtgaggtgcatgggtctggccggtggaccagctccgattccaggaggccctcgggactgctcccagactcccctgcagtctgcagccctacccataagcccctg

SEQ ID NO: 532948 - DNA, 819 bp, Homo sapiens
ctacatcatcgctggtggtctgtgtggcttcggcctggtgttggctgcagtggctgatacatgcgtgggtgtgcagaagctcgtgttgacttctcgctccgggatccggacaggctaccaggccaatgcagtgtccgccgtgtgtgatgtgcagccatgtggctgtacacgtgtgcatgtgtgtccaccaagcaacactcagctcacatgtgagtgtgtgtgccctgtgtgtgcctcatttgcctgagtgcggcgcatgcttgtgtgccctgtgtgtgcgtgctgtcttcatacctgtgcctgtggtcttgagaggatggctttgcttggatgaaccaagaccccatgagttcttccaaggactgtctgcaaggcccaagtacaagctggcacccctgaaccttggacagggtagaccctgagaggctgttgcccttgacgcttggacctaccttttgttggtctatctccatctgatgatgcttgctgtggctgttggcaactgctgtggacatgacgcaacatacgtgcctttgccaaattcctgctcatgtgagcgtatcatgtgaggaaactgcctgtgcacgacaggcctccacagtgccttgtgccgtgccatgtggggctgccaatctggcgacgttggtgcatttatggtgcgagaccgatgagcaaccaacgacacgaatagtcagattggcacggctggcccagctgcattggctgttcctgacctggagagtgcttggaacctctttccttgacatcagacccacaacatgtgtcctagaggcaggcttatgtgacttgagctgacga

SEQ ID NO: 532949 - DNA, 306 bp, Homo sapiens
  misc_feature (24)..(24): n is a, c, g, or t
  misc_feature (95)..(95): n is a, c, g, or t
tgctgcatgtgcacgtgcagattntgtgcccacagtatctcagctatcggtcttgctctcgtgccagtgacctgctcagcctgcgtgtgacctgnggctggcctcctgtacctcctttgaggttggacagtgtttggtctgtcaactggaaggagctggagggactccacaggagggaggggtctgccctcctggttccagtgtgcttgcttgtcctggctttcgtggtgtgtgcctgcccagcctcatggtgggggcgggggctctcagtgacagtctgcagggagtttagcaacacccaggttc

SEQ ID NO: 532950 - DNA, 112 bp, Homo sapiens
gaaaagacacgggatcaaataaccattgattaaattaagtatgtgcaatgcatgtatgcaaagagggtagaatgggtataaagtgttaagtaaaaagggacctgtataatta

SEQ ID NO: 532951 - DNA, 263 bp, Homo sapiens
gaaacgggcttggagctggccccataagggctggcggcttcctccgacgccgcccctccccccagctttttgactgcagtggggcggggggcccccacccttggagatttttccggaggggagaggattttttaaggggccagagaatcccttttttaccccttaacttgagctgctggaggggccctgctggccaacggagacctatttttggacaaagaacccctgacctggggggtaataaaaatgacctgggcccctga

SEQ ID NO: 532952 - DNA, 368 bp, Homo sapiens
cactggaggaggccttgctgttaggaggaactgtccagaaagagcagatggagactagggaattgcaacggttgacttttggcagaaatgccgatcgaagtatagagagattttcacatagtcctaatacgtacgaatagcttttctttgacttgcaaaagtggaagcgataattggagtgaaagaaatgtatgtgaacaagtgactaatgaagacaaatcagttggttggccagctgttagagaccaaaagcgaggagtattttggcagttcattgtaatgtagccttagcccatgattttacaaataaagaaaagtactgagagacagatagtaaaataaaacaaaccagcagttcagatagaaaa

SEQ ID NO: 532953 - DNA, 213 bp, Homo sapiens
agtaccatatttacaccactgctcttcagtctggacaacacagtgagaacccccatctcaaaaaaaaacgcaaccatgtctatggggagtttagaaagctcgcatgcatgccctagataacatgcatactcagaaacttcctgagaggactaagctttcaccttgagctagtttataagtgcaatgcaagtctgcctaagggctgtaggagta

SEQ ID NO: 532954 - DNA, 300 bp, Homo sapiens
accagatctggagatgaggggcgatctcggtcactgaactccgactcccgggttcacgccattcccctgcctcagcctcccgagtaactggaactacaggcgcccgccaccacgcccggctaattttttgtattatttagtagagacggggtttcacctgtgtgttagccaggctggtctcgatctcctgacctcgtgatccgcccgcctcggcctcccaaagtgctgggattacaggcctgagccaccgcgcccggccagctctttcattttcaataaaacaagaaaaccattggtcca

SEQ ID NO: 532955 - DNA, 196 bp, Homo sapiens
ccaaggattagtcgtcttcttcggtgacactcccgagacccaaccctgcacgccagctcagtgattactcggagctacagagggtgaaacaggagcttctgggagaagtgaagaaggaattgcagaaagtgaaagaggaaatcattgaagccttcgtccagagagctgaggaagcggggttctccctgtaccacag

SEQ ID NO: 532956 - DNA, 852 bp, Homo sapiens
gcaagcagatcgccgcgaaagcagtacaagggcactcgtggactgcattgtccgatccccaaggatcagggcgtgctgtccttctggaggggcaaccttgcaaaagtcattcgctacttcccctatcaagccctcaattcgccttcaaggataagtacaagcagatcttcctggggggctggtggacaagcaccacggcagttcttggaggtacttggcgggcaacctggcctccgaaggtgcggcggacggatctcccctctgttcgtgtcaccctgcgtgtaatttcgacaagaaacccggccttgagcagcgggcaggtgagccaaagtaagtgcacaagtaagcgcgatgtgcaggatgccgtgtgacaactgtcttgggtgaaacattcaccaaggtccggaaggagcattccggggagcatgataccaacgggcattccaggaggtctcccgtcgcagcgacaatcatcacatctaccgagcagcacgcactacatcccgagaggtgacaccgacacaggagcacaagggcccaatgctcacccggaccccaaacgagaccaaaaggccacaacccgggcggctgacgcctggagaacagacccggcaaacaaccggttgacaggactccgaggacaccgaccgtcggaaagaacaccaacgcccttacggaacacgcgagtggcgccgccacccactatgaacaatcgccacaccacaggcgagccaaagcgcagcagagacacaccatgacacgcgcagcacccagacaactgacagacgagaaccacccccaccacaacgacagggcgacaccgccactccccaagcgcgctgcggaccccaa

SEQ ID NO: 532957 - DNA, 1022 bp, Homo sapiens
  misc_feature (123)..(123): n is a, c, g, or t
  misc_feature (133)..(133): n is a, c, g, or t
  misc_feature (173)..(173): n is a, c, g, or t
  misc_feature (198)..(198): n is a, c, g, or t
  misc_feature (257)..(257): n is a, c, g, or t
  misc_feature (262)..(262): n is a, c, g, or t
  misc_feature (502)..(502): n is a, c, g, or t
  misc_feature (507)..(508): n is a, c, g, or t
  misc_feature (512)..(512): n is a, c, g, or t
  misc_feature (521)..(521): n is a, c, g, or t
  misc_feature (633)..(633): n is a, c, g, or t
  misc_feature (653)..(653): n is a, c, g, or t
  misc_feature (655)..(655): n is a, c, g, or t
  misc_feature (658)..(658): n is a, c, g, or t
  misc_feature (669)..(669): n is a, c, g, or t
  misc_feature (676)..(676): n is a, c, g, or t
  misc_feature (684)..(684): n is a, c, g, or t
  misc_feature (689)..(689): n is a, c, g, or t
  misc_feature (696)..(696): n is a, c, g, or t
  misc_feature (700)..(700): n is a, c, g, or t
  misc_feature (702)..(702): n is a, c, g, or t
  misc_feature (706)..(707): n is a, c, g, or t
  misc_feature (710)..(710): n is a, c, g, or t
  misc_feature (719)..(719): n is a, c, g, or t
gcaggatggagaggagacgcatcacctccgctgctcgccgctcctacgtctcctcaggggagatgatggtggggggcctggctcctggccgccgatctgtggtcctggcaccctgacctctcncctgggctcngaatgccaccctccacatcccgaccctgggtggatttctnccctggcatggtggcactcaatgcntggcttcaagtgagaccctgggccagtgagcgggcagagatgatggagctcaatgaccngcttntgccagctacatcgagaaggttcgcttcctggaacagcaaaacaaggctgctggctgctgagctgaaccagctgcgggccaaggagcccacacaagctggcagacgtctaccaggcatgagctgcgagagctgcggctgcggcatcgatcaaactcaccggcaacagcgcccggctggaggttgagagggacaatctggcacaggacctggacactgtgaggcagaagctccaggatganaccannctgnggctggaanccgagaacaacctggctgcctatagacaggaagcagatgcagccaccctggcccgctggatctggagaggacgatcgagtcgctggaggaggagatccggttcttgaggaangatccagaggaggaggacgngnacnccaggagcagntggccgnaagcaggncaagntggagcntgangnggcnnagncagaacccnccgaggccctggaagagaacgagagcagaagaggcactggcgcgcagaacaagcatgaggcgaaaaggggacgagccaaggagacgaacctgcagaacgaggctgccgaacacggcacgagccgaccagaacccagaccccaggctacggcgcaagaacaatgaccgggaccgagacaccaggcaacagccccggaagacaccaaagaaggaggcaagaggcgcaccgagcagacagggagagcagacacaacaaggccgcaacacaccgaagagaactaaggaacaggagccgaggacgaaa

SEQ ID NO: 532958 - DNA, 240 bp, Homo sapiens
  misc_feature (239)..(239): n is a, c, g, or t
tgcagggaaggtcattgagccagaagtggaggctgctgtgagtctatacaccactgcactccagcctgggcaatagagcaagacccccttctccgaaaaaagacagagagagagagaaagagaaacctgaaggagatccgagaacactcaccgtgtatacctgagggaagagaaatccctgaacgaaggaagacgcagtgcaaacggcctgaggctggattgtgctcggggggcggaang

SEQ ID NO: 532959 - DNA, 735 bp, Homo sapiens
catggtggctcacacttgtaaccccaacacttgggaagctgaggtaggaggatgacttgaggtaaggagttcgaaaccagcctgagcaacatagcaagaccctgtttctacaaactaacaaacaaacaaaaatgaggtgtggtaaggccaggcgtcgtggctcacgcctgtaatcccagcacgttgggaggctgaggcgggtggatcacgaggtcaggagatcaagaccatcctaacaacatggtgaaaccacgtctctactaaaaatacaaaaaaacaagccgggcgtggtggcgggcgcctgtagaccgagcccttagggaggccgacgcaggagaatggcgtgaactcaggaggcggagcttgcagtgagccgagaccgggccactgcactctagcccgggccgacagagcgagactccgtctcaaaaaaaaaaaaacacaacgacgcacaaaaacaaacaatattttggggcgccgactgagccgccgcgagaagagtttctacaaagcacatctgtgtgggagcgcccggcgacccagagagggatacggacaacacgcgggccagaacgggtcgtcgcagaggagacccgtgacaaacgaccagggctgggggtccacccaattatagaagcgccggggggaaccacgaggcgtgtagtaccaacccacaagggaggcccgaggagccaagccgggctatcaagacggagccaagcgagccagaataat

SEQ ID NO: 532960 - DNA, 413 bp, Homo sapiens
  misc_feature (413)..(413): n is a, c, g, or t
gtggtagagaccgttattattagactcaggcatgcacgccggagtggatcgggggctttcgtgatcagaaggaaccggcccgtccatctgagaggcagattgttttcatgctacagaaaattaaccatgcgtggtggtgcttgcatgagccatgtactactcatagcggtgagtgaggagcatgacgtaaaccctggtagttggtactgaacgtgggaatatttagcttgaatcagcacaagaagtgttgtctgtgggtctacctataataggtgatctagctaaaaacaatattactgaaaaagatcgggaaagcagagaatgtggagccgtttcatatagaactaatttcgtgagacataggttctaaatcttgcttagaggcatagttgctacatgccttggagtgaccn

SEQ ID NO: 532961 - DNA, 412 bp, Homo sapiens
  misc_feature (41)..(41): n is a, c, g, or t
  misc_feature (56)..(56): n is a, c, g, or t
  misc_feature (88)..(88): n is a, c, g, or t
  misc_feature (103)..(103): n is a, c, g, or t
  misc_feature (130)..(130): n is a, c, g, or t
  misc_feature (143)..(143): n is a, c, g, or t
  misc_feature (160)..(160): n is a, c, g, or t
  misc_feature (201)..(201): n is a, c, g, or t
  misc_feature (213)..(213): n is a, c, g, or t
  misc_feature (402)..(402): n is a, c, g, or t
tggcccggggagaatgtcaaagccaaaattcaagacaaggngggtatcccccctgnccagcagggtttgatatttgccggcaaacagntggaggatggccgcnctttttcagactacaacatccagaaanagtcccccctgcncctggtgttgggcctgngaggtggcattattgagccttttttccgccaggttgcccanaaaaacaactgngacaaaatgatttgccgcaagtggtatggttgccttcaccctcggggtgtcaactgccgcaaaaaaaagtgtggtcaccccaacaacctgggtcccaaaaaaaaggtcaaataaggttgttttttccttgaagggcagcctcctgcccaggccccgtggccctggagcctcaataaagtgtccctttcnttggctggga

SEQ ID NO: 532962 - DNA, 367 bp, Homo sapiens
accattggttgtcgctgaaagtatttctaagtctttggccaagaagtcagtttcagctaagttagacggcgcttatgtgggtatgcatgatgtcattcctgcatccggtgattttcaattaattacaacggctgatgatgaagcgttggatttgttgcgtcattctgcctcacacttattggcacaagcttaaagcgtttgccaaagtttgctaacatgcactttggcgtggggccatttattgaaaatagtttctactatgatacagataacggtgccggtaaccaagtgacgggtgaagatttcgctgaaatcgagccatgatgcaaagattcccaaggagatttcccaattgtgtcacgcgagt

SEQ ID NO: 532963 - DNA, 182 bp, Homo sapiens
ctaagcgcattattacggcgaacgcaatattcgctcgctttgggctgagccggggggcgggttatggtacactcaccgtcctaatcaacatttgaatatttcttataccatcggagttgcggggccatggctcaactttatttttattactctgcgatgaatgccggcaagtccaccgcgct

SEQ ID NO: 532964 - DNA, 366 bp, Homo sapiens
cctctggagcttcctgttgttcaaactttttccttcctgacatttgtttttacttacaggggttttgctggggacggtagccttaccccaattaactgtgcatattaaatgggagaggagatgcccaaacgcccgatgaaagcaatccagtttcttcttttcccctttttcctatgggcggggaatttgattccaaagttttttttctttaaccaaaaaggaaagaccacggtttgtgtgccctttccgacaaacctgggtttttgggggcctgccttccctccctcctcccccccgggccgggctgtacagagccctgtttcggggggttaggaatggcctgggattgtccattaaccgatgctg

SEQ ID NO: 532965 - DNA, 948 bp, Homo sapiens
tagaaacttcgggtaacttagatgatctggaatacaagttacatgattatgggctacgagaggagttcctcttcccaagagactgcctggcgataggagcatctgctcacttggcttaacttcaagaggaacagatacaggagcaggacttgctctaattaaagaaatattatggaacgaaagatcctgctgccaggctcatgtctgttccagcagcagaacacagtgaccataacagactagggggaaagacccatgaaaaagatgcttttgaacatattgtaacacagtttgcatcagtgcctgtatctgtggctcgagcgatgagctatgacatttataatgcgtgtgatgaaagatatggggtgaagatctaagacattaaatagtatcaagaagtacacaggcaacactaataatcagacctgattctggaaacgcctcttgacactgtgttaaaggttgggagattgtagggtaagaagttatcctgttactgagaacgtcaaagggtaacaagtaggttgccaccttatctgtagagttattcaaggggatggagtaggatattaatacttacaagagatcgtagaagggatgaaagaaagaatgtggagtattgagaatagtgcttcggtatctggtggaggttcgctacagaaagtgacaacgagatctctgaatggttcccttcaagtgtagctatgtgtaactaatgggcctggggattgacccgtcttcaagggacccagttggcgatcccaagaaggggtccaaaagggccgctacctgtccatgagccccggaactcggtccccgccgcagcaacaggaccgtggagaagggggaaactcccagttcacaggggcggacaacggccggaacaaaaaccgaattacagaaaccacgcaaagggcggggagacaaaacacgcgggatagcacagct

SEQ ID NO: 532966 - DNA, 993 bp, Homo sapiens
  misc_feature (301)..(301): n is a, c, g, or t
  misc_feature (419)..(419): n is a, c, g, or t
  misc_feature (442)..(442): n is a, c, g, or t
  misc_feature (674)..(674): n is a, c, g, or t
  misc_feature (751)..(751): n is a, c, g, or t
  misc_feature (767)..(767): n is a, c, g, or t
  misc_feature (773)..(773): n is a, c, g, or t
  misc_feature (777)..(777): n is a, c, g, or t
  misc_feature (781)..(781): n is a, c, g, or t
  misc_feature (791)..(791): n is a, c, g, or t
  misc_feature (794)..(794): n is a, c, g, or t
  misc_feature (802)..(802): n is a, c, g, or t
  misc_feature (809)..(809): n is a, c, g, or t
  misc_feature (880)..(880): n is a, c, g, or t
  misc_feature (948)..(948): n is a, c, g, or t
  misc_feature (953)..(953): n is a, c, g, or t
  misc_feature (955)..(955): n is a, c, g, or t
  misc_feature (957)..(957): n is a, c, g, or t
  misc_feature (970)..(970): n is a, c, g, or t
  misc_feature (972)..(973): n is a, c, g, or t
  misc_feature (984)..(987): n is a, c, g, or t
cgccttctgtgtccgggtggacatgtctctggcaattctagaagaggtaataatgtgggatcctagggtgtcccggccgtgcctcccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgcttggtcgatgccagttgtttgaagagacccagattggaagcgagaggtacaatcttttgactgctgccccangccaagacatgcaccttcattctccgtggcggcaccgagcagtttatggaggagacagagcggtccctgcatgatgccatcatgatcgtcaggagggccatcaagaatgattcagtgntagctggtggcggggccattaanatggaactctccaagtacctgcgggattactcaaggactattccaggaaaacagcagctgttgattggggcttatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctnttcgtgtgggagccagctatggtgcggatcaatgcgctgacagcagcctctgaggctgcagtgcctgatcgtgtctngtagatgaaaccatcnaagaancccnccgnctcgactgtnggnatgctccncacagcnagcaggccggggcctgtggtctgtggccgcccccactgagaggcaccccacccatcacatggctggctggntgctgggtgcacttaccctccttggcttggttacttcattttacaaggaaaggggtagtaattgcccnctctntncntactggaggctantnnaataaaaggtnnnncttcca

SEQ ID NO: 532967 - DNA, 1062 bp, Homo sapiens
tgcttccctcaaatcccgtactccttgacttattcccccaatagaacgcgtgctcccgcggaaggagcgccctggcggagaagactcgaacggtctcccacagccgggtcgttgggggaaagtgcatgaacgaactcttgactgacagaaacggaggggtgtgtccaaagttttgaggacggccgagcggacgcttccaaaacccgtccatcacagtgcctcgcccgcgttcgcgctcaggctagcaacaagatcactcggtcaaacatgtttaccactcttcttccagtgtcctgagtatgcagaaaagggagtagtcatcagagccaactcattcgaccgtcgcaccattgaagccgtggtacagtccaggtgatgagggaggctgaggcgaccgcataggatagggccgagcgtcgctcccgttcatgcaatccatgcaggttgccataggtgggtcaaggcgtgtgacagaacttgattggcgctcacatgtgaatgcacggggatgcaatgggatcgatccaagctcgtgcgacgtctcgacggtcaaacccttgcgaactgcgccacaatgctcagagccctaagcgcacgccaactgaagacctgcgggctgaatgatcagaggcgagtgacatatggcggatgacatcccaagagggcgcctgctaggaaccacgcacttcgcttggcgaatggactcccaggaacagcgtggaggtcacataccaggacaaccatggcttgcaccgtgtaccaggggggagcacactgacgctggaacgcggatcggatccggtcggctcaccatagggcgaagccatcccgtgaatccggcccacagcccagtggacgccaccgaagccacagttgacaacggggaaacgacgatggtcagacaccgatagaaatgacgcgtaagccaaaaactccgttcatctagggaggaggctggggaactaggcagcgagggggcgcccgtagcccaacggccgttgggcccatccgtacgccaggaaaagaggcgaaaccgtcccccagagggagggacacaccact

SEQ ID NO: 532968 - DNA, 197 bp, Homo sapiens
ggcccaccgatcaccagcctgtgtgacagagtgagagcccatctccataagggtctgggggaacagatagggatgaaaactgaagttctggtcctgaatgagatggcatgcagcccaccccaccgacacgtccccacactaagttacaacaacaaagcccttgcacatcaaagtaactacacaacaactgttcacca

SEQ ID NO: 532969 - DNA, 464 bp, Homo sapiens
  misc_feature (35)..(35): n is a, c, g, or t
  misc_feature (49)..(49): n is a, c, g, or t
  misc_feature (67)..(67): n is a, c, g, or t
  misc_feature (118)..(118): n is a, c, g, or t
  misc_feature (385)..(385): n is a, c, g, or t
  misc_feature (405)..(405): n is a, c, g, or t
  misc_feature (415)..(415): n is a, c, g, or t
  misc_feature (430)..(430): n is a, c, g, or t
  misc_feature (441)..(441): n is a, c, g, or t
ggtgcgctcgaggttggccgtggtccgggaagctngaggggccgggcgnaagtgctgcgctcctctntttcttttttggaacaaggacttgctctgtcacccaggctggagtgtaatnatgtgatcatggctcactgcagcctccaactcctgggctcaagcaatcttccttcctcaacatccccagtacctaggactacagacacagcctcactctgtcctccagtctggagtatagtggcacactgcattcttcacctcctgggctcaagtgatcctcctgcctcagtctcctgagcggctgggactgcaggcgcccaccaccatgcccgactaacttttttcgtatttttttagagatggggtttcaacatgttgcccaggntggtctggaactcctggggntcaagcagtncaactttcccttgancttccaaagtntttggggatttacaggcgtgaca

SEQ ID NO: 532970 - DNA, 455 bp, Homo sapiens
gaaaacccgacaaaatcatgggattctgagtaagaccatcaggagcacaagccatacacaatggagctgctttaatctcctacaggttctttgcccatcataactgaacaacatggaaagaccagaacatgaccatctattcacggggtcagataaaaggataacgcctcttatatgagactctcgatagctatatactccaaacagggccatgttttcttttctggagcagctctgggaggctaatttacaggcagaaccattgtggacaatgaaatacagttgataaaataaattttgtttttcaacattggcagctggtaaaggaaggtttacctctcagcctcacactattttcttgggtgctcacagacacagaacaagacaattatacctcttccatgaagatggcttctttccttacgaaaactgtgtagatctcaagaattataagg

SEQ ID NO: 532971 - DNA, 880 bp, Homo sapiens
ttgtggtccccccgccttttggaggcccattttgcccactagtgttctgcgtgcaatgcggggcctctcgccgttggcccctcttccgccgtttctgccggcccggctagtaaccttcgccccgcggtgcctgttgttacccctcctcaaggttcatcggggtgtcacgggttaacacccgcccggagttccgcacagttgcgccgccaatacaggggccgccatgtcttccgcgcccccggtatgggtgccaatcagtcactactggtcatgccccacgggtgtcgagatccaccacgcaatgggggcgcccctgccgtgggtttcacccctgtggacctcagggcggccccccatctccacacatggtgtggcccgcggaccccccgggcaaccttctggaatcctccacggagcgccgcaaaaccaatcccccgcggttcccgtccagccctcacctcgtgcaacgggccgtgaagaggggagccgcccccccagcgacagacctcctcttccgcccccggagagcccccgtgccccccacaaagggggacaccttctgccgcaagaagccggaagtaggcgccaccccaccgctggccggcccgcagcctgaaccccggccccggagacttaacaagacaagaaagatgatccgggtctctccccggcggaaaaaaccgtagaaactactctaaccactgcgccagtggtccccgtcatggcctcgggacccggacagcccccgcgttgctacggcaactcccaggcccaaacaagaccaccaccaggacgcccggccgaaccccaaggacgtcgtggcaacaagaaaacaacacgcccccccggggaatggaccccttgccccaccaaaaagaca

SEQ ID NO: 532972 - DNA, 956 bp, Homo sapiens
  misc_feature (443)..(443): n is a, c, g, or t
  misc_feature (447)..(447): n is a, c, g, or t
  misc_feature (450)..(450): n is a, c, g, or t
tcagctcggtaccctatatgctttggagcaggtagtgttaggtcctcatactcatactcggttttattttttcaaaactgtttggctcctccatgtcctttgcatttccatagacaattgagagcccgggcgtcagtacaggccaaggctgctggaatttatgctgagactgcactaaatctgctggccattatcgcattgagccttctgaccctgtgtctgtaggtggcccagctgtctttgagtttgatattgagtttctctcagcagagccttgtagcttttagtatgtcgatcttacactgtgtttcgttaaatgtattcctaagcacatcatacttttcatgtattatcaacagtattgttttcaaatttcatcttccagttgtttgttggaaataatgcggaaatacttgatttttttgtgcattgaccttgttaantgtntgnattctactcactttttggactattaggcttgtctgcacatgtggtcacgtcatgtgtgagtaaagacagtttttcttctcgcgttctgagccgtgcagctttgttttctggaaggtcgggcataatgcttgttctcttcccggcactgggggaagaggtgtccttaccctgtctaatgttagcttcaggccttttgtaaatgctccctgggttgtcagaattcacttccttggctgcaggatgaggcctctgcttccttgctggctggcaaccgggggtgctctgagctcctagaggcagctctcttcttgaaggccagcaggagaatgtcggggctttgccacgctgccttcctcacattctgtgggccagaagcaagtcacgctcaaggggatgggttgatacaagggagactcttggggctgccttagaattctacatgtgtgtgggccgactccctctcctcacgggcacctgccttccccactccgagccacggccacgct

SEQ ID NO: 532973 - DNA, 838 bp, Homo sapiens
  misc_feature (61)..(61): n is a, c, g, or t
  misc_feature (237)..(237): n is a, c, g, or t
  misc_feature (315)..(315): n is a, c, g, or t
  misc_feature (344)..(344): n is a, c, g, or t
ggagagagagaactagttcgagtttattttggtttttttttaggaacctcaaggtaatttnaatgacctcagaaccaggtgacaagggcagacgtgaccaggggcgtggtggggggattcccagaagcaaccttcgagggcgctccgtgggtgcttaccacctgtggaaacgtgggtgagggtgggtgggaaaactccgtgggtggaccctagtgtggaagcctttccagataattntctgtgaaagccgtgaggcgcctcgagggtgagttaggggcgaacatcgtggtgtggcgcgggtgtggtgtgagaggntcatgtggcagaagagaggagaggaaagncgcggagagagagtgtggagacccgctggccagcgagagagaagcgagcgtctcgcgagagagagaatatccctcgcgagagtctctttctaacaacaaacctctttttgggtgcaccaagacgacgcgaactcataagaaatcacgaacacaacgcgtgaggagaggaaagagtgtgtagacatacaagagatttagacagagagcgcgagccgggtagaaatgaagaaccccccgcggtgccggccgaggtggaacaacagccacgagcggtacagacgaagaactcgtgggcggctccgctgcaggcgccgcggaggcgcacacccggagcggagaaccagtaggaggagcaggagagacggaggtggcgcggattcactcatacgcagaagcacacaccgaagctgatgagaagtgaggagccacacagaacgggcggcgacaccaagatggggcaagaacaaccctaccgacaccacagccgacctccg

SEQ ID NO: 532974 - DNA, 162 bp, Homo sapiens
actatgtagctacgagtcgctctcacgagttagcgagcaatgagtacacttaggtagagtacgtagctttaagggctgctttcagttagcgataggtaataggcagtgcactagtgggcctacggggttggagacccaacaaaaggacaaggttacaaatga

SEQ ID NO: 532975 - DNA, 219 bp, Homo sapiens
aaaaacatttatggtttttttcagactgtattatatagctcttcagctttattacatcatgcaaagccaagggtaatattttgaaatattctcccaggcagggattagtaaatacttggctggatttctgggttttggtagaaaggtcatttccttggttaaaatgcatctattatatcaaataaattgctacaggtatctcctaagtagataccttcc

SEQ ID NO: 532976 - DNA, 388 bp, Homo sapiens
  misc_feature (52)..(52): n is a, c, g, or t
ggaaagggacaggccgggggagctttgtaaattagttatgaaactgcctttngaaaattatgactgagacagtgaaagagatctaacgtaaccgactccatcttggttctaaacttttaagttgtccttgctccttcctggacgtatgctgaactaactttgggaggaacttagtttatagtttaaaataaagacgataacagcctttacccaaaacaaaccaccttcttgcctgggggactaggactgcctttgtagggaccaaaaaatgagccacaagattattaaattatggtttagggtgttatgtagctgggagactacaagagtctggacccctcccttcaacttgctcctaagatccagtgcttgaggatatttttcccag

SEQ ID NO: 532977 - DNA, 320 bp, Homo sapiens
ggtttgaatgaaatttaatttttgttagaaccagaagcaccaaagagatcatctaactctgtgtccaataaaatttgtggatctaacccactaatttcttatttcattttaaaaataactttattaaggtataattcacataccataaaattttgtcttttaaactgtagaattcattagtttttagtatactcacaaagttgtgcaggcaggcgtggtggttcacgcccgtattggtagcacctttggaggccggggcaggaggatctcttgagcccaggagtttgagaccagcttgggcaacatagaccctatctctt

SEQ ID NO: 532978 - DNA, 775 bp, Homo sapiens
taaaacaaacaggggctttatttcatcatcagaaaccgggtgctagtttaaaaaacaaacagaagccctgacgagcctgtggagtgctgcagctcggagtcctgaaggagtaagtaattctggaggaccggcctgatcttcctgttaggggccggcccccacccagaggttctcccggactggcggggggtgggggtcaggcagtgggcaggggcctgacctaggctcccactctgcctggtgcccacagccgtgggcacaggggctcagctacgcagccttgagcgtctgtgccgggtaactcagccttctgcctggaggaataaggggagcaataaagagcccgtgaccacgtggtgaagcagggcctgggccccgggccagccagtacactgaagcggccaccaggggccccggggcccgggcacagagcacctaggttgcgcagtgtaccctgtgaccgtgcccttctgccctggatgagccataggccaggcgaccagggtggacaggcagggtaccacaagtggggggggcaaaggagtaagagcatgagccccaggcccagacagggtgcagaaaaacgtccccagccgatgaggaggaaggggggtcaccagcatgaaggagggcccgttcagggagaaattaccccgcccagggtgaaccccggcgcggaaatagggccctgaatggtggccatggttgaggctgatgaggaaaaacttcttctcctgtggtaggatactgaaagctgataaagcgttggtgtgta

SEQ ID NO: 532979 - DNA, 772 bp, Homo sapiens
gtttctgaggatagttgaaactggtcacaagccgctgagggtaatgtgagcaacgtactactggtggaagaaggactgtgtaactttaacgaacagcttgaacatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttaggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggctgccaaatgtccatatgtgggtgtcagcagggacaacagatccttatgcgagcagaggattctgccgggacgtgggaagtgtccgatagccgcctgaaacttgagggtcagtggtgaatcgagttctc

SEQ ID NO: 532980 - DNA, 997 bp, Homo sapiens
  misc_feature (228)..(228): n is a, c, g, or t
cggcagctggcaaagtgcatgctattgagatcttcgaatgctgcggagctggaggcggaggcagcgtggggaggtccgagcgagtgtgaccaggggcgccagtcgatcgtctctctcctctctcctgccgcctccgtgtcctcgaaaataactttttcagtcttaaagaaagaaagacaagaagtagatcggtccgccgcgctcacagcacctctcttcctctctagncctttccgcccggtgtaggaagcccggggttggctgatccgccggtcggggccgcgccggcgtagccacagactgacaactcggtccgtcacggcgacacctttttccgccacattgacatgtcccagtgtcatagaacctcgagtgccgtcgaaactcctgtggttgggccaagaatctcgcaacagcgagaagctttgttcaattccgaagtcaggactcaagtttccgtcacggactgcgcagaggagggttgggcgatggtagcctggggggcgcccaagccttgtcagaaacggtattcatggctggatgccctgggcgagtgtatccgttcctggtggcgccatcatgtgtgacttccccttgagtccacatggagttagcctcgggaagcggggctcgtgtgccagtgggcttccgagagttcgcgcggaatggaaagtttgtcccaatgctaccctcactcatcccgattcgagttgtcacctccttgaattcgtgagtagcccgttgactggggcacgccggagggggataggcgcgacgcggggcagagcaaaggtctaaccgctgacctcgcaatgcccatggcctcccaaggggcgcgagaaagtcgaacaccgtggagcacttgtcttgtgcggggtgggatcccaccaggtgaagtgccaccaatgatgcccgtgacaaggatggaacgccgcaagagcaggataggggggacgaacccatgaagtccgccatgtaactagaacgtcacatccca

SEQ ID NO: 532981 - DNA, 102 bp, Homo sapiens
ccacgctcgcggccaggatgaccgccagcaggctccctgcgagccatttccagcccgataggactaacgccctggtgttggcctctgtcgcgctcaaaagct

SEQ ID NO: 532982 - DNA, 339 bp, Homo sapiens
caatacaaaacacgccaggacacgatactaccttctattgaccatataccacatggacaatctacatacaaccatacaaagtacaaacataaacacgacagattggtacaggatacagataaaaactacggactggatagaacacatgtactaactaaagataagcccatgatatacctgagacgctcatcacagcacagctactaatgaaaaaatacctaagacacagaggactaccacttataggccatacttactatcctttgtagagcagcttctgtatagagagagtacagtaagaagctacggagagtagaggagcaagaaaacagtaccaag

SEQ ID NO: 532983 - DNA, 409 bp, Homo sapiens
  misc_feature (269)..(269): n is a, c, g, or t
cacaaagatagaaggttggagaaaacctgagctaatagccaccccatgtgggcatacaaaatgaggcagccgtgaagcccagcatttgtgttgctatggcttacatgaaaaccatttacaagattggtgcagtagctcatgtcaataatctcagcattttgggaggctgaagtgggaggattcctgaggccaggagtttgagaccagcctgagcaacatagcaagaccctgtctccaccaaaaaataaaaaataaaaaaaatagcccanctggtgctgatgcctgtagtagtcccagctgtgcaggagactgaggtaaaaggattatttgagcccaggagttccaggctgcggtgagctataatcatgacactgcacttcagcctgggtgacagagtgagatcctgtct

SEQ ID NO: 532984 - DNA, 370 bp, Homo sapiens
  misc_feature (130)..(130): n is a, c, g, or t
  misc_feature (257)..(257): n is a, c, g, or t
ttccaacctcgaaaaaaagggtgaatatttgtggcagctgctgcaagtaagccctgaagcgctaaagttcatgtgtaaggatgccttctgcagtaacctgtccgtggagaacgctgcagaaattctcatnctggccgactccaacagtgcagatcagttgaaactcaggcagtggatttcatcaactatcatgcttcggatgtcttggagacctctgggtggaagtcaatggtggtgtcacatcctcacttggtggntgaggcgtaccgcactctcgcttcagcacagtctccttttctgcgacctctacgcccacctctgaagcaatcctaagatcctgcttgttgtaagactccgtttaatttccaga

SEQ ID NO: 532985 - DNA, 85 bp, Homo sapiens
  misc_feature (7)..(7): n is a, c, g, or t
taccggntccggaattcccgggatgcggcttccgcggaggggccggctgcgcgcggcaatccggcaatggcggggcccggggggc

SEQ ID NO: 532986 - DNA, 388 bp, Homo sapiens
  misc_feature (67)..(67): n is a, c, g, or t
aatttttttttgggtttttgggggaaaaacgggccaaaaaaaaatttttttcccccccttgtttaanggaggggtaaaagatcctctttccaaagggggcccccccccaaagccaaaaggaaaaaggggagggtcagccggggcaaaaaaaatttaaacaaacaggccttttggggtttccccccccaattaataaggattggggaaaacccccttgggccaggcaaattttttcaagggggttcaacccttggtgacccaaaggataaaaaggggcaattttcccggggttttgggttttcattttaaagggttatgtgggaaaaggggggttcaaatttcatggaaaggaaggatcaaaaaaattgggaggccttttttcctttta

SEQ ID NO: 532987 - DNA, 946 bp, Homo sapiens
agcgggcttcgtagtctccctagtagatcccaagctagtaggctgggattctgccaaatgggcagcggcctccttgtcttctcgcccgtagcttgtagttagaccgaggggagaatcctggtgagcccaggtcccatcgccctcgtcagtttcaggaaaagccctgtgtagatgattcaggctaggcgggagaggaggagttacagggctccgtgttactgcccagaagctcatggcattctaaatattccagtgttcgagtcactaagtatacctctctgtcctagaaggctactggagctactgagactgtagtgggaaagaggcataagcatgtgaacttaacgtgtaaatgatattgaactctataaggaaatggaagctattaattcgcggtctacttgagtacttaccatagtgatgactgaaacctggaggctcatgcgagtcataccttggccaactgggcaagggcacaactcttcacagacacgctaagttaatatctaagggagaggcaacatgggccgagccttatctggtccaactctcggcccgcgctggcgccttgcaggaccccccaataggacacggtctcctcagctatgttcaaccataaagtttcggcgcacgacagccgcagcctccccccgaccgcactccgcccgccgaactcgcacaaggtcccatgaacacgccgggcaacctctcgacgcgaacgggcaagcacctgcggaccaagaccccattaagggcaacacggctcggcacccctcagcagaaactaaccccaccacatagccagctacaagacgggtcctcgcctcacaccacacgcaggggtcaaacaaggggacaaacccagttcccctcaattacaactacggggccctgcctacagcgtcggaacgcaagcaagcagccgcacatggggacaacgaacgca

SEQ ID NO: 532988 - DNA, 287 bp, Homo sapiens
taatcacgcatgggagacaggctctcactctgtcacccaggctggagtgcggtggcgcagtcttgcaagctgtgccctccccagtgcccacctggtgtgatcctcccacctcggcctcccaagtagctgggactataggcatgtgccactacatttggctgtttatattattaatcaattaattttttgagacagagtctcactttgtcacccaggttcaagtgattctcctgcctctgcctcccaagtagctgggattccaggcatgcaccacaatgcctggctaa

SEQ ID NO: 532989 - DNA, 248 bp, Homo sapiens
ctaagggatccttattatagaatttgtatatagcattgtgtattaatgtagtgtgtgtctcatattggggttcaggtatatcaagcacatgctgacaaaactgaataaacacaaagagagcaatacaattatagtaggatatttcaatactccactttctgtaatataacaagagagaatattctgaaggaaacagatgactagaaggcatgctataacaccaattatttttaataaggatcccctaa

SEQ ID NO: 532990 - DNA, 94 bp, Homo sapiens
ttttggaagtacatggaattgttgtaacaaagtatattgaatggaaatgtttttcatgtattttggaattttccattaaataatttgcttttta

SEQ ID NO: 532991 - DNA, 162 bp, Homo sapiens
aggagtagaggaggcaggtgaataaagatagagctgtgggagtaactaagtgtctgtacgtggatatgcatgcatacatacagacactaaaggcaaggtctctagtatccagcgtgattccccagtgaccattttctcccacatcaggaattgccaagtatg

SEQ ID NO: 532992 - DNA, 288 bp, Homo sapiens
aggatccgtatatgctgtctcactttttcttcaaactatgtgaactcgaactataatagatttggataagaagtgatacaccttttattggttttggtgggagacccctgatctcggggaaaaaaatattggtctcggaagaagggaaaaccagtgttctacgccctggcaccataggcctggctgatacttttcttttatcctctggttaattcttggtaatgggtgtttcctggtctggttttatgactattctgtattctaagatttctctgagacagcatataa

SEQ ID NO: 532993 - DNA, 841 bp, Homo sapiens
gctgcggaacgagaagtgccatgactactacaccacggagttcctgtacaagcctgtactcatcgagcagggcaaggggcgatcttctgactgcaggtacctacactgtccatgcggcgcacccttgcagccatggggtggacgcatccaaacccgcctttgaccagtgaactatgtggaccaagcgtggtgggtgaatggccatgcatgtggtttgtcagtgagaagctgcgcgaggttgacctgcgaagggacgggtgttcatccaattgccccagactcggccttgcgtgatcgggctgaataagaacggcggatggctcgttctagcccctgtcactgaggctcaatgaaagacactgatttcgatgcaccgcgatgccacgggagcagtggtggctgagcctgcggctcatgctgaagatgctggcacaataccgcatcagtatggccgcctacgtgtcaggggagctggagcacgtgacccgccggaccctgagcatggacaagggcttctgaggccagccatgcccacgcccctccccagcccccacccatgccagcgcagcgccagggctcagatggggcctgggctgttgtgtctggagcctgcaggcaggtgggggctgcgtacctgctcagcccatccctgcctctatgcctgggcacctgccaggcctccctccggctggtgtcttgagaccagcctgccaggccctccagacaggaggacagagtagcctggggcattcaacttcctgaccaggggacgtggcagctgtacggcgtatggaggctagtgcccctggcttaaggagacacatgaggcctcacgtatcca

SEQ ID NO: 532994 - DNA, 795 bp, Homo sapiens
atggcacatgcaacgcaggtaggtctacaagacgctacttcccctatcatagaagagcttatcacctttcatgatcacgccctcataatcatttccttatctgttcctagtcctgtatgcccttttcctaaacactcaacaaaaaattaaataatactaacatctcagacgctcaggaaatagaaaccgtctgaattatcctgcccgcatcatcctagtccctcatcgcctcccatcctacgcatcctttacataacagacgaggtcaacgatccctcccttaccatcaaattcaattgtggccaccaattggtactgaacctacgagttacaccgatacggggactaatcttcaattcctacatatttccccaattattcctagaaccagggacctgggaatccttgacgttgaccaatcgggtagtactcccgatgtgaagccccattcgtataataattacatcacaagacgtctgtgcactcatggagcttgtccccaaattaggcttaaaaaacaagatgcaatttcccggacgtctaaaacaaaccaaactttcaacggtacacgaccggggtatactacggtcaatgtctgagatctgtggagcaaaccacagtttcatgcccaatcggtcctagaattaattcccctaaaatcttggaataggccgtattaacctatagaccctttaccctctagagtaaaaaaacaacacaaaaaaaaaaatgtgggggccgcccgaaagtttccaccaacttgtgggcggccaaagtaggcgtgtcaggccaaga

SEQ ID NO: 532995 - DNA, 548 bp, Homo sapiens
  misc_feature (179)..(179): n is a, c, g, or t
  misc_feature (209)..(209): n is a, c, g, or t
  misc_feature (212)..(212): n is a, c, g, or t
  misc_feature (363)..(363): n is a, c, g, or t
  misc_feature (371)..(372): n is a, c, g, or t
  misc_feature (377)..(378): n is a, c, g, or t
ggcgcggtcgagtcatcgcagggcctcaccgcttcgttctcccgtccctccccgcgccttggctacaggactagccaagtgaggcgggaggcgactcggacctttccctgcatttcgtttcggccagtgccggggctacccgccctggggcctgggatccttggggcccgtgagccacntcttagcggccggggctaccgcggccgccntgnccctcatgaggcatagctgaccaagctgctggcacctcgggagcaactccccaacccgcagtgagagcccggagccggctgcaacttgttcgctgccctctgacctgacccgggctgcagcgggggaggaggagacggcggcggcgattcntcccggcnngcagnncagtttggcgacgaaggagagttggaagccgggagggggagccgcggcgcgttggccgtgcgcgcgcccgtcccccgaggagatggaggaggaggcgatcgcagcctcccgggggaagagacggaggatatggactttctgtctgggctggaactggcggatctcctgga

SEQ ID NO: 532996 - DNA, 260 bp, Homo sapiens
agctgtaccctcagcggatgataatctcaagacacctgcggagtgcctgctctatccccttccaccctcagcgggtgataatctcaagacagctccggagtgtctgctcactcgcgttccaccctcagctccacgctcagcggatgataatctgcaagacacctcctgagtgtgtctgctcactccccgtccaccaacagcggatgataatctcaagaaactaaggaagaataaataagtaatataaaaataaggtgaaa

SEQ ID NO: 532997 - DNA, 882 bp, Homo sapiens
  misc_feature (125)..(125): n is a, c, g, or t
  misc_feature (135)..(135): n is a, c, g, or t
  misc_feature (158)..(158): n is a, c, g, or t
  misc_feature (162)..(162): n is a, c, g, or t
  misc_feature (218)..(218): n is a, c, g, or t
caaaatacacaaattagctgggtgtggtgacacacacatatagtcccagctaattagggggctgaggtgggaagatcacttgagctccaggaggtggaggctgcagtgagccaagttggtgtcantgtactctanctgggtggcaagtgagacctgtntcantcaatcaatcaatcaatcaatcaatatctcatgctgtaattgtcttctgatgtttncatccacccagccccacctctgcagccttaattactggagtaggtccatgatttcagtgtagggttaatgtattctgcagatcatctttgatttgacctgcttttttgcttcctttttatctctgaacaaaggagatcatcattctctttaatctgccttctgtgtaaatctctaccagactggaagctccctgaaagcagaaactgtctgcttccccagaacttagcactgtgctttcatgtatgtgggataaatttttactttgttagtgcaactttgtttgtacacgttatccttgatattacatacatttgttgatgggggcaatttatatttgttgtgagtaaaatacttttttgttggattaagaagaactatactcttcccagcactttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcgcgccattgcactccagcctgggcaacaagagttaaactccatttcaaaaaaacaaaaacaaaaacaa

SEQ ID NO: 532998 - DNA, 284 bp, Homo sapiens
ggttctcgtgagactcagtaggagcttcttccatttacttttgtggtctttgacagtctttgcttattggtacgagtgacgactgcttctggcacctcttgtgtgttccctaccccagacatttctctaagaagccttgtttcctttgagtgggaaacaaagtagatttgattccagatcttttgggatcttactagtcttaccagtctagccagattcttactagactgatgttctgtctgccccattggtccgccacagaggcacctgcttttgatcgaatc

SEQ ID NO: 532999 - DNA, 309 bp, Homo sapiens
gaatgggttagtaagtactgtagtatatggtgaagtaagagatctgaaaagagcatggaaccagtctacacatgctaatgtatcctatccctaagaaaaatagtagtatacatgtacagtaagtcatatagtcttcacttcaccctcccccagttgtaaatctccttagctgtaacatattctgttaaataccacaacactggtaaataatatacccaggtagccatattacaaaaattgtgtagcatatatacttccatagcataaataaaaattaaacaatgtgtacgtatagctaaaggccaaggg

SEQ ID NO: 533000 - DNA, 206 bp, Homo sapiens
tactagcactgcgccggcccaaatgagaaattatacctaacattatgtcagtttccaatttttaaaatccaccttagtcttttattttctttgtaagagtcactgttagcatttatcgagcttagtgaataacaatgagtaacaacttaacagtggtattgaaaacaatgtatgatatacacaaatacagactgtctcactcaggg

SEQ ID NO: 533001 - DNA, 171 bp, Homo sapiens
catatattcttctagcttctagactacatttggtgtcttagccagcttgggctgccaaaacaaacacaaacagtctaggtgccttacacaacagacaatttattttcttcacagttctgacaggctagggaagtccaacgatcagaggtggtggatatcgagctcgggcta

SEQ ID NO: 533002 - DNA, 150 bp, Homo sapiens
gcaactttgagctgcacgttgcacaaggcgaccactttatcaagttcttcgctccgtggtgtggtcactgcaaaggcctgggcttccaccttggagcagacttggctcttgggctcgtgaacaattccgaactctttaaggtatggcaca

SEQ ID NO: 533003 - DNA, 252 bp, Homo sapiens
tttcggtcaccctcctggttttgccctgtcccattccacccccctgctccccgaaaaatttaagggtgtttttttcccccccttcatatttcaaacccatctttccctttttcctcctttccttcccaaatccaaaaaaccttgggggggttgtgccagcctgccccctgggtttgccccctgggtcttttttttttctttttttagttcctgtattttaaacattagtaaaaataaatgttttttccccca

SEQ ID NO: 533004 - DNA, 137 bp, Homo sapiens
gtgattagaggatcccattcaggcaggacgatggggactcaacagcctggcgagtgccttggaggagatgggcaagagtgagatgctggtggctgcaggtgtggtggcggtggtggtcagcactggggggataggtg

SEQ ID NO: 533005 - DNA, 1017 bp, Homo sapiens
  misc_feature (88)..(88): n is a, c, g, or t
  misc_feature (145)..(145): n is a, c, g, or t
  misc_feature (541)..(541): n is a, c, g, or t
ctgcaattacctagatagcgaacatctgaatgcagtcttgaggttggattgagccagatgctatcgacttagatgactagacatgttnaagcataccctgaaatgtagaactggatgcacaatcgtaactgtgcactgtgacatnacgtgtccatcgacactgattgttcgcacagtatctactcgcaccacttagttgtcatcaaagacatcattatctttcctatagtcccgtctcaggtacatagcgttactaaattatcccatctttgtaataaccttgcacttcttcggagtcatactgtaatcgcagtgagtattaacatcagcgcggatatgggtataacgaaaccgagattgcgcgattcatatcatcaggatcccatgtcctgtacgcgttctacctctcatctcctgaaattaacaggcttgcgaacatgagcaacgtacactcattctctgacggtctcaagagccgaccttgtaagcaacgtagaccagtatgccttgaagatacgcgtcgtggtaacaccagggagantcctaatattcacaaggaagactcactattccatgaaaagcgacttttcccgcatagagtcccgtatggaatagtgtcccaaacatcgtcaagacgtgcctcactaaaatacgactacacataatggtctcgcagtaattatcactgttcattccacctgtgaataaacacagacccggtatggctcggaaactattttacggcgtgcactacagacgcaaaatttcccatttgtcaaggcagaattgaacctatacaggccacatttccatgcaggaaatctccccgtgttaacctgtctaatacgctcatcttactgaccatcagccggcagtgttacgtgttcacctcagtgtaatgctcacaataacggcgcggggtatacataggcacgaagagcccaacaccccaacacaccgacccacacgctttgacccaagccagactgtccaacaccaacgcctctccctcccttg

SEQ ID NO: 533006 - DNA, 861 bp, Homo sapiens
ggcccactttggggggccccaggctctttttgaggagggtggtaaagaggaaatgcttttttatttttgggggtttcaccaactggggacccacgggcgccgtgttgcgccccctgttgtgtgtatagaaaggttccctttttgtttgtcggcgaggcccccttgtgggtggatgctgtttgaagacgccacactgttttagggggagttgtagtgcgccccgctagatatggggggacgccagctgcgttctgtttgtttgataaaataaataaatactctacgtggagatagcccccccctcttaaataacacttgcgtctagacagaagaacaaccaccaacgaagcatgtgtgttttttccataaaaagtactcaccaccagaaaaagtgcttgctaagagatatgataatatttttttgtccaccactcttctgttttgtatgtaggcacactgttatatatacacgcgtgattttatcatctagaggaacacttcttcttcgtcgtttattttataatatgacaccaacaagtcgtataatatagcgtcttctttcgtagcactacattcgcacccttcacagccttcgttgtagattgctgctagatagatagaataagttcatctttttttcgtatgttattagtataaatattattatgggttttttcaaaatcactataaaagaaaaagacagccaccagagtattgccccccgccccccccatattctccagcgggtagggcttctcttcctgcggggcccaaaaccccttttttgggccccctttttttttttccgggggaaaaaaaatttttttttttttgggtttcataaaccggacccccggcgga

SEQ ID NO: 533007 - DNA, 519 bp, Homo sapiens
  misc_feature (375)..(375): n is a, c, g, or t
  misc_feature (378)..(378): n is a, c, g, or t
ttcctctcctcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgattttgaatatttctgcagtagaaatctcctttttcagaaacagccaggggctgtgaaaaggagggnagntggacaagggaggaacagatacctgaggatgtgggacgtcctggggccatgtgggtgacagaggaaaatcagcaggcttcagccctgaacttcacctcccagagccgggtgggaggacagaaaacagggccggccgggcac

SEQ ID NO: 533008 - DNA, 709 bp, Homo sapiens
  misc_feature (309)..(309): n is a, c, g, or t
  misc_feature (314)..(314): n is a, c, g, or t
  misc_feature (316)..(316): n is a, c, g, or t
  misc_feature (318)..(319): n is a, c, g, or t
  misc_feature (321)..(321): n is a, c, g, or t
  misc_feature (323)..(323): n is a, c, g, or t
  misc_feature (326)..(326): n is a, c, g, or t
tccctgcgccgacaatgtaacggggctaagttataaaccgaagctgtggaatccttatggattggtaggagagcgttctgtaggctgttgaagaagaagggtaaccaactttggaggtatcagaagtgagaatgcaggaataagtagcgagaaagggggcgagaatccccctcgccggaagaccaaggttttcagggtaaagcttgtcttccctgagtaagccgggacctaagcccaggctataatgcgtaggcgaatggaaaacagattaatatttctgtgccagtcatttattgtgatggagggacncgaangntnngngnacngacgatcggttgtgtccgtagaagtatgtagggtgacttagtaggtaaatccattaagttatatctgaggtatgatatacagtcgtaagatgaatgtacaaatcccacgctgccaagaaaaacttctaacgttaatatatgactgcccgtactgtaaaccgacacaggtggtcaggatgagaaatctaaggcggacaggctaactctcgttaaggaactctgcaaaataacctcgtaacttcgggagaagaggagcccttgtgtgtgagtatacacgcgatacaaagcgcacgagggtcgcagtgaagaggctcaagcaactgtttaacaaaaacacaggtctatgctaagctgtaaggcactgtttggggtaccgagctaga

SEQ ID NO: 533009 - DNA, 137 bp, Homo sapiens
tcagcaatgacgtggagcgcatggacggcgcctgataagacaacgccttgttcttcaagccacactggagatagaaattccaccacaagatggtggacaaccgtggtcttcatggtgactcggtcctataccgtggg

SEQ ID NO: 533010 - DNA, 504 bp, Homo sapiens
catagctgtggacgcccacatttcgctgagaggttacagtctcgcctacaggtgagccgcggtagtacagagagcttgtgccgggccggagctccacgtcacactagtgcatatgggtaggtgtagggcaggctgtatcgacacttggacgagagcttggcagtattctgtaggtacggccagtcgatccatgtgcccagatagttcattgaccctctccggactcttctctggaatccgcgggtatgatctgtggctctagcgtgcaagcttgaattgtggtttacccagctctcagaagttagaataagtacttcgtgagggcttccctcggctgggcttgtaggctctggttcacgatgtcaggattctccttgtaacgactgcactcatagtattcagtgccatgagtcttccaatctcctagacacatccagcagaagtcgtgtttacatttggagcattgcatgtgattgcagcctccattcttctcaatgcagatgt

SEQ ID NO: 533011 - DNA, 125 bp, Homo sapiens
aaaaacattttggggaaaaaaaaacagtgaaaattaacaatacaattagtctgggaacggtggttcacacctataatcccagtactttgggaggctgaggtaggcagattttttagcccagaaat

SEQ ID NO: 533012 - DNA, 433 bp, Homo sapiens
ccaggtagactaacctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggtctacctggattaactagaaataactttgcaaggagagccaaagctaagacccccgaaaccagacgagctacctgggttaggtctacctgg

SEQ ID NO: 533013 - DNA, 236 bp, Homo sapiens
acagtatattctatctagaatatgcagcatgccatcataactcagctcaggttctaggggtttttgagacaaactacatacgtctgtgctgtaggagtattatgttctggataccagttctttggccaatatatatagtgcatatttcttctagcctgttattgttgtcttttgatgagtttctattttatccattttttcttttatgggtaattccttatagactcctcggtcta

SEQ ID NO: 533014 - DNA, 110 bp, Homo sapiens
agaggatttcccgatcccgtctgatagtcgctatagtgatgccagcagctaggactgggagagataggagaagtaggactgctgtgattaggactatcaaaaggaacagg

SEQ ID NO: 533015 - DNA, 485 bp, Homo sapiens
ccgggaattacttgccccatccaaaaagacaagacctatagctaccttaataacctaccagtgaaaagcgaatatccctctataaaactggtggtggagtggcaattccaggatgacaaaacccaaagtctcttctgctgggaaatcccagtacagatcgtttctcatctctaagtgcctcattgagttcggggcatctggccaatgagtctgctgagactcttgacagcacctccagctctgtgcttcacaacagtgacttgctctccaatggatccagtgattcgttaaaggaggtgctctgtagcagaaatagctccgggggctggtctcagggttgtctcatgtctctttttctgtcttaggggttcattaaatcagcacttggttagcagatgtttaattttttttttacaacattacttgtggcctctttctcactggaaatttatcttgataaataaaaactcgtttcttgaaaaaaa

SEQ ID NO: 533016 - DNA, 399 bp, Homo sapiens
aataactctcatgagatctgatggcttttataaaggggcattcccctgcacacaccctctcttgcctcctgccatacgagatgtgtcttgctcctccctgtcttccaccatgattgtgagtgaggcctccccagccacatggaactgtgtcaattggacctctttcctttgtaaattgcccagtcttgggtatgtctttattaggcagtgtgagaacagactaatacaagtaggatagggtatcttttaacttgtttccagtggactcttgctttactttcaggtgggatgatggacaggaatgggaccccttgtttcacggaacttgtggggaaaagggaatggcaggagcaggaacaagtgggccttttaccccaacaactggaggcaatggggaac

SEQ ID NO: 533017 - DNA, 844 bp, Homo sapiens
ttcctcatccgcctccttgctcgccgcagccgcctccgccgcgcgcctcctccgccgccgcggactccggcagcttcatcgcacagagtccctgaactctcgctttctttttaatcccctgcatcggatcaccgggtgccccaccatgtcagacgcagccgtagacaccagctccgaaatcaccaccaaggacttacaggagaagaaggaagttgtggaagaggcagaaaatggcagagacgcccctgctaacgggaatgctactgaggcacacatggggagcacggaggctgacaatgcaggtagacgaagaagacgcaagccaggtgggcgaggacgagccaggcacgcacgcaccaacggtgatggtcgaggccagaggatggccgatgaagatgaggaacgctgagctcagctacgggcaagcgggcagctgaagatgatgacggatgatgatgtcgataccaagaagcacgaagaccgacgaggatgactagacagcaaaaaacaaacaacacaacaccaccacaaaacctccggcgcgccgccataaatatctccccccgggggggaccacaccaacctcaccagcgtcacccgcggagatcagcgggaacacaacgaggcgcgtccccacaataccagagcccggcgatactaaaagccagacagcggcgtcggccaaaccgctagaccacaggcaccgcgacgcggaatcaccgcgtcgaccggcgatcaatcggcgaacggccacatcacctctgcgcggggaaccacaagcggcaacgcatctccccgggacgctgacgacccgagcgaaaacacaaatgacagggcaccggga

SEQ ID NO: 533018 - DNA, 359 bp, Homo sapiens
  misc_feature (116)..(116): n is a, c, g, or t
ggcatgtgctccccctaagggtttgctcctccctgggcctgaaagttccttttcagcctgagagggggcccttcgatttcaggcatgactcagcccgggtgatgcctttgcagggntgagtcaggatttggggccggcttttttgggtctgtccccttttccccggtgctgccctacaaaactgtggcccggaaggggccgggataaaggatgccccaggtctttggacggggggagggggtagggggtttgatattgtttatataataataatttttttttagggggccgcttttggatgtatgttgaaccgggtcccggtttttttagcttgatataaaaccgaattccaaagggga

SEQ ID NO: 533019 - DNA, 1473 bp, Homo sapiens
taggacgactggcggcgacagcaaatacctacgggaccaggtcccgggtagacacccggtcgatggggcacccggacccggcattgccgcccagcggcggtgaactgctcgggctgcgagggcagagactgcactgccaggacgccggagtgcccaggactacctgccccgagagaagttcctccgacacggaggaggcagacggcgggctggcacggaccgtgtgccagcagctgcatggcatgctgtcgcaccaccggcgcgctcatacgcctgcaggtgagccgcgagcaggtacctggagctggatgagacgcacgcgattgacggacggaaccgagaaccctcacctggatgactctacagtggatggacacatgcatggtacactgacccgaacgaccctgacatgaacacgtactttgacaccgacgactgtgtgtggaccacacgaagcaagacatgactcgtagactgggaaacacacagtggaacttcacatgaacacccaaggacatgctccgtggacataccggacaggcaggcctgacaggagatgcagaccatgtggagacggacctgtgcccggcgaccgaggcatccgtgctgggccccatgggccacacaaggggccaacagaagaccaccggttcaagggacggagcccacaagggaccggggcagaatcacgaatccggacggaaactggtcccagcaacaagtggatcaagggcaccgttgcggcttgactcacgcatgccaacagacccgggcatcatgggaggatggaaagaagtttgactcatcatggcccgttcaggaggcatcccttggacgcataccggtggaggaccgttcttacttaggatgggacagccacccgaacgcacgggcagcaaattcccacgttcctcttttacaagaacagctcccttgagaggtccagaatctacgtggcagttgacaaggggatccagaatggccatcggaaacagagagcacccagattcttaccatttgggcacaagatactacaatttaaacccttcctggaacagtttcctacttgtggcaaaccaagatccttacagactgggttcaacaccgggcccctcccagagcactgccagaaaccggcaactccgacccagggcgtaacgcacgcacctactgcaggcggcgcacgggcaccagagctcggtaagagtgcccacacaaggaaagggaactgccggcagcggcgagtaggcacagacacccgcggaactaggaagacacagagaggaagacagcacaagagggatgaagcgaaccacggagagatgcactggcacaaccaatagggaaacacaaccacaacgaaaagacaggagacgatggaacgcagggattcacgcgacgagacgtcgtgcagcaaggcacggaccacaccaccggataccagcagcaaggcaggagaggcacaccgccgac

SEQ ID NO: 533020 - DNA, 115 bp, Homo sapiens
agatggagtccctgagaccttgagatgttaaataccttgcctattattttcaagtggtagagctaggatctaaattcagacagttggacagcagctgtaaacacaacattatacg

SEQ ID NO: 533021 - DNA, 594 bp, Homo sapiens
taaggttttttaagttcattgagatgggtctttgagcttttttcctgggtttttttggccttttttctttttaattcaggggaaatttttaagctaactaaatttggggggtttttgctttttttttttttagtttttttggtaaaattatggatttcatgtgattttaaaggggggctcaggtacccttttcagcttttgggagactgtattacattttactggccgctgtttactacattatgaccctgggaaatgttaggctttctttttacactctgaatttgatgcgcagatatgggccttcggtcttcttatgtccatttttacatgcgcttggggtattcaatttctacttttgccctgttctctatgtttgttaaggttttcttaaaccttaaaatcttcttagttttcttatggtcgattctataaaatttctacatatttgtttttttgtttatttcttttatttttctcagttgatttgctcgttttatcttattaatttatatgtcttagttttggctttgtttttttctatatttttgtgctattcgattctctttttcttggtcttttagatactttata

SEQ ID NO: 533022 - DNA, 330 bp, Homo sapiens
tgacatatggacactaggcgtcaggaagacagaagaagctggacagaaagagatcaagatttaactggttatgctgtagaccatggcagatcgtaacagaagacaaagcccttaaaagaaatgaaactatcctcattaaaggcctgatggctcacaccatccaggagatctcctctgctaccaactcccagcagctgattcagcggtccttcatgaacaataggcaactgaacaagaaaatgagtttatattgttcaaaagaaagaagaatgcctcttttttcccttgaacaagggaggtggggactaacaaaagattctttgcttgaaa

SEQ ID NO: 533023 - DNA, 111 bp, Homo sapiens
tccaccatcacatctgtgcattctcttgagtgcatgtatagcaaattgtgtgcatagttactcagtttttatgaactgttgtatcctgttaatgcatatgctctgtgactc

SEQ ID NO: 533024 - DNA, 378 bp, Homo sapiens
  misc_feature (4)..(4): n is a, c, g, or t
  misc_feature (13)..(13): n is a, c, g, or t
  misc_feature (27)..(27): n is a, c, g, or t
  misc_feature (31)..(31): n is a, c, g, or t
  misc_feature (36)..(36): n is a, c, g, or t
  misc_feature (44)..(44): n is a, c, g, or t
  misc_feature (53)..(53): n is a, c, g, or t
  misc_feature (72)..(72): n is a, c, g, or t
  misc_feature (83)..(83): n is a, c, g, or t
  misc_feature (111)..(111): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (131)..(131): n is a, c, g, or t
  misc_feature (143)..(143): n is a, c, g, or t
  misc_feature (190)..(190): n is a, c, g, or t
  misc_feature (208)..(208): n is a, c, g, or t
  misc_feature (248)..(248): n is a, c, g, or t
  misc_feature (271)..(271): n is a, c, g, or t
  misc_feature (305)..(305): n is a, c, g, or t
  misc_feature (315)..(315): n is a, c, g, or t
  misc_feature (353)..(353): n is a, c, g, or t
taanaaagggaanactttattcaaaanccancaaanaaatgganagcttgggnctgtaaaaaagcatttatnttttagagcanaggtcagtaattgtatatgagagcatanactgctanananaaattaantgatcagaccanaacttttcaatgtttaaaaaagaataagcttccctgtaaaagcagcncctttgtgacgttttaantttagtattcctctccttcttcctcaccctctccttcaanagaatccacaccaacctcctcanaatccttctcaaggggagccatgttctcacgggnctttgaaaantcaccttcctccatcccctccccaacgtaccagtgaanaaagggacgtttgggataaattagg

SEQ ID NO: 533025 - DNA, 1060 bp, Homo sapiens
  misc_feature (550)..(550): n is a, c, g, or t
tggcccaccgtggttaatttggggggggcgtccaaaaattgggtttttaatttcctttggaaaggggtttccccgggggaaattcgttgtggctggtggctgaggacaactgtttattcccccaactgctgttgataacggttgctcacaaagtgccgctgtctcaataattgcctcacccccttctttggagtacgttcttacacaagcggagacaattacattcccttgtcacccacacaatactactatacaccttctacattatttctatatacaatctaacatactggcgctcattcaaaatattagtgcgtctcgaagtgggcgtcgctttatatttcgtccctctatcaatctctgtgaataaacactatcctatcttttctcgtcgcgcaagaataattacgaagaggaacgttcatccctcacaatataatttgttctcgaatagaattattcagagcagacacacaaacagaagagcggctgccccaggcgtgctacgtggcgttgtgtttcacacccaccgctcgtgttgtataaacancgcctcgcacaaaccaactgtgttgtgtgaggagcagcgccccgccgaaagagtgatggctggctgagcacaacccataatgtggagtagagtgtgttgacagcgacgatctattgagagacccaccctcgcgctcgtgtgcgcacaccaattgtgtgagcagaagaaacctctcctctctgtttctactactactagaaaattatacaaaacaaaatatacctcgcggtgcgagctagtgtgttgcgctgcaaagcgtgcgctcgcccgtgttgtaaacatcactctacagggaatctcacttctggagggaagaacgccgctgttcgagcgcgacaaacaactgtgtgttcttgagaacccccccagtgcatgtgtgttgggtgaccgttttgcatgcaagtacgaccgccacggatagagattacaacacacccgaagtgtgagcctctcctcacagccttgttgtgtgactaaaccaaacggactacagaacgaactccctaaaag

SEQ ID NO: 533026 - DNA, 150 bp, Homo sapiens
agaggtgattatgtatagcataaaggaggaaaaacaagttagcagtcaggatgggcggaaggtgtacataaccacagaggtgggtagcatggatttaccgtgattttagttcaagcagcttcatacgatctagagcttcaaacaatggca

SEQ ID NO: 533027 - DNA, 686 bp, Homo sapiens
cattatggccggcgaagtggagttagtagaattagaagtgttttctgaagatgggactgacttgctgcaatctgacgattaaacttgacctattgacaagttgcttctttttgtttgtttgttttgagatggagtctgtgttgcccaggctggagtgcagtggtgcagtcttggctcatttcaacctccacctactgggttcgggcaattctcctgcctcagcctcccgagtgcctgtaatctcagctactcgggaggctgaggcatgagaatcgctggaacctgggtggcctaggttgtagtgtgccgagatcatgccactgtaattccagactgggctgcataacgagactctgtttcaaaataaaatggaaagtgctttcttgagatggaatctaatgctggtggagatgctgtgaacaattgtaatgatcgcataggatttagactattatatcaacttaggtgataaagccagcaccatggtttgagaggtctgctccaattttgaatgaagttttcctgtgggtcatcaattgcggcaaaccttactactattttttggacatctttgtcccggtgcagaggcttacgccttgtatttctagcacttttgtgaagcttaagtggttttgtatgtgccctgtaagcatatgttgcggttcgcactatgtgcccctgcctct

SEQ ID NO: 533028 - DNA, 123 bp, Homo sapiens
actcatgggacccctatcgaaacccttacacattatggaaacagggcatttaaatcattactctaataaaggagaaggagttgtgatttgcaaaaaattatagaaattatagggtcgctgacc

SEQ ID NO: 533029 - DNA, 227 bp, Homo sapiens
gcgtgacgcgtgggtcgtgtttgaggaagtcgctgccgcgctggccctgcgttaagattccctgcattttaattgttttcaggcgggtgtcatagccccgggtttggccgacctagtaccaggattcgcattgcctagcatactatacgatcactatagggacacttgtacaaaagctgttaccgtcttgttccctcgagatctcttaggccctataattttatcac

SEQ ID NO: 533030 - DNA, 763 bp, Homo sapiens
  misc_feature (743)..(743): n is a, c, g, or t
atgacccttattgggtagcatacctcttgcttcaagtggactaccgggtcccggcttgcacatgtggtcttcactgtagcctttatactcctttcggagccggcaatttgttatcgactctgtcctcacgggaatgttccttgatgacccaatgatatttggaccaagaactaattgggtgagactttcgacgaatgccgctgggattgcccttcatctcccaagatcctgtgtgtattgcgtatacgatgtgcttcactgagttctcttatatagtatatgctgacatgactgtgtgtacaactacctgcctatgactgctggatactcatgacaatgaatacgccagttaaaacctgacgatccagattgtctgtgactcaatatggattatgaacccgttggaccatgcagggtctgcctgacagccacgcaaccctctctgaagtggatagtggactgatcatgctccttctgacatcagaccttcaaggacgggacaacgattgcaaagtgtgcagctgtatcctgctcaacgcctaaatggctgatggggacggctgctgctttcaaggggcccagtgcttgtaatataacctctccaggaagaggcacattgcccacctattggaaagggaggaatatgccttctcctcggtagttccacagagttttaggaaaatctgttaggaactgggtagatgtcaaactgcctagcgcagtcatactgatctttagccatntaacgccgtggtcacaccaa

SEQ ID NO: 533031 - DNA, 355 bp, Homo sapiens
  misc_feature (110)..(110): n is a, c, g, or t
  misc_feature (127)..(127): n is a, c, g, or t
ccttgggatggagtttaggttccccccccccccccccccaccacgggcccaaaaatttaggggaacccattccggggccggaaccaattcctttttttttgtggcaggantggcaaccatggtgggntacccctttctcaacggcattttttccatccaacgggcaacgcctttttgggccccaggcccccggaccctgggcatggtttaggaggattaaaaagaattatttttcctccccctccccaaactggttttttttctttcatgcattccaaaggcccccgtgcctccttgttttttgttcaaccggacccggggtttttcccccccaaattaaacccctcccccttta

SEQ ID NO: 533032 - DNA, 1677 bp, Homo sapiens
  misc_feature (647)..(648): n is a, c, g, or t
caggaaggtgggaagaattcatctggaattactacccaatcaatggaatgctgatcaagcaccacagctgtaacttctgaggcgatctaccaagaaggctgtgatatgagagagacttgtccgccgtggccatgtatcagccagcgtctcccgcgtgctggacgacgaatctgactggtggtctctgcactaggttcttgcatccaatgagaagactcttgtctccgtatcagaacgtctggacctgagtgtggaggacctgtgtccatccagacacaggctcgggccgtgatgataagtgtgtaaggaagaaagatcacctacaaacagctgagtgtgaccactggacatcagagacgcgattgagctctatttggttttgccatgggttgagccaccatatgtaacgaaaaacatctcaatgcattgtagatatctataacttcctcgtatgggctatcgtcgtattaaaatagttgatgttgcaccgatatgaagatcttagtagaaatgcatcagtatctccttaatattatgtataggacgctcattgtgtttctcctcgtacattttctctctagtatacaagcatacacacggtaaccccacatgttctcgtggtcttcgttaacgatttagacacacannttcattcccttacaatagaggatacacatagagaagagaaatgaacccaagggaccatacattggcattgattggagtaatagcaagattaagagcatatatagggagaccacccagttcgaacttaattacatacttaaagaaagttagaagcgaaactacttgaggacttaccctaggataatccccaatgaaggagattccaagaaggccccgagatttgacagaagaagcaagtgcctagtaaagattccactatttacggaagccttattaaaggacttgtcgttccttggcgccaaaaggacacccttcggaacatataaaggacacccaatgccaaaatactccaaggcgaaacattcgctagggaccccacgattatcataggattataccaattaagggaaaattcctatgtgtgttgcggcgtcatacaggtcttaacgacgtcggttatcacacaaaataggagcccccactttagtgtagccccatactttatcccaaatgtgtcaagacgcacgagtgaatccagcccttcaccgtataggcaaaacgagacacccggataagagagcataacgactgggagagcacgtagacaaatggcgggcagaacacagcagacaaagaacacataaccacaacgagtgacccccaaataaggaccacgacccaaacaacggtatggatagcaacatggtcagcaccaccaacagagggttaggataactacaacgacaggtaagagagacgcacactcaatgcaagaacagataaggcgtgagtaggcgaggagttgtgaacttagaaccaccaccaggacgctaagaagcatataagaccaacacagtcgacacgacgaaagaaaaaaaccagagtgacgaagagagcaacgaaagagaaaggaagggatgaaatcgacccacgcgtcgacactcaacaaagaagtagcacaagacaacgcagagaagcgaggaattgtagaggtggataagccaaggaagtagacagtacaacatcaac

SEQ ID NO: 533033 - DNA, 638 bp, Homo sapiens
  misc_feature (24)..(24): n is a, c, g, or t
  misc_feature (63)..(63): n is a, c, g, or t
  misc_feature (138)..(138): n is a, c, g, or t
  misc_feature (160)..(160): n is a, c, g, or t
  misc_feature (171)..(171): n is a, c, g, or t
  misc_feature (215)..(215): n is a, c, g, or t
  misc_feature (273)..(273): n is a, c, g, or t
  misc_feature (288)..(289): n is a, c, g, or t
  misc_feature (300)..(300): n is a, c, g, or t
  misc_feature (309)..(309): n is a, c, g, or t
  misc_feature (311)..(311): n is a, c, g, or t
  misc_feature (314)..(314): n is a, c, g, or t
  misc_feature (354)..(354): n is a, c, g, or t
  misc_feature (366)..(366): n is a, c, g, or t
  misc_feature (388)..(388): n is a, c, g, or t
  misc_feature (394)..(394): n is a, c, g, or t
  misc_feature (406)..(406): n is a, c, g, or t
  misc_feature (409)..(409): n is a, c, g, or t
  misc_feature (427)..(427): n is a, c, g, or t
  misc_feature (456)..(457): n is a, c, g, or t
  misc_feature (459)..(459): n is a, c, g, or t
  misc_feature (463)..(463): n is a, c, g, or t
  misc_feature (466)..(467): n is a, c, g, or t
  misc_feature (480)..(480): n is a, c, g, or t
  misc_feature (490)..(490): n is a, c, g, or t
  misc_feature (500)..(500): n is a, c, g, or t
  misc_feature (535)..(535): n is a, c, g, or t
  misc_feature (544)..(545): n is a, c, g, or t
  misc_feature (557)..(557): n is a, c, g, or t
  misc_feature (607)..(607): n is a, c, g, or t
tgacatgaaaagggctgccaggcnatgtgttcctccccccacttcacagccagcacataatcncccctctccttgacgacgtatgtaacgttgtattgctggttgcctacatgcttcatggagacctcctcgcagggngtggtgggcccatggaccccgntcagcagcatnttggagccagctttgctgcagtccaccaggaaggaactcttctngcccacaaaggcctttgagagccctgcccccttagaggtcaccttgctggcgtccgcngatgccttgggaatnncgctatagccngtctctgtngncgncctggtcactgactccccccggctggctgccgtctcgttngctgccccaggnctacctagacgctggcctgtcnccttcnccttcgccgggnctncccccccctgtggttggnccccccgtatttgatgctgctcacggctnntncccnggnnccacgggggtgtncatgattttnttcccttcangtgtttcctggcaatccattttaaccttggatggnccttcgatnntcgccgcgcctnctctccctggaacctgctcggggtggtgttaataaggaattccgactggntacctgtggtgcccccttcgagtcccgtgcc

SEQ ID NO: 533034 - DNA, 810 bp, Homo sapiens
tgcagcctataaaggccagcatcttgtgggccatccagtacatcccacctgagctggatcaagttagcaaaatggatttcctgactggaatctcaccaccgcaacaagcacacccttttaagacctactttatgaggcacttgtggattgtaagaagagtgatgctgcttcagaaagtcatggtggaattgctcgggaagcttacacagaggacaatgcttcccaggctgcgagttgagtgcccacaggtgtagttgtacggagcaattgaaagatccgaaatgcatttcttttagaccaccttcgttactattaaaacccagtcaagtttattggaaggcgagattaatcatgatcttctaaccaatattgtgagtgctaaattggcatcatatgtcaagttttatcagaataataaagacttctatctgattcacactggccttgtgtaccatgcaacgagaatatggcatcaatatagagagctaacgttactatttatgggaactggcagtagaaaataaacgaaatttctgtttgaccccaatgcagcaagaacttcagattggagctgatgatgttgaagcatttgttattgacgccgtaagaactaaaatggtgtactgcaaaattgatcagacccgagatgaaaagtagtgtgtcagtcatagcccacatcggagcgtttggaacaacagcagtggcaacaatctgtatgacacagcttgaatgccctggaaacaaaatctgaaccaagtgataaacagcctgtcgagtctttctagataccttaactcttagggttatact

SEQ ID NO: 533035 - DNA, 315 bp, Homo sapiens
tgactctagaggtatccccttgtccaagcgtagtacccatgcatttaggataaagggatactcaactggtacaacacaaatgctgcaaaatagtgttgaaacatatctccttgtgcatacacacaagtttctttctttttttttttttttggaaaaacaaattttggctctgtcacccgggctggagtgtacgggtgcaatctcggctcactgcaacgttctgcctccggggttcaagcaattctccgtgcctcagttccccaagtagctgaactgcaggcgtgcaccaccacaccgtggctaattttggtattt

SEQ ID NO: 533036 - DNA, 146 bp, Homo sapiens
tataaaggaaggctgaggggagagaggaggctaggggcctggacgaagaggctaggacctgaagagactccagcgagtctcgggaagcccagggggactttgtcacccattttggggcactttccccagggctccaatggctcagc

SEQ ID NO: 533037 - DNA, 674 bp, Homo sapiens
cttattaagaaaggttaatgattcattgaagctcagcatgaggacagtggatgcttacgcagatgagtgaatggtcatatgagagtagttctgatactaactagaaagtagaatttcagtacaatacaatagttggtctcctaacactaaatactaacctgaaatgagtaggagcacttgttatagagcgggtcaaagacttttaacagagttgatgtgctaattgtgcgtcctgttcagagaagtgaatagtatataattgagggctacttttgaatcagctggcttttcatgtatactttggcgataagtggtattatttgtgtggtgccacttagattcaacgtctaaagaatttggataagatggtggtgataacagacttggtctagtgagaggatgacgactgcatccttaataatagtcaggcaatttcctacaattgaggtttcccttaatggcatgaaatttgttagttggtggaaaggaaggaggggtaactatgcgggccgctttttaattcaacttccctggatgggaggtatatactggtacacgattaaaatgctcccgaagaaaaccactaaagttttaaaaaaggaaaattcttttgggatggataaacaaatctatttaagttgatttggtttttttggtcggtttctttagaaaat

SEQ ID NO: 533038 - DNA, 111 bp, Homo sapiens
  misc_feature (56)..(56): n is a, c, g, or t
aaatgttcctttggccaaaagctgaagggagtttctgagaaaatagttaaccattnctgtcaggtgtcatccctgttccaaaggtaagcccctttagaattttgttcttga

SEQ ID NO: 533039 - DNA, 386 bp, Homo sapiens
  misc_feature (11)..(11): n is a, c, g, or t
  misc_feature (114)..(114): n is a, c, g, or t
cacgcagatanatacacacacacacacaacatcacgcacactcaagaaaatggagacacctttggatttattgaaactcaatctcgatgagagggtgtacatcaagctgcgcgnggccaggacgctggtgggcacactgcaagcgttcgactcacactgcaacatcgtgctgagtgatgcagtagagaccatataccaattaaacaacgaggagttgagtgagtccgaaagacgatgtgaaatggtgttcatcagaggagacacagtgactctaatcagcacgccctctgaagatgacgatggcgcagtggagatataagcaaagaggaggagaaaacaaagggaaacagtacgtatttttttattttacttttagtatattaaaa

SEQ ID NO: 533040 - DNA, 741 bp, Homo sapiens
ggcgtgctgtgggtgagttgcttggatggttggtcagcgcgcgtgggctagaacggctagcaaaccgagcgatcatgtcgcatcaaatcaaactttactatttcggaacaaatacgtacgacgaggagtttgaagtgaatcagacatgtaccatgctgcccataggagcgatacgccatagtctggatccctagaaatcgccatctgatgtccgtgaatctgaatgtgaggaagtcttgagctgtctacagcagagctcagggtatgggtccatcatatgatccatgaatccatgaatcctcacattcttgctgttccggtgctcattagccaagaaactcaatgaaatgaagctggtcaagctacttttcagcctccagctttacagcagctgtccttacttcctaacatctttctgataacatttattatgtttgccttcttgtgtctcactttgatatttcacacgatgttcaataccactgtttgaatgtgctggtaaactgcttgcgttcttgagtagagccaccaccacataggccagccagatgagtgctctgtgggacccacaagctaagcctgagtgtgaaccccagaaagccacggatgttgctcctgtactcccagaaacacacttgcggcgatggagggaaggctctgagtttgagaccatgggctgttaccgggatcctgtttaacttgcctgttttgggttttccttgcccgggtgtggatagtgtg

SEQ ID NO: 533041 - DNA, 376 bp, Homo sapiens
  misc_feature (15)..(15): n is a, c, g, or t
  misc_feature (93)..(93): n is a, c, g, or t
  misc_feature (99)..(100): n is a, c, g, or t
  misc_feature (110)..(110): n is a, c, g, or t
  misc_feature (127)..(127): n is a, c, g, or t
  misc_feature (135)..(135): n is a, c, g, or t
  misc_feature (151)..(151): n is a, c, g, or t
  misc_feature (161)..(161): n is a, c, g, or t
  misc_feature (179)..(179): n is a, c, g, or t
  misc_feature (189)..(189): n is a, c, g, or t
  misc_feature (195)..(195): n is a, c, g, or t
  misc_feature (199)..(199): n is a, c, g, or t
  misc_feature (204)..(204): n is a, c, g, or t
  misc_feature (243)..(243): n is a, c, g, or t
  misc_feature (274)..(274): n is a, c, g, or t
  misc_feature (278)..(278): n is a, c, g, or t
  misc_feature (301)..(301): n is a, c, g, or t
  misc_feature (307)..(307): n is a, c, g, or t
  misc_feature (315)..(315): n is a, c, g, or t
  misc_feature (341)..(341): n is a, c, g, or t
  misc_feature (344)..(344): n is a, c, g, or t
  misc_feature (356)..(356): n is a, c, g, or t
  misc_feature (359)..(359): n is a, c, g, or t
taaagtggatggacntgatggaattcagttgtctcaccctgatagccggggtgttgatattcactttacccgcactcgagacacaggcgaccntgaagnngttctcggtntgtagagtccacgtganagtccccncagcctccccggatanctgtgtgccngtgcgctactgctgtgcncgttttcccnacttgngcgntcacnaaatgcagctgatctctctctctgtgcactcgtgatccntgttgaacaatacatgttggttctttttccncgcnatgtaagaacatgatatactgtncgttgnaaaaaaanttaccgtatttatataccggaatgtnccnacttcggggatnacnggatattaaatgggggg

SEQ ID NO: 533042 - DNA, 577 bp, Homo sapiens
aaaatgtttattccgctgtgcaatgtatttgtgttttaagctaagtattattacaaaaaagtcaaaaagatttaaaaaattaaagtttataaagtaaaaaacgtataataagcgaaggttaatttatgattgaagaaagacacaaagtttaataaatttagtgtaagctaagtatccagtgtttataaagtctacagtagtatacaataatgttttaggcccttacattcactcaccactcatcactgactcactcagagcaacttccagtcctgcaagctccattcacggtaattgccctatacgggtgtatcagtttttacctttcatactgtatttttacctcaccttttctatacttagatcacaaatattttccatgatgttacaaccgcctacagtattcagtacagtaacatgctttgcaggtttgtagcctaggagcagtaggctcaggtgtataggaggctatactttctaggtttgtatacatgcactccaccatgttcattccatgacaaaaccccctaataatgcacttctcaagaaggtattccctgtccgttaacttgatgcc

SEQ ID NO: 533043 - DNA, 778 bp, Homo sapiens
agccttctgggttttatctgactgggcagaactaacttatgtggtcaccctagttacaagggagtctgagacagcatttttaactagaattttatcagtaagggagcaacgggtcaatggcagtttgccagttgttaatgtgtaccctcagctcatattttccacccacatattcattgcacacttcgttcgagcatcgcaataacatgcctcaggcatcaaggggattaaagaaaaatccacaacatccacaatcttaatgttggatacaaagttgggcaacatggaaactttgagcaatcatcacatgtctcttcatgtggcatcatttcattttcattgaacgtccactttttttgaatcagtacttacaacaactttcagcatgtatcttagtagatagtaaaagtctactcaacctgccagtaatatcttttctaaaagtttacgtcctattaaatcaaatagctggttagaaaactctatcaccagtcacagactgctattcaacatggccgtactctacttttataattttacttccttctaattcctgtcatccagagtggctgaagcaggactcccgggtgccacgagtactttcctgagtatagcaaaaacaacactcaggccgccatcggctccagaccaagttcgaatcacatccaattttggaagccgcggtgctataagaccacggtggagccaaaacgccctcaaactaacgaccagaagttcgagtccaggttagggcaccggccctcgccccccgccggtc

SEQ ID NO: 533044 - DNA, 618 bp, Homo sapiens
  misc_feature (179)..(179): n is a, c, g, or t
  misc_feature (218)..(218): n is a, c, g, or t
  misc_feature (237)..(237): n is a, c, g, or t
  misc_feature (270)..(270): n is a, c, g, or t
  misc_feature (327)..(327): n is a, c, g, or t
  misc_feature (334)..(334): n is a, c, g, or t
  misc_feature (474)..(474): n is a, c, g, or t
  misc_feature (482)..(482): n is a, c, g, or t
  misc_feature (485)..(485): n is a, c, g, or t
  misc_feature (492)..(492): n is a, c, g, or t
  misc_feature (510)..(512): n is a, c, g, or t
  misc_feature (519)..(519): n is a, c, g, or t
  misc_feature (540)..(540): n is a, c, g, or t
  misc_feature (543)..(543): n is a, c, g, or t
  misc_feature (546)..(546): n is a, c, g, or t
  misc_feature (549)..(549): n is a, c, g, or t
gagggagccgcgggcgagggatcgcaggatgagcgatcggggcccgggcagccggcagcggacgcgccccccgagcccaccggcccgcgccccgcgccccccacggccccgcggtcccggtcccggccgcatcacccacgtcccccgagccccacgggccatgcccggccggccctaancgcgggccggggggcgtacccttgcgcccgggccccgcnctggcgccccccgggccgncgcccggcgcgggggccatggcgttcaccttcnccgcgttctgctacatgctcaccctggtgctgtgcgcctccctcatcttctttgtcntctggcncatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccntccacggnctnttctgtntgatgtttctgtgtgcannngagtggntgaccctggcctcaacatccnctnctnttntaccacctctggaggtacttccaccgtcctgcatatggttctgaggtgctgtgtgatgcggggtccatc

SEQ ID NO: 533045 - DNA, 378 bp, Homo sapiens
cgtcgacatgaaagtggggaacaggaggatagatgaaactgagggaatggatggagtattacttagctgttaaaaaaaatgctatcatgaaattcataggcagatggaaggaactacaaataaatcatcctgagtgaggtagtccagattcagaaagataaatttgatatgtagtcacttacatgtgtatattatccaagaagtaaaagataaccaagctacaatctacctagagtatagagaagtggactagacagtatgcactgatctccatgagagtgggaaatagaatccatcttataggttagctaggataggtggatgggaacaggaggatcaagtggggaacaggaggatagatgaaactgaggtcgacgc

SEQ ID NO: 533046 - DNA, 986 bp, Homo sapiens
tctccctggcctttctccccatcttgcctcctccagcgtcgtcagggaatgatgccctgggcaaaaaccttagcgtcaggcattcaccatgtccccctatccgcacgcaacggagaatccctctggttccactcgacatgcctagcgcccctccacagagggttgcccctcctcagggattggtatctattcctgcagcgttgtgactacatgaggttgtttctccccgtctggtgttgactctcaacgctatctataacactccttcgacaatgtggtgtcgtgattcggagcgacacggggatcacgactttgaggacctgcacgctggcggcactggggtcttgccacgtaagtactaagatgacagtgtttctccccaggacactctgcctacctaagtatcccatggcgctgttgcatggcgtcattacttctgagccccagccccaatctcatgacgaagactctgttgcacgccctccacacgcactaggtgaacagcaggatgcccaagttggagggcttcaggtcatctagtgagctggtgaacttgccaagtgaacattggcgaggtgggcacgggcctgtagattcacgggatagcgctgttgatcccctctctgtaggctccaaacccgttgggtcaccttgctgcaaacccatgaagcatggccctcagcatgcactgacccctgtcctaggtcatgaaggacactctgcagggtgaagcacttagggagaggcctcggcatgtcattccatgtccccagcgctggggtgcctgctgtccgtcccgctttcatgttactgttcggcagcttcgtgcatgagcctgcccagttggaggagactagggcacccctgcctcatgcctcccgcctcctgccaacctgtctcagtacctcccctccccgccacctgaaacagtgtgcccctgcacaaggccggagacccacagccctaaatcgcgaagtgcccttaaa

SEQ ID NO: 533047 - DNA, 117 bp, Homo sapiens
cacaggcttgctttgaattctctgacccctcatcctgaaactatggagacagccttcagctcctttcccttcttttagacctctgagtcttgctgaggtcctctaacagtctgatct

SEQ ID NO: 533048 - DNA, 394 bp, Homo sapiens
attttagaattggaagaggtcttggaaaatgttatctaattctcactcttcacctcactaaaattttgaaaactttaagtgatttcctaaagggacacagctaattagaggcagagttctaacagaaaacccaagtctcttgattcatttccagtgctttaaccaatatattatgttgctatgtaggatagtttaaattctaattttccatggttagttttaaaatacaatcatttttaaaatatactagtaaaacagtttttgctttctaaaaataaccagctctaaaagggatcttttcaagcattatcattattttaataactggtttttaaaactatcaatctgtattagtaaaattttcactcagaaaatttgactacaacaaaaataa

SEQ ID NO: 533049 - DNA, 1415 bp, Homo sapiens
cagccgctgcgggagcaccaccgtagcccgtaatgatctaccagccattgggatttcttccgggcacagactctgtaaggaaacctctgatgtaccaataccatggcgtgtgttacacatcgaagagcttcaggcagtcagtcagtgctgcttctgaggatgtctacagacgctggtacttcgacacggccagctcttcgggcaagtagagtacaatccattgcgactctatgcaccttgacaccgcgtccgtcacgtcgggagggataggacttgaagtcgagcatgtcgtaggatgcctgatcctgacacccccttgaggggtagaggacatgggctgccttttccttcgaccgaatgtagactttaagggctcgtcgccgtgacccgtcgtgtgctacatagggtagcgaaacaccaacgaaataatctgggggggtgtccccatagggcacttttcgcgtccccccagcactcgcacgtctcaaagctcgctgcttcgtcggcggagaatcgcgcacacaaacacggttagcgcccctgaatcaaggcaccaagctgcggtcatcgccctctacttgtttccaatgatcgtcgaaagtgtgcaaggcatcgcgggtcgcgactctggggcactagccctgccggggcagctctattgttgccttgaagaggcacttccctcgtgcctgcgattcaaaccatacctctgaggctctggtgactggggcatagtgcgcctcgaggtgacgggtcgcttattgcccttccggaggggcttggcatgctcgcgggtggcccttcgtttaccaagcgtttcgccggtccacgcttcttgtgcttgcttatcccccgtgctgaagcgtgcccggtgcattcggtgtggcgtttggcgccaggggggtcttgctcctgtggaccgttgcgacgaaaggccaacagggggggtgacatggtaggaccgcaattcccgtattccccttttgtgcgacggacaatggccttgcctcggggtggttgttcgtctccctggccattcgccaccgtagggcgttgtggggcgcattggccgacgttcccgttcctccccacagcggcgcctttggaggcctttgctttgcgctctctttgcccggcgattagccattagcctgttcccccccggggttcttgcgcattccccaggggatggttcgtgcctggggcgattggggtccaatttggcaaggtgtagtacaagcacagcccggtaagcggggcttctcttttctacctttttggggggcgccctttgcacatagcgcttctgtgagtggtaccccagtgcgtgccgtcacagccggcatattgggagcgcctcccactgttgctctcatccctttcccggagatccctctggccactacctctctccg

SEQ ID NO: 533050 - DNA, 642 bp, Homo sapiens
  misc_feature (419)..(419): n is a, c, g, or t
gggcagaacaggcagttgagagtctatagggctcagctaatctgaatcttggtgggaagaagtggattctcgggtgctagcaaatgggtgcagaagcctgagacgtaaaagagacgggattttggtccgtggtggaagcgaatgctcgacaagggccacagggcccacgataagtgtagacactttatgggggtataggaatgtcactgtggtaagatgcatgagcactttgaggagaccagttgtcagcataatcggaatgacacttaaagtggttagtgttctcaacgcatgagagaggaagtgtgtgtaagagtagaggtaagcaagatattctataaaggactggtgggttgggagttgggaatcaggtgtgtactggaggccaggagataagaggagtcgttggttcaaacggnatctggttcaagaataaagagggtactggtgcatgtcgtccgtagaggtaacgcattgcagctatgcattagttccatcctcctatgtgtgtaatttcttggctttcttgtcaggatctcctacgaaccaagtggctctcggactcacgctctggggccctaattacatgactctctggagagctcgcgcgggcagcgatgcgtttagcagggtgagatggac

SEQ ID NO: 533051 - DNA, 272 bp, Homo sapiens
cctggtaactcccttgctcattagggatataatcaggttcaggcagtggggaggaaactcatacaaaattgattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgagg

SEQ ID NO: 533052 - DNA, 298 bp, Homo sapiens
gagactctcggtctcaagtgtatcctcctgtctcgagctctcaaagtgttgggattacaggttttagcctctgcactgggccaggactacgctttcttacaacctgttttcgcattctagatgttccagggggctcccctgtagaaacggcaagtctctgcaggtcatcagaggctgcatttcagagcgctggttctcggtgtgtatcggtggctccatcgtggtctcactgtccagcttccagcagatgtggattaccaagctggagtacgacgagtcgggcccctccatcgtccac

SEQ ID NO: 533053 - DNA, 1931 bp, Homo sapiens
gccccaacacaaagagtgccaactgtataataggctctatatgtgcctggaagttgtcttatgatgcgcgtgattacttggacacaagacaggaagagctagaacatagagtagagtcgtacacttacccatggtatgtgacggaagaagcgtcgcgtagcaagtaggtgggcaatagagcatctaaggacagtgcacacgagcgcacaaagaataacgtgcaagcgcacgtcatatagtgtaaaatgtacaccctgtcattctagtgcaggctggacataagaggtaagacgatgcccattctcgtacttagtcaaaggtcggcgtctagtagagacgctgacacgtaccatggctaagtctcacatacaggatattcagaccctaaatactcgcgttgctagcgcgggactaaacacgaagggcgtcatcttcgacgtcatcgttctatgagaagacataaggaccacaaactaaaaggttaacccagtatcgccaaagcgaaggaaccacaccatggctataagggaagaagaccgtacatgacaaccgcaaggactcttgcatatagtggcccgcagcgagagcccggaatgcacaaggacatgagtctagccctgggagtcgaatagacgggggagggacatcgtagcaattccatagcacgggaccaagcttatggaaagcgccgacctcattggattagcgcctattgccgcgcatttgcccagacgtaacggtttttaatagccacaccctggtaacgagacctaagcccttatgggtgtgttagccgcaagggaagacgccaacacgagcacaagagggatctttcccaggaccatgggcggatggtcgcttgacaatttgtggtcacaccaaaccggaacagcggagttgggggaattatccgcgtcgacttccgggcactggcccttgggcatattgtgagatcaatttccccttgttggtccacttatagcccccccaatggacttagatctcctgcatataacacaaccaagtttgatgatcgtggaggctaccccgccatatcgttaaacagtttgccccagcttctcaccttttcaagcagcgcgctgctacaacatacgctggccaagcgtggactcatagggcgtagaacgcacgagctcacattaacgtggatgccccaaaccggcagtgtgggtcacagcgtaccacatcagccttgtggaaccaacccgccaagtgtctgtggatcccgtccccacgattttcagaaccacccacgcgtgattgtaaaacccctcccggtgcactaagacaactcaaaacaaaggggcggctcattctgtggcgcacctataccaagcccactgcgctgtgtgcgacaacgcctatttcacgacgaactccgaaatctagcgccatggaccgcaggcatttacgcaacctggaaggaaatccctgcgcggggactccacctttgccccgtatgtgtgcccacacgtgcatccgcattggtgggagttccccttacagcgattacatgaggtcgggcttcgcataatcatcgtcggacgccaaacgtctttccgaattacaatgcggcacaagcgggcttaaatgaaaagtctgtgcccacgtttacaacctggggccttaaccaatgtttcacctggtcggagcatttcactcgcgacccacttcacgagatcacactgcagacattaatcttagcccatgagccatcagtgaacacactccgatcatgacatccacacatcctgagcgccactcacgtgcgcacagcgatggtcgccaccacacatatcaactcaccgcaacacaatgctacctcgaggttcccacaacgacaccgcgctcgttataacacacacgagtgcaccagcagacccatcatgacaagcacgacccatgttcct

SEQ ID NO: 533054 - DNA, 205 bp, Homo sapiens
aatatgggatatttaattagtcacacgtcataaaaacagacatggccgggcatggtggcccatgagtgtaatcctagcactctgggagaccaaggcaggaggatcgacttgagcccaggagttcgagaccctggcaacatagtgagaccctgtctctacaaaaaaattataaaattaggtgtggtggtgcgtgtttgtagttcca

SEQ ID NO: 533055 - DNA, 950 bp, Homo sapiens
gatctccatcttagtcgattcgcggaacgggggtcatcgggtgtctgcgccggagcctctcgaagggtgccggaaggactacatctagggtcgtatcacgggactcgtgctcgtgcgtggtaacctgtactccagttgaaccaagatacagtagtcatcgaagggagttgagctccgtggaggctaggtatatcctctcgcgaggaaggtaggtataggacccagtagagatatggcatgctggatctcggcgacattgctggggcagcccttggtgtgggcgaatcccagcctgagagctgcctcggctggtatgtgtccttagcctacgttgagattgactgcggatgcctcgcacgaatgctttcgtatagaagatgcgtctgattctattggtgagtacaattctatgtactaacacgtctacactcgaggaacaatcggtgtatgccacatgctagttgaaggcatgcatttattctgaattgcatggaattgttgctagtacgtaaagtagtagaagtaatgggctacaatctgggtacaattggtggtattattgaactagggaatacgaggaagacgttattaaacttgattgacgggaggatcgggttaatatggagggtgctagttgaaaaatgcggttacattcgatcatgttcaacatacttatggaagggaatacagtgtgaaactttttgctagtgaaacgattggttggattatcatagggcagggttgaataagttacgtaattggggaatggtaatggatcatatagcaagctcgtgtgggtttagctttggttagggtttaaacggggaggtatgggagacctggacaacaatggtcattgtggacaggggtcaattcagaagggtagaggaaggtgatttgtgcccctggggtgtgcaccgacgaagatactcaattctggagccaccagg

SEQ ID NO: 533056 - DNA, 485 bp, Homo sapiens
ggcctatttacaccttgtctaggcaggaaccaatgtagcatctgacatcgtatggaggagagtctcacgtgtcgtccctacagtgtataggaccaagctgtgccctgaacaccttgggaccaggttgtcaggatctcctgaggaggtagtcacaggcgcacgtcctcgagataggcagggtagactttctaacaaatctgagagctgtctcggctattcagggttcacacatgtaatgtaggatgtcatggttgataagagggatgtaattctactctgctattagagatgtgctgtcaattatccttcaactttctcaacaaactatactatgttgatgaggtacaacatcagtatatctaggtcgtgaatagtgtagcgattttaagaggcctagtggacaacttgttcaactacctatctttagctaatttaaccactgtacagaccaatgggtcattagagacggtgcatagcagtgttcc

SEQ ID NO: 533057 - DNA, 635 bp, Homo sapiens
  misc_feature (6)..(6): n is a, c, g, or t
  misc_feature (111)..(111): n is a, c, g, or t
  misc_feature (113)..(113): n is a, c, g, or t
  misc_feature (126)..(126): n is a, c, g, or t
  misc_feature (128)..(128): n is a, c, g, or t
  misc_feature (137)..(138): n is a, c, g, or t
  misc_feature (175)..(175): n is a, c, g, or t
  misc_feature (203)..(204): n is a, c, g, or t
  misc_feature (216)..(217): n is a, c, g, or t
  misc_feature (238)..(238): n is a, c, g, or t
  misc_feature (264)..(264): n is a, c, g, or t
  misc_feature (267)..(267): n is a, c, g, or t
  misc_feature (284)..(284): n is a, c, g, or t
  misc_feature (299)..(299): n is a, c, g, or t
  misc_feature (340)..(341): n is a, c, g, or t
  misc_feature (351)..(351): n is a, c, g, or t
  misc_feature (366)..(366): n is a, c, g, or t
  misc_feature (428)..(428): n is a, c, g, or t
  misc_feature (453)..(453): n is a, c, g, or t
  misc_feature (461)..(461): n is a, c, g, or t
  misc_feature (565)..(565): n is a, c, g, or t
  misc_feature (582)..(582): n is a, c, g, or t
actaanaacaaaaggtagcggaacaagcaccccatcgaaaaggctccttccggtttgatcctgaaggccaccatcctctgcctcctggcctgggctggccttgctgcagtnancgggtgtacaaanancccttccanntcgtcatccaaaataaaaataccttttaacagctggnaaaagccaatgccgggaaacccaaaaannccaccttcatanntgctccaattcaagccaaaanatcccctttggataaaaaagccctanaanaccaactggtgctaatngctgcaaaaattganaaagaaaaaaaattgagggccgcaatggtcgggattcttgnnaaattcttgngcttccgtatatatngcatgcacagtgagctatggggcgttgtccattgggccaccgtcctctccccaacggctttntttggcacccttgcctctctctatnttggagcnttggaacacacaatgataagctacaggcaatcctgggtgttccttggaaggacaagaactgcacctcccggctggatgcgcacaaggtcctgtctgccctgcangctgtacagggcctgcnagtggcccagggcagggctgatagccaggcccagctgctgctgtccacggtgg

SEQ ID NO: 533058 - DNA, 465 bp, Homo sapiens
gaacatgatgtggcccatgcacaccccactgctgctgctgactgccttgatggtggccgtggccgggagtgcctcggcccaatctaggaccttggcaggtggcatccatgccacagacctcaatgacaagagtgtgcagcgtgccctggactttgccatcagcgagtacaacaaggtcattaataaggatgagtactacagccgccctctgcaggtgatggctgcctaccagcagatcgtgggtggggtgaactactacttcaatgtgaagttcggtcgaaccacatgcaccaagtcccagcccaacttggacaactgtcccttcaatgaccagccaaaactgaaagaggaagagttctgctctttccagatcaatgaagttccctgggaggataaaatttccattctgaactacaagtgccggaaagtctaggggtctgtgcaaggcctgtcacactgaccacc

SEQ ID NO: 533059 - DNA, 862 bp, Homo sapiens
gtgctctttttacttgttttgttttggctttgtttctttgttggtttttctgtttcttgtgtccttttatctctttttttgttttttgttgttcagtgtgtttcgttttttttggtgttgtgttctttcgtctctggtgtcttttgtcttcctttctctcttccttcgttttctgttcccctctgtggctcttgtgtttcacttgtgtttactgtctctgttattcctcttcttttctttgtgtgtgttattgtctatggttgtctcttttttgttgtctcttgtgttggttctttttcctttcctttttctttcgtttgtttattcccttgttttttatttgtgttttttttagtcatacctcttgcttctcgcctactccttttctctaccctactgcctgctgctactcgttatcctttgtatgcctctgtctgctgctgtatgcagccttctgcgttgcgtatttctggatctccttccctcctttctcgtccttaatcatgtatatgtttggccttagtcaatgtctatgcccgtcacataactagcctgatggcaccagaggtcctctactagggaagctagctgggagcttggaaacctggtctcttgtatttctaatacctggtttcttacaggtggttgtctggggtgggtggagtggcgacaggatagtagtctgaaggactatgctaaatgtaggaagtaagtcagggcgggctttgagaatgtgggtacccatatccttactaggcaaaaagtcatggctatggtgatccttttgggacacaacagcttaacgagatgaggatggacgaaaaggacggacaagcttttcatctgcggcgcttataagtcc

SEQ ID NO: 533060 - DNA, 910 bp, Homo sapiens
  misc_feature (10)..(10): n is a, c, g, or t
  misc_feature (79)..(79): n is a, c, g, or t
  misc_feature (122)..(122): n is a, c, g, or t
  misc_feature (169)..(169): n is a, c, g, or t
  misc_feature (229)..(229): n is a, c, g, or t
  misc_feature (236)..(236): n is a, c, g, or t
  misc_feature (271)..(271): n is a, c, g, or t
  misc_feature (278)..(278): n is a, c, g, or t
  misc_feature (286)..(286): n is a, c, g, or t
  misc_feature (305)..(305): n is a, c, g, or t
  misc_feature (368)..(368): n is a, c, g, or t
  misc_feature (371)..(371): n is a, c, g, or t
  misc_feature (699)..(699): n is a, c, g, or t
  misc_feature (708)..(708): n is a, c, g, or t
  misc_feature (720)..(720): n is a, c, g, or t
  misc_feature (722)..(722): n is a, c, g, or t
  misc_feature (725)..(725): n is a, c, g, or t
  misc_feature (754)..(754): n is a, c, g, or t
  misc_feature (757)..(757): n is a, c, g, or t
  misc_feature (790)..(790): n is a, c, g, or t
  misc_feature (818)..(818): n is a, c, g, or t
  misc_feature (843)..(843): n is a, c, g, or t
  misc_feature (883)..(883): n is a, c, g, or t
gatgcctagngaaatcatcaccctacatttgggccagttcggcaatcagattgggttcgagttctgtaaacagctgtgngccgagcatgtgtatcatccccgagggcatcgtggaggagttngccaccgagggcactgaccgcaaggacgtctttttctaccaggcagncgatgagcactacatcccccgggccgtgctgctggacttggaaccccgggtgatccactncatcctnaactccccctatgccaagctctacaacccagagancatcttnctgtcggnacatgtagtaggagctgtnaacaactgggccagcggattctcccagggagaaaagatccattaggtcatttttgacatcatngancgggaggcatatgtgtagtgacagtctagagggctttgtgctgtttcactccattgctggggggacaggctctggactgggttcctacctcttagtactggctgaatttctggtatcttaagaagctggtgtagttatactcagtgtttcccaaccaggtcgatgattagcgatgtggtggtcctagccttacaattcactcctcatactcaagaggctgacgcagaatgcagactgtgtggtggtgctggacaacacagccctgaaccgttttgccacagacctcctgcacatccagaacccatccttctcccagatcaaccagctngtgtctacnatcatgtcagcnancancaccaccctgcgctaccctggctacatgnacnatgacctcatcggcctcatcgcctcgctcattnccaccccacggctccacttcctcatgancggctacacccctctcactacggancagtcagtggccagcgtgaggaataccacggtccttgatntcatgaggcggtgctgcagccaataac

SEQ ID NO: 533061 - DNA, 1070 bp, Homo sapiens
  misc_feature (136)..(136): n is a, c, g, or t
  misc_feature (310)..(310): n is a, c, g, or t
  misc_feature (313)..(313): n is a, c, g, or t
  misc_feature (315)..(315): n is a, c, g, or t
  misc_feature (363)..(363): n is a, c, g, or t
  misc_feature (365)..(365): n is a, c, g, or t
  misc_feature (386)..(386): n is a, c, g, or t
  misc_feature (817)..(817): n is a, c, g, or t
ccccagtgggtttttttaaagtagattttaacaaaaacggggaaataatgcattctgtggaaacagtcccaccgcctcctccattggaacggtatctccctgccatcagttgtctgtcgccttctccgcgcttcantaaccccggcattttagtggtttcacctgaggcaaaagggaggggacaaagggccctgccacgtcccgatgcctcctgctctctggaggtactgagacagggtgctgatgggaaggaggggagcctttggggggccacccgggcctggacctatgcagggaggccacgtcccanccnanctcttgtttctgggtccctgctcccctttgggggtgtgtgtgtgtgtntnaattttctttatggaaaaatngacaaaaaaaaattagacgagagaggtattaaactggcaataaatgtggccccatggtggccccgggcttcaagaaaacaaataaaaaacaaaaaaaaaacaaaacattttggtgggccaggcatatggcgcctagggagaacggttcttatagagagacaatttgggtgggggcgccggagggcccacaagataaagacactgggaacacttgggctccaaacaggggaggtcccaaaagggcgacaccccgggggcacagagaaacaagagcggcgggggaaattatcacaacccaaataaaacaaaagagcgcgcggggcgggagacacaccccgggccgcgtgtctagcagacacaatattcccagagaaggtggaagcccagagaggggaccaaacaagacgcggggagaccacacaacaccacgngggagaggacaccaaaagcggagaagtccccggagaaattacaacgaaaatattaaaggccccgcacggcgcgggggtgggagaacccacacaagcgggagacgacagacgaggtatacgccaaccagcgcatcagacaaaagatgacacgatgacgacgtgcgggctaacgacactgatggagacgacgagcccacccagaatacgaagagcagacacgacacacagctcggcatcggacagagcatacagc

SEQ ID NO: 533062 - DNA, 351 bp, Homo sapiens
cctaagagtttcaccaattcctattttgagtgcgtctatcaatagtagttaccacatttgccgaaaggcctcatcaacacctatggatacaatcacatgccttatcttcttagatggattcatatggtgtagtatttaataggctttctaattgaaccagttgcaatcttaaattccacttggtcatggtttattattttctcaatgtggttttgtattatttgctaatatttaacataactaatttgaatcaatataattaacactgtaatttttcattttggtggtcttttatcacattttgcttttaacttttatttatgagatggagttttgctcgttgcccaggct

SEQ ID NO: 533063 - DNA, 594 bp, Homo sapiens
aaatgacccgcaaattccgtcctctctcgcagcgaaaacgcccccgcgggcgccgaccccgccgccacccactccactaggccacaacgtcagaaccgcacctcgcccgcggtccgcggaagccgataaataacacgatccgggaacccgaaccagataccgaaccgggagtcctcccagcgtctaccgacgagtataccattcactatgtgccggccgacacctccgcagaggacccctaaacagacagcctaattaacctcccgaagtccgagcacctcacagcgctattcaaacagtccggtgcaactacggctacagtcgcccttcgcgcgaaaccgccacttgtctataaccttatataatacatgagttggaagtacaaagcgcaaagttcggggcgttcaacgagcgagtcaatctataccaaccgtgccgtgtctatcgtttgtcccttagctgggaaattcgctgcgttagtcgtaccaacgaactggttaatgtgaattttccgtggttgtttgggttgctgattaacctctacgcccgatagtccactactgaaccctcgttacctacttgtccaccactatc

SEQ ID NO: 533064 - DNA, 905 bp, Homo sapiens
tacctgggcgttttctcggtgccccaatctcgtggtacactattttgggtattccccaacaatcacccgggtttctctcaccattactggggcttgtcaccaccccgatataacccgctggccccccgagacataggtcaagcctccgatgtgttcccacacgagtgtcgaatttgcaccgcgttttacacacacgagtccacagcttcctccgacagttccaccgaggagcaggtgccccccatatgtacacgtggtttctggataaagccccgcgttctacaccctatggcgcccacaaatggtcctgaaaaaaacagggcatctctaatacttttgtcccaccaaaagaaatgttaatttttttttaaaaaagtaataattactcgcccaatatcttaaggcgttacctctaaaaacaccaccactccacacgcatcaatctcgcgccccccaaaccaattttgtatttgttggtcaaagacaccacccccctcaacgttggccgtccctctggtggacccatcctttattgcgagagcacaaacaaaaactcacctctgacaattcttctgtgcaaaacatctgtttttagaacccacccccacgtattcggggtcctatggaagcgacagatttcctcaataattccattgaaggcaccccctcttttcaattggtttgtcgtctgtaggctgctcccccccgggtgtgttcgcggccatgttcccacccccgagtcttacgctctgcccagaactctggtgggaccaaaatttcgtacccacccgcaggtcgctgtttccccccgcgctaaatgcggctggcactaacaactgatgtttcggtgaaatatttcgggcttttggaaagaaaacatttaaccaaattcgcccaacaaaaca

SEQ ID NO: 533065 - DNA, 176 bp, Homo sapiens
  misc_feature (38)..(38): n is a, c, g, or t
  misc_feature (54)..(54): n is a, c, g, or t
  misc_feature (74)..(75): n is a, c, g, or t
  misc_feature (84)..(84): n is a, c, g, or t
ccccctccgccggggccgccactatctggggttgttgnggaggatctccagccngcaggggcaggaggtgatgnnctgccgggngtagcaggcccccacccttggcgaagctgatgcggacgctgttggggtcgtagggccgtcggcggcgtcgggctcgggcgcgtgctgcaggc

SEQ ID NO: 533066 - DNA, 168 bp, Homo sapiens
gggcagcaggcgcaccagccctccgaaatagcagaacgacgcccgcgagttcgtgcgacctgtacgtcccgcggaaaatgctccgctagcaaatcgcatcatccgtgcccaaggaccacgcatccatccagatgaaccgtggcccaggttgacaaggtcacaggcaag

SEQ ID NO: 533067 - DNA, 213 bp, Homo sapiens
aactattacagcatacactattacagcataaactattacagcataaactattacagcataaactattacagcataaactatttgattaagtgcaacatgattttttttttttttttttaatatttgacattaaaatttttattttgtgaaacaatgcaagcgatttaaaatccccacatcctatttgattaagtgcaacatgaatagtttatg

SEQ ID NO: 533068 - DNA, 468 bp, Homo sapiens
  misc_feature (2)..(2): n is a, c, g, or t
cntgaggtgtgttctcaagtcatatattataattcatttcactcaaagtatatgattaaagctcattcaaagccctaagagttgggaatgaaggaagaattgtaggatgttctgctgtgccacaagacttaatttataccatttattagtcttaccaagtacattgaaaggaaaaagttgttgggggccaggcacgatggcttacatctgtgatcccagcactttgggaggctgagtggggcggatcacttgaggtcaggaattcgagaccagcctggccaacatggtgaaaccccgccttattaaaaatacaaaaaattagccagctgcagtgacatgaacctataatcccagctattcaggaggctgaggcaggaggatcgcttgaacccaggaggtggaggttgcattgagctgagatcatgccattgcactccagcctgggcgatagagcgagactctggctca

SEQ ID NO: 533069 - DNA, 118 bp, Homo sapiens
gagtagatggtccatggacaaagaaggaagagtaagggcctccttcctcccctgcctgcagctcgcttccacctggcacgtgcctgctgcttccgtgagagcccggacctctcacctc

SEQ ID NO: 533070 - DNA, 766 bp, Homo sapiens
  misc_feature (562)..(562): n is a, c, g, or t
  misc_feature (569)..(571): n is a, c, g, or t
  misc_feature (578)..(578): n is a, c, g, or t
  misc_feature (592)..(592): n is a, c, g, or t
  misc_feature (622)..(622): n is a, c, g, or t
  misc_feature (627)..(627): n is a, c, g, or t
  misc_feature (635)..(635): n is a, c, g, or t
  misc_feature (639)..(639): n is a, c, g, or t
  misc_feature (642)..(642): n is a, c, g, or t
  misc_feature (648)..(648): n is a, c, g, or t
  misc_feature (664)..(664): n is a, c, g, or t
  misc_feature (675)..(675): n is a, c, g, or t
tcgttattattaaaaagggaaaaaaacatgggttctggaattgaaaaaaaagaatatgacccccattcttgcgtcttagtttgggttctttttggaactgtctcaaaccttagtggggaaagtgcccttacccccagtttcttttcccaaaggttccgcctgctggatacgtctcctgtctcaaagtcaaaaggtttggagcaggtttcctgtttccatctggggttttagtaaccaattcaataatgcggctagaaacccctcctttcaagccaccagtttcctaattggtgtccctgctgcagtgggggatgaaaacacattccctttctcccacaacctcttgatgttgcgtcacccttcagcaggaacaggaagatccgaggctcccggctttgtaggttttgcgctttttgttccctcaattgcactggtatactgctccagtctgctgtcaatcttggagactattgctgcttgatgggtcgatttgacaccactgcttttctgcacagacttattcaaaaattctgctcgctcttctatcttgagagatgaaccnttaggannnaaacacntgaatggtttcttntcatctgacaagccatcttctggcatcttntggcntttctcancagnttntgctcntcgcctttcaatctcntccttagcctnctcttctcttcctcctctctgagttttcgatcggcttcgtcttgcttccttctctgatcctcgtgccgaattcctgcagcacgggggatcc

SEQ ID NO: 533071 - DNA, 935 bp, Homo sapiens
ttccggacaaggcaatgctcaaccaagaaccagtggcaatgaatatcgggatcccgtgacaatgacgcacaacttttgagccgtaggggcaaccaactgcaagtgcgcaaaggttgtaccgtgttacaagtgtgccctatagttgtcgtacacgaactaaaagttatcctttggtggtagaatgaattcaaaaagaagcgttttaaaaagttcacacacggcctaaggaattgtctagtttctcgacccaggttttttggcgtactttctggccactccattctggtgtgccaacatttgggccacaaatccaccaaaccgctctttggtgaactgtgtgtgccgtccgccacttttgggttttgtccgtggaagacccttgaggccgcttaaagaagtccgtcctatctttgggggaaacccaacataatttgttagggggttttctttccctgaggcgccccccgcgccggcccctgttatgtgaagaaaatataatgggaattatagcacgcaaaataaatccacgctcacactgtgctgcgaaacaatatgtgtgaaagtaaataatttggggtgtagatttattaaacccccgtcacggcgccaaaaatgtttttaaaaaaataattaaattctataatagtttaactccacccctttaatgaatgttcgccaacacaatggccaactgaatttgtggagattttaaattgcaccaatgtgtcacttttatatcactactcacttggaaaaccacccttgaccaccacacccacccacttcgaatataggaattgtgggtaattatagcttgttaacccccggtaattaattctgctatattgttaattttcccccctttatttggaaaaagccccccttttaatttttttttcccccaaaaaaacccacccttgggttccgaaaaaaaa

SEQ ID NO: 533072 - DNA, 250 bp, Homo sapiens
tagaggatccctcccgactagcgcgacaggaggactggtcaggaggagacttagggcaggaggacgggtcagtgaggagttagggcaggaggactggtcagtggaggagttaggggaggaggactggtcagggaggagttaggggaggaggactggtcagggaggagttaggggaggaggacgggtcagggaggagtgagggcttgtcgggctagtcggggaggtcgggggctgacgggctagtcggggg

SEQ ID NO: 533073 - DNA, 199 bp, Homo sapiens
gactctaaggatcagcccacagagagaggatagcacatgaagagtgcggaaaacaaagatccaaagacctgctgacgagactgaagctgactaattggtctgagactgacttctccccatccctttcttaaatatccaaagactgtactggccggtgtcattttatttttttcccctcctgacaaatattttagaagca

SEQ ID NO: 533074 - DNA, 360 bp, Homo sapiens
ttcctctaccgcgccatctttttttttctctctgtctgtcccgtgggaatttagtcacttcagaggctttttttccccacaatttggaacttcctttggatttgatcaagtcatatagagttgatcaaatccagtgggaaaaagaccgaaaaaacaacaaaaacagaaacaaacaacaacaaaacagttaagcaaaacaaatgatcacacagtttatatgattactgagtgctctgatggtaaggagaaattaagaccagctggttgttaatctttagccaaagcaaaccacagttcagttacttacctatgggtgggtctcaggctgataattgctctataccatcctagaagcgggtt

SEQ ID NO: 533075 - DNA, 413 bp, Homo sapiens
  misc_feature (14)..(14): n is a, c, g, or t
  misc_feature (53)..(53): n is a, c, g, or t
  misc_feature (125)..(125): n is a, c, g, or t
  misc_feature (214)..(214): n is a, c, g, or t
  misc_feature (250)..(250): n is a, c, g, or t
  misc_feature (264)..(264): n is a, c, g, or t
  misc_feature (296)..(296): n is a, c, g, or t
  misc_feature (344)..(344): n is a, c, g, or t
  misc_feature (390)..(390): n is a, c, g, or t
  misc_feature (395)..(396): n is a, c, g, or t
tgcgtgaacggggncgacgccccaccccctgtggaagtggattaagatccaancccaagggcaagggcattctgggaaatgccatcaagtggaactttcccaagttccttattgacaaaaacggntgggtggttaagcgcttcggacccatggaggagcccctggttataaaaaaggacctgcccccctatttttagctccccaagtgtgtggncccgcccgagcccctgcccacgcccttggagccttnccccggcacttatnacggcctgcctgcaaacctgttggtggggcanacccgaaaattcagggtgcccccccccggaggaaggttccatggcctnttggggttgggttggggcccccccccctgggtaccttgtgggaatnaacanncaaattagcctgttgga

SEQ ID NO: 533076 - DNA, 260 bp, Homo sapiens
agtaattattaaaagactttaccatggtgggtaaatacttgggctcagacttatctgtattttctttctttctttttttttttaaaaaaacttttaggttcagggctacaagtacagggtggttacatagataaactggtgtcacaagggttggtggcacagattatttcatcacccaggtatggagcctagtacccattagttatttttccggatcctctccaccttccaccctccaaaaggccccagggtggagagag

SEQ ID NO: 533077 - DNA, 1417 bp, Homo sapiens
catggaaacaagactaccgaaagtggtctgaatttcatgaagaccaagtggaccataactcttacgtaagaccacccatgtccataatgaaacggtgtagagactatgatgaaagagggttattgtgtatgagaggagtacatgtgtccttttgactctactggtaagtgatccagtagcttgtagagaggatgtgaagtcttcctggttgatgctgcgctttccgcgagctacatgccgtcctgttgttgataggaccagcctcctccatggagcgtcctcgccctaactccagcgcaggttctttgcaccgtgctagcctggtgattgcgtcaatggcacgcctcgagtgtcgcaccggtgcgaagcggtcgctagttcgtccaatccccgacgttcatcccactacgctgattcaaccagcatagattattttgcgttaatctcttctctgggtattattgatcaaggtagacgaacgctaatcttgccgagctttccactgtccctgtgtggacggagtcgccatttcgtgggtcacttgggacatgacttccctgtcaccagatagcagtcttgcttgatcccaaggatgcgtgttcacgaagtcacatgtctcagggtggtcccactctggtgcatgtgtcccttctatccgacggatctcatctctgtctcccctaggcatctcttaaccccggtctcctcggtatgtaaatactgtggcaaacgtataatttatggaggatcacatttaaccggcggaggcaattaacaattgttgtagcaaacctattgaccctggggccataaccggaactcaccgatgaaagggccctcccaagggcaggtaaggacaggagagccagcggattttgccccaggaaacccaatagtggttaaattccggaagcggacaacagaaggttgcccgattggcccaaccacacaagggtgcggccctaggaccgtgtggcacgtacgtcgaacggtgaaacctgttccaaggggtggcacttacttggagaaatacaagggcgagccacacgaggaagctgggatacatggaatgtccccaactttaaataggccacggtgaaatgaaggggaccttaggacaagggggaagctcccaagtaatttcgaccgtaatacagtcaaccggatcgggaggtcaatggatgacagcccctgggcgaggtttccactaccgacagcaactgggacgtttggatatggaaataagggccgcagatgttattaaacaatatacacaacaaacagcgacgcgagggcttaccagcaaaatgaagcgggtccaccctcgtgtggccacagatgatatacaacaccaccggggacttgagccctatgaacaaaaggatagccaaccggacaaatcgaaacagccatctca

SEQ ID NO: 533078 - DNA, 242 bp, Homo sapiens
cattggtcgagagaaattagttgtggctatgaaaatgattgaggatactactataagagatcaggttcgtcctttcgatgttgtgtatgtgttatcatctgtctggaggttagtttgattagtcattgctgggtggtgactagccggtcgcttgatgagatatttggaggtggggatcaatagagggggaaatagaatgatcagtactgcggcgggtaggcctaatttctctcggaccaatg

SEQ ID NO: 533079 - DNA, 602 bp, Homo sapiens
tgggcgtcccaccacgcatagcatggaatggcaggaagggacaaaagcctgttccatgagaccctgggaggaccccagtgcaggtagagcccgcctgcctccaccctttccaacgagccatcttggtaactgggaacaaacacaccccaccccgtttttccttaaaagaggccttaatccccgagcccccgctgccagggcacgagtggaggagggggcaccagctgtgccaagccctggccccactgcgtgtgtccatcacgaatgtgactcccatgaacatgccagcacgggaacaggagtgcttgctgcagagaatgcagccccagagcagccggcgctccttaggctgtgtgcagcatggtaggggttaaactgggctgagctgttcccaggtacaactgaggctcggcggaggggcaacggacaggcttggcctctccttcactgtccacagggccttgggttcccctgagctgtccagaccccaccatctcccggagcccatggaggtggccattgccagaagcctgtgggtatcctttctagcttgggggattaaccaaacaaaattctccactccttttacctcttgagtagac

SEQ ID NO: 533080 - DNA, 177 bp, Homo sapiens
gagtaaggcacatgccacacaccaaacttgtatgtgtgtgtgtgcagagatggggggtgtgtgtgtgtgtgtgtgtgtgtgtgtgcgcgtgtgtgtgtgtaccacattttctttaacctgtcattgatgggcatttagattgattccgtgactttgctattgataatagtgcccagt

SEQ ID NO: 533081 - DNA, 358 bp, Homo sapiens
tcatataccacacaacatagataacagacattccataagtcttataaagatgtaaaatcgaaagtattagccattaattcaaactacccctatcattaaatcacgttcaatagggaggagggagataaaccacagagaaaaatccaagagactagtacgaaggcttaaagaacagattgcttgtagagtgagctttagtaggatggaatgttatatccatttggacttctcagatttgattcctccttggctttacccacatgaaactgagccagctttcctacacatcactgtaacccatgtttacgacatcaactcaccacacgtatttcgctaacttgtctggcccagcctcagt

SEQ ID NO: 533082 - DNA, 1012 bp, Homo sapiens
ggtagccgcccgcggagaatcgaagccggccgggcccccgaagctccctcctcgcgtccctcggtgtccctccgcgggccggggcaatgcgagtggcccggaaggaccgcggcgtagggcgggctggctcgctgtttgtgcaggccgccggaggccgggccgcccggacaaggggccgggagggaaggttggcaaaaaacccgggttggggagaagccggccggaagggtcaataaacgaccccgggaagagacctgaagggggggcgtcacccaaggagaagctgctttgtgggggtcacacattttgtgttaacaacctccggggcccacgagaagaaaaggggcgggacaaaaaacaggcctgtgggagggcggacatccaatgaaaggcacaacgtccgacgtggggacccccaggatggggattacccctccaaggtggcaaggtgacacgcccacgagtacgagggcacactaccaaattgtctcttaagaagacatttgcgccgtgttgccaaagaagagccaaaaacccacgtgtttggtctggcacacttttgtctcacaacaccgtgtggcagccactacggtgcacctgtggcgatgactttataccctttcacaattgttttatagcaacggggtgagcaaatgcgcacttgtggatgacaccaccccgtgggtcttcgtgtacgtgtgttgcccacacgagacgagggctctttgagaggaaggtctcatccatttagaagggacacgagcgacaagcgctgtgttgggacaacagaggcttcaacacgggtatcgacggctccccggctgtgagttcctggacacactcactggggtgagaaccactccgtaaccagaggttgattattatcagcgggaattggtacttccagcagtcttgtgaagacactgtccaacacagcgggcacgcgcctgcgtagttggggccgacactgttgggcgtgacacacgggggcgaccccacacgcccatgacga

SEQ ID NO: 533083 - DNA, 183 bp, Homo sapiens
acgcgcacgctggccaaacacaatagcaggtgtgctagttgacaagaatcctgggttactaggtgtcttagcagaagcgtgattgcatccaaagcaaatgagcaccgaaggttatgttatcttctaaagctgtataatacgagcacatgctctcgtgaagtcagattgaccaagtatagggaa

SEQ ID NO: 533084 - DNA, 330 bp, Homo sapiens
cggatcgaaaagattcagaaaaaactggatggttgcatctgtactgaacacgtatggacttttttttgcttgtcactgttccctaagcaatacagtataatagtaatttacatagcatttacgttgcattaggtattataagtaatctcgagattatttaaagcatgtgggagatagagccaggcatggggcctgtagtcccagctacttgggaggctgaggtgggacaatcacttgagcccgggagttcaaggctgtagtgcaccatgattgtgtctgtgaatagccactgcacttcaggttgggcaatgaggagactctgcctcttta

SEQ ID NO: 533085 - DNA, 363 bp, Homo sapiens
tcattaacatagaatatctttccatttttgtgtgttacttttttatttctttttcagattaatcacttttggcatataaaaatacgtactaatatctgtatattgatgttgtatcccatgatttactgaatttattagttctcatcattttttatttgctgcagtctttattttttccaaatataagattatatatgcatataaggataatttgactccttcctttccaatttggacgctcattatttctttatcttgtctgattgctctagctagaacttccagtactatgctgaataacagcagtgaaactgggcatccttgtcatgttctcaatcttagagaaaaggttttcagtttttc

SEQ ID NO: 533086 - DNA, 167 bp, Homo sapiens
gttttcaaatctttcaaccgccgcagccccactcgttttgtgcttttgcgcctttcctccctcccgcggctttggaggccggttccggcccggaaacccggaacctcaagaaggcgggtcacctcttattttccttggaggcccttagagttgcccggaagagaaga

SEQ ID NO: 533087 - DNA, 235 bp, Homo sapiens
ataatttatggatagactgtagcatacaaagcaaagcgaaagaaaaagaaacaaaataagtctcatgaaacaaaatgtttggctataagccaaaataacctaaattttatttcttaattagataatatacacaatatatctgcactcagttatatataagattaagagtgttcatgcactgttcccactggaacatatcaaaactgattttatttcaggtcatcaattgtcacat

SEQ ID NO: 533088 - DNA, 1533 bp, Homo sapiens
  misc_feature (115)..(115): n is a, c, g, or t
  misc_feature (128)..(128): n is a, c, g, or t
  misc_feature (149)..(149): n is a, c, g, or t
  misc_feature (307)..(307): n is a, c, g, or t
  misc_feature (317)..(317): n is a, c, g, or t
  misc_feature (340)..(340): n is a, c, g, or t
  misc_feature (1533)..(1533): n is a, c, g, or t
ggcttgtgctgcagccggtgtctcgagatagatccctgatcaagttccgagccgatatttgtggcgagtactacaaccgacggcaacgattcgacactgaggtcaggtgggcaanacatgagactctnatgccaatgccacgtgcgcantctgaagggatgtgagagccagtagagaatatgtctcgatgataggaggtctggagggaaagactgaggacaatgggaccctctaatcaagtagggccggggagcaactttcacatgagcgagtgcagagctgtgaaccggtgtgcagtctgcgctantctactcgcnaaggaatcactcactgccctagntgcgaaagaattccgcaaggaacctaggctatcgttagatactggtacacgtaatgcgattggtaatagacgggcatagggaacaactagcagaccagtgattccataagacacacatggagtcatgggagcgaaccaaatgtctacgcgctgtgaacgagccgtggtgagtccgatgcatgtaggtagagcagtctcggggtgctcagtaggagagtgtctgacaggtcaagcgtttcttgtcgcgaccgtaaacggtggtcccgaaggcgcagcagacatgcaagtatctaggtgtggtcagcacgttggtgctggtacgcagtacggagttgtagttccgtacaggatagtataatccaaagtccttggtgagtgcccttatgtgctggtctaacattaaatagagtctagataatacatatagaaggacaaattgtataacgcgcaggggcgagccacatataccatgcgagagcgcaggacataaggcgtaacgtaaaccgcaagatggccacgctaggggatcaaggagcccgagaattcccgtgggcccgggaaattggttgtagcaaccaaatggcggtgggaggccctcagggggcggaaacaccgccacataagggtggacacacccgagaattggagaaaacggtcgaaacacgcgccagtgggatagggcaagggtctatgagaatccccgcaggcagaacacagttagaaaggctccttgggagctttgggatcccttaaccagaccaaattcggtgcacacctgaaccaaagcgccttgggcgccttgggcctcctcccaggagtggtctctacccaaacactgggggggggaaatggggaacagtggccccctgggttgggccccaagtggggacaacgggggggtccacaaaccccgggattgtggcgggccaccccttgtggctccagggcaacgggtccaacggggaggataaaactcgtgcgaatgcccccgacgagcgtgacgaaagactctccggggcaaagggggcaaggcaaagtgcgcgcacgaagctacccgaacgctggggtgacagcaaaacccccgcagaggtcttgaaggatactcaccaaacagacgaacgccgtgtcgaccacaagcgggaataaccagaccacacaatggtcggcagctcgggcagagacggtggctcagn

SEQ ID NO: 533089 - DNA, 472 bp, Homo sapiens
agagtagcactttaccagcaaccgaggttagcaaccactgatgccatacaggaagtgtccatatgtaatggactgtttcttccatgcactcaatctacccagaggagttgataaactcagtgaggactgcagtagtccctatactacacaactgtaccggccaagcctggtccccttcttgttgggcactagtgtatgggcggagaaaatccagcttgtacttgcttgatgacgcagaggtcaatgtttgcttccggagcccaaggtcgtagaagctgccagctgcgatggctaacgcacaccagatacttggcttcctcctccatgtctggcctaaacttatcttcaaatacagacattagctgccacggagccagaacccatggtgacataaggcaacttatcagttgatccatgcggatagatgctgtagaggtagagggccaaatacatctactcaccctacaactag

SEQ ID NO: 533090 - DNA, 106 bp, Homo sapiens
acgacagacgcaaacatattttagggaggcaagtcaaccttttaagacaaatcatgaccaggggataagaattggcattgacccgaattatatgtccaggaattgt

SEQ ID NO: 533091 - DNA, 894 bp, Homo sapiens
tctttttttgagcaagaagattaagagaacgagacaggagatcacgaacatacctgctccgccctgttgccctatttacatatagctctgcccaaatgcgtccccccgaggcttacccgccggttctcaggcgcccggtcttgaccgccaattttttctggaaaaaggcgtagccccctcttaaatcgccaagggtcaaaaaactgtgtcgcgcaattttacggatccttaagcccacatctacgccaattttggaccctttaagcgttccttaggaaagcaaaaattagcggttttatcacaccacccggctgtcaatcataaaccttctctccccggggaacacagtcgtgtaaaccgttgtgggagaatggcctccggcccccgtttatccccccacattagggccgccaactttttagatttaaaaggaacgggtcattttcagcgtttaagccattggcgttttacaaagtggtagggggtcgaaaatcatttatgccgcggccttctcttttaaagagaggattatacaccagaggtagcttcctataaaccccttgacactcccaagccccgggcaggattggcgcaccttaaacccgtgcatgccgcattgctatctcgccgaggtcatcaggggaaagacatctattggggcgggggacgggtgaacccaccttggggagagaagattaacagatttgcgaagtggcgatactcggcgagaagcagagcagaatatcggggagaggtacgatagaaagagaattagaggaatcattgcggagagttagaagagcttaataccaccgctcttcttgcaaggataaaacagatagacaacatttcaacccgcaattggcccaaaaaaaaacccaaccaaaaacaaaa

SEQ ID NO: 533092 - DNA, 368 bp, Homo sapiens
  misc_feature (8)..(8): n is a, c, g, or t
  misc_feature (33)..(33): n is a, c, g, or t
  misc_feature (81)..(81): n is a, c, g, or t
  misc_feature (137)..(137): n is a, c, g, or t
aaatccantattttagagtataccctgcctccngcctataaagaaaaagttaaacctgtaaaaccagcccctcagatgggnccctttagccaggtattccctagaagaagagattatccatagaagatgacctgccnctgtgtgtgttattgccccctgaataccctccccgtgggatgagataaggaggtgaaagacagtgactttgatgatcctgacactgtgtaggtctaggctgatgtatgtgattgtgtcttagattttaacaaaaaagtttaaaaactaaaataaataattttgaaaatggaaaaaacttatagattataaggatacaaggatataaataaaataatttgtagagctgtgta

SEQ ID NO: 533093 - DNA, 851 bp, Homo sapiens
aattcggcacgcggaggaagcagaggaggcgggtgtggagattgaagctgggaaagagaaagtttctgccgtgtgagccaatggtgaacccctgccccctgccctccaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggca

SEQ ID NO: 533094 - DNA, 163 bp, Homo sapiens
agacttgcggcacgacaccgcagtcacctgtgcaggttacacctccgccagctgctctcacgcgccgcacgagatcttgtgtggaggtcccgcctctagatgcagcaggtactgtggtggtggcatacgcctgtcatgcagcacctgacacagcttgcagagc

SEQ ID NO: 533095 - DNA, 494 bp, Homo sapiens
aacgatggtcctcagctactcaggaggcaggcatgagtatcgcttgaacctgggactcagaggttgcagtgagccaagattgtggcactgcactccagcctgggtgacacagcgagactctgtctcaaaaaaaaaaaaaaaaagctttttggggggggcccaggggttcacgcctataatcccagcatttggggaggccgaggggggtgcattacctgaggtcaggagttcgagaccagccgggccaacatggtgatacccggtgtctactaaaaatacgaaaattagccagggatgggggtgggtgcctgtagtccaagctactcaggaggctgagataggagaatcgtttgaccctgagaggtccagatccatggcctcagactctccagggatggagcccagcaatctgtttccacagccctccgggtgatgctgagggacactccagggtgaggaccatcgttgagctggggaccatcgtgggggtccga

SEQ ID NO: 533096 - DNA, 908 bp, Homo sapiens
ccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgctctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggtctggtggggggatcctgggggctggcgcatttagggagggctggggggtctctgccccctgaggctgggcaatgaccaatccctgggtgcaggctccggcccctagatgtggccttcctccgggcagtacacgagaaagtcaacatcatcccagtcattggcaaagcggatgctctgatgccccaggaaacccaggccctcaagcagaaggtgtgagtgatgacctctgactttgacccatgtgaagccaaactgatttcagcttagacttctttgatctggaagtggctatctggagcatggtgcatcaggctacattgt

SEQ ID NO: 533097 - DNA, 855 bp, Homo sapiens
  misc_feature (480)..(480): n is a, c, g, or t
  misc_feature (485)..(485): n is a, c, g, or t
  misc_feature (537)..(537): n is a, c, g, or t
  misc_feature (789)..(789): n is a, c, g, or t
tctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccaggtcctgccagagtctgcaggggacagccctcgttttttaagtctttttttttttttttttgggctctattctaagggaccagtaaataatggatcttactctccaaatctccgtgggaatttccacgacagcacagactgactttatacctctcatttcagcggtggtaaaacaccgatttaacacttctaatgagctcaagctcctagggttttggggtttggtttggtggccaacgaggaacacagcctctgggggaatgggtgtcactccaccctcgctttaaaaataagcacatgatggcttgggcnccggnggctcacgccgtgtaatcccagcactttggggaaggctgaggcggggtggantcacctgaggtcgggagttttgagaccagccgggccaacaggggtgaaaccccatcgctactaaaaatataaaaaattagcggggcatgggtggcgcacgcctgtagttccagcatactcaggaggctgaggcaggagaatcgcttgaacccgggagttgaggttgcagtgagctgaaatcgcaccattgcactccagccgtgggcaacaagagcgaaactcttgtctcaaaaaaaaaaaaacagggggggngggtccactcgggcgcggggtggaaatcaaccgcaccaatgtggaaaccctttctctcaaaattta

SEQ ID NO: 533098 - DNA, 265 bp, Homo sapiens
ggacgatcacgttgaccagataggtctttaacctcccagagttgtagccagcactatgacgatagtcttgcgagatcacatatactgacccacatgcaaaggcaggctaaggcggggctcgggtactaccaactcctgccactattccggttacggtcaaactgcccaattacagtctagaaattatccccaccaaacaattagagcccatccacgtattcctcttggacaaatacctattacaatacagacttcgacggtctat

SEQ ID NO: 533099 - DNA, 908 bp, Homo sapiens
gctcacacctgtaatcccagcatttgggagacccaggccagatgagttcaagaccaatctagacaacacagcaaggccacatctctacaaaaaaaatttttaaattagccaaccacgtgtggtggcgcacacctgtagtgttagctactctagaggctaatgccagaggactggagttggaggctgcagtgaactatgactgcaccactgcactccagcctgggtgacaaaacaagattgtctcaaaaaaaaaaaaaagggaaaattttcttgtccccgagttggcctgatcttcccaagttatctccaagaaatagtattttcccatttaacatgaccctccaatcctaacgggatttggatggtttacatcagactggtacttctttggaagagttccacgtttatggaaaccttaaatccttaggccaaaacttatcaagtctcatcttttcaaaagaaaacaacaaatcctacttcggataaagcagttccaccttttagagacatgagcgagacattcgaccgtcttaaaatttgtccccataagtgattttcggcttggcccgttcgtgggcctaaaaagttcaggaaattccctacggaaggtattcccttttcgtagaaggttcgacgggttagttatacaacggcattgaaaaacccaccgggatatccggctattaacctttaagaacgtgtacacacactgtctggcaggaattctagggtggcaacaatgcgcggagtagatttaccgcaacctcccccactggtactgtgcagtgcggttagacccatgttgcgaacgcatcttatgtgtcgggtgaacacatgcgggagggcacgtacccagtgaggggggcaagagcaaaacaccgggcgccaaaatgggggcgtgctgcagt

SEQ ID NO: 533100 - DNA, 357 bp, Homo sapiens
  misc_feature (44)..(44): n is a, c, g, or t
  misc_feature (73)..(73): n is a, c, g, or t
tgggttctcccgaagcctatccatggtttatagattaagaattnatgaggtagctgggcacagtggctcacgnctacgatcacagcacttcgggaggctgaagcaagcagatcacttgaggtcaggagtttgagaccagcctggccaacatggtgaaaccctgtctctactaaaaatacaaaaagtagccagtcgtgatgacaggcacctgtaatcccagctactcgggaggctgaggcatgagaattgcttggacccgggaggcggaggttgcagtgagcctagatcatgccactgcactccaacctgggcagcagagcaagactctgtctgcaaaaggggtaaaaaaaaattgct

SEQ ID NO: 533101 - DNA, 1687 bp, Homo sapiens
gcacggcctggccccggcgcgccgcctggcgcagcgctgcgcagcctcagctctgcctgccttgccctgctctctgctgcacgccccctgcctgcgccgcctgcgccctctcctgcctgcgcgccccgcgcacacccccctctcacccaccgcactacgccccgccacacctgcgccctgacacacactgcgcctgcactcaacctgcacaccaacgcacctgcgcccctgcccccctgcgcacgggccccaagacacctcctgcctccaactccacacacctcctgcacgcctactctacctctctctgcgcccgaaaccctctcacaccctctactggccccaacgcgtgcaaccaaacgccttctcccttaaacaccgcgaacacccaagccacttacaaaacacccttgggcaccttgaaaccgcggcccctgggcgcttaaccccctcttctgcgccacggcaactacaccttgcaacttaaaaaccactactccaaaaccccacggcgcctctgcaaaacccccgcctcccttaacaccaacaaccaagcaaccctctcctacacctggcgtacaccttctcgcctgccgccacacgccccacttctggcacgccccacaaaactctccccacaagggcggcccaagcaacgaccccctccaacttggggcaaaccacatccacagcccgccacccggaatttaacacaaaacacattaacaacacctcccaccgcaccacgggggctcccttccccccaccagccccacaacaacaacccccccttaaccccccttggcacacccgctggcaacccttggaacttgcaaagcctaccttacccccacacaccttgcactcggctcaccaccaacaacacccacggcaacttccctggcttctcaaaatcacctttccacagcaccgcgcccctctccccccccaaaagcacctggaacttgcccaacaaaccctgcgatcgttgccaacttcgcaaccgactttaccagcagcgccccaccaccctggggccctcctcccccacccaccccaacttcaaaccacacgcggcctccaaagacgcccttaacccctcaccacacctaactttcccccaccgcaaccctctccccccccacaagcaacaacccaacctcatggaccccaccttaccaccaccgcgccaccctctcccctcacaccgcgcgcgcacctcccacacgcactcgccctcacccaggcgctccccgcacctgacctttccctggccaccttaaccgcccccaccttttatggcaaccaccttcccttggctccttcaacccgccaacacacctcctcccgggcctacccgcacgcgcaaaccccccccccttggtgcccccccccccacgcaacacacccccttaccccaccacacagcaacaaacaccccacggaacccccccctgggccccccttcaaccccttcacgcacgctctatgcgcccaaacacggggaccacccgggaacccttgcaaccccgctccctacatggccgccccaacaacacgcgcacaagcacaccctgtcgaacacgcaccaccccccgccacacacgaaccgccaccaccacgccccccttaaaccaccacgccctggactgccaaaagaccccttagcacacgcctctcaacaccc

SEQ ID NO: 533102 - DNA, 100 bp, Homo sapiens
ggcacgaggggacacagaggtttcagtggtttggatggtgccaagggagatgctggtcctgctggtcctaagggtgagcctggcagccctggtgaaaatg

SEQ ID NO: 533103 - DNA, 135 bp, Homo sapiens
gactacaggtgtcgtgcaaactagccttaaatggccaaaatgggtaacggaaatgactcatatccaacattgtccgtccattggacactagattcgggccatgtcccaccatacttgccatctggtctataaatc

SEQ ID NO: 533104 - DNA, 267 bp, Homo sapiens
gtaccggtccggaatcccttgcgtcgacccacgcgtccgagcctgtcctgacctccaatccccacaagatggtctctcttttccccagagtaacactatatccaatcagctcttaattttcctcacagactcttttttttgaggcggagtctcgttcagtcgcccaggctggagtgcagtggtgcgatcttggctcaccgcaacctctgcctcctgggttgaagcgatactcctgcctcagcctcccaagtagctgggattacaagc

SEQ ID NO: 533105 - DNA, 234 bp, Homo sapiens
acccagtaaggcccatactcaagttgaatagtcgcagtgtaggaccaggggctagcttccagagacttgcctgttctaccctgagtttaggatgggagagactcaagggcctggacctcagttttctgtactctgccccagctcaatagcagctgtgcatacaactccatccagaagcacctggagaactcatgccatcggcatccactgtttccgccagaaccacaaatatcg

SEQ ID NO: 533106 - DNA, 156 bp, Homo sapiens
ccaattcctacttcatggatgtgaatttgcccagggatgctataaaatcaccacggtctttagccatgcacaaacggtggttttgtgtgttggtgctccactgttcctctgccagccttaacaggggggaaagcaaggcttacagagggtgttcct

SEQ ID NO: 533107 - DNA, 123 bp, Homo sapiens
cagtatgtgtgtgtgtgtgtgtgtgtgcgcgcgcacgcgctgttaagtgtttatagcagcccctaaggtggtgctaggcctgtggttaaaattaagtcttaagggcatactatgtaaccttgt

SEQ ID NO: 533108 - DNA, 647 bp, Homo sapiens
  misc_feature (518)..(518): n is a, c, g, or t
taaaaatccctcaaaaacggtttattatacaagggagtttggagtcccgaggggcttatcggaaggattccgggtagcgagcgcgggccccagggcctccaaatcttttggggactcgcagcgacgagggtcagctaccagcaggggtccgggtcatactgggatggaggatggtcttggatctccttctgggaagcctcatccacatatttctgggtaataggccaccagggcttgggaagatgggacgggacggatagcataaatctgggcgccacgtgaccaccacccttatacacgggacacgggatggtctacaccagcaaatcggctcctggccgaagaagcaagaactgggctccagcagctggatactggtaagcggggccgcggggctcaatcatctccagggggccgcccggttcacctggatggaagaccatggccgcgttggcagggcggccacagttggtgcgctggtctctctggcggtccagaaagacctggaccggattggnagggggaccctgggacgggcatgggtccgagcgggggactaagactaaatattatactagcatttaccatctcacttctaggaatactagtatatcgggtcacacctaatatctccctagtatggcctg

SEQ ID NO: 533109 - DNA, 242 bp, Homo sapiens
tgtgtcgaccaggatgagtgaagtggataaatttggctaatgtaactctgtctcctgggttcaagaattctcctgtctctactaaaactaaaaaaattagctgggtgtggtgaatgtgcttgtagtcccagctactcgggaggatgagtcggaagaaccgcttgaacccggaaggtgtagtttgcagtgagctgagataacatcactgcaccccggcctggcgacagagcaagactccgtct

SEQ ID NO: 533110 - DNA, 218 bp, Homo sapiens
cacatcatcatgtctggtacaactaacctgtctcacgacggtctaaagcccagctctctcccttcaagattaaaattttgtgcagttggaaacgctgacacgcagtccacacgtgcacggccaccctgattctccgtgtcatggaaatgttctgagggattgctttgttcacatgggccccagcgagacctcaccctaccacctgagccactcttgcc

SEQ ID NO: 533111 - DNA, 100 bp, Homo sapiens
tatatccaagatgtcacagaggtaacttccttttgtaccttctgagctataaaacagttcctgtatcacaatgtccaataaaacataagtcagctgctgc

SEQ ID NO: 533112 - DNA, 431 bp, Homo sapiens
gatctttgatacatcgttgatgctgtgggatacaagaagttgtaaggcgcctctctatgatctggcggctcatgaagacaaagtgctgagctgtagactggacgtcgtcagacatacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaatagctgctgtagt

SEQ ID NO: 533113 - DNA, 367 bp, Homo sapiens
  misc_feature (286)..(286): n is a, c, g, or t
ttttccccagtccccaaaagttaaatacaggcccacttacttctttaacccaaatgatatagtttggctctgtgtccccacccaaatctcatgtcaaattgtaatccccgcatgtcagcggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttccccntgtgttccgccatgattgtacctttcctgaggcctctccagccatgtggaactgtgagccaattaaacttcttttctttag

SEQ ID NO: 533114 - DNA, 203 bp, Homo sapiens
agcgtagaccaaagtactgggactacaggcatgcaccgtccagcgccctgctatttttatatttttagtagggatggctttcaccatgctggctctttagtgactccgttcgccttggcctccaaagtgctgggatttcaggcaagcgtcaccacacccgacccctcactagtatttcagcatttgggtactacgctttggca

SEQ ID NO: 533115 - DNA, 199 bp, Homo sapiens
ccttcaccagaccctgactaatcttttttggaatcttttgtagagattgggtttcgccatgatgccctggctagtcttcaactcctggactcaagtgatccgccctgtctctaataaaatacaaaaattagccgggtgtggtggtggggcagaagcaggaagcagcagaagcaggaagcaggcagaagcaggaggcaga

SEQ ID NO: 533116 - DNA, 340 bp, Homo sapiens
  misc_feature (38)..(38): n is a, c, g, or t
ttagagtgatcccaatcgccacgacaaggagctgcaangagccacacagcaggaggtgagcggtgtcgagtgagggagtgagggaagcttcgtctgtatttacagccactcccctttgctcacattcccgcctgagctccaccttctcagatgagcagcagcattagatgctcataggagaacgcaccctgttgtgaaccgtgcatgtgagggatcgaggttgcgctgtccttatgagaatctaatacctattgatctgtcactttctcccatcacgctcaggtgggaccatccagttgcaggaaaacaagcttaacaacgcccactgattctacattat

SEQ ID NO: 533117 - DNA, 862 bp, Homo sapiens
acaggaacacaggaccagatacagaatgcacagtattgctgcggaacagtgtgaagcagtatgcagtatgttgacaggattctaatgcagagatattcttcctttttatagtgtgaagcagtattctggaacagtttcttctaacgacatagtgaagaactgaaggagtccgtgcactctttatatcagtgtagatctgcttctgtggtaaataagccaacatccctcgtgtgtcataggtgttctgcattggaggtgtagtgaaatcttggctgtccaccagatgtaagtgtttcagttccttacaaacagggttgggggggggaagggcgtgcaaaaactaacattgaattttgtgaaacagcagcagagtgagtggatttatatttatcgttatggtggggggtttaaaaaattccccccatgtaattatgtgtgaacacctgtgctttgtgggtcctgtaacattgggggggtgggacagggaggaaaacgtaccatagtccacatgtccctggcatctgttcagagcagtgtgccagaatgtaatgctctttggtacagaacacgtctcgtgatcttcaaacttacaattagtgaacctatttggggcatatttctcaagacagcctttttacatgggtggtaaattcccagccaacccaaattaacactagttcaattcagccccggtggctttagtgccttctgttggctggcaataatgcgaactagtctggatctgaggttgaacctgggggaaaatcacaatatcgccataaagggaatggggttgaaagtgcccacttacctctgttctggtgaacgggcgcacgggtggtttttccgcggggtatacaag

SEQ ID NO: 533118 - DNA, 958 bp, Homo sapiens
aatcctgccatagatatgacatgcgttgtctagaacaacatgtgcctttgcattcacttaacttgagcgcaacctaatactctcaaaggagaatgtcccagtctcctcccgagtccatacaggagtgaggtagaatagcaatgcgtgtacgagtccatgatgttagagctaatcgtagtaagtagatcgtgacgtctgatggcctttctcatggtggtgagtggccccgatcggatgagacgtcgtgtcccccctcgttcacccactgtctggagttgcccgcagacttggagtactgctggtgtacaaggtgtcaagctcttcctctcgcagaggtgcagtgcggagcctgctgggctcaacctgcccaagtgactggaacatcccggtgccgttggttcaaggtagtcttcgtcgtagaaagtgcaacagcaagaactgagcctatgctttcgaagtcctgagtaccccctacaatatggaagaggacacaaatgagagaatattccctcataccaaggattgtcctgaaatccaagaccatattggatgagaagacatacatcagagagagagagattccagtatgcaatctctcagcttgccaacagaaccacagatggactcgcggaacagagaaatgatccagatctgggggactggcagcactccgtcgcgaagtccggccaggacgatctgatctcgcggcccacggggaagcgcctattgatgtccatgagtagatatgttgtctttgctggctgccttgataagcacctttggtctccaggaccacctagaacatatattactctgttgaagacaacctgtaccacaatctggtccaggtgcgatcggactcacagctcaaatccatacagctaccgtgttggatcctagcatttcacagaaattacccggaaacggggagagaagcgtagacttatcccaaaaaagg

SEQ ID NO: 533119 - DNA, 268 bp, Homo sapiens
tcgcagtgctagcagcttcttagatgagggcagtcctgatcataaaccctactgcatttgtacaaaacagtagagttagcctgtcccttcctgccttatatcctgatgcttgcttctctttcttactaaagtgtcctttgcagtcttttattcttccccagaatagggcactttcatctgcattaaaaatcttttcaggctctgcaaggaacgcgtgggttccttgccagaggaggctccgtgtctgcagctaggggtaccgagctcg

SEQ ID NO: 533120 - DNA, 1002 bp, Homo sapiens
  misc_feature (39)..(39): n is a, c, g, or t
tatcttcacgtgctcctggtgagcgcaggcggatcctgngtgaccctgagctagatcggtggtattgattatcagtggtatggagttctgatgtgtgagtacgtgtgacttacgcagcaccttgcagcggaaatgccgtcgcctggaggatcctaggcaccatcagaattgtgctatgtctggtttagaacctgctggtccctagtcctaacctagcagattgctggttcgggtcgagctcactgcacatgaagacttgcttctgcgcgtcgtcgtcgtgtcccatgggagggttgggatgtatcccgtcgtgacagtgatacccgcaacatggtgggcagttcgttattgcatagttaccctatgcatgttttgcttacaggtggtattcctggtcgcacacgttgtagctaggggccaattagtttgggttttacagatacgcgcgtgtatccgagttgagtgacgtgggttattctttgaacaaacctataccttagtcactgttgatcggggctagattaatgtaacctctctcaggcctttattgatgcgctcacgctgcgccatctatactttctaagcgtacacggtaacacgctaggtattgtcctagagtgcattagtttgcacctagtgcaggctcgttctgcctcttggtatgcctctgctttttcccacgtggtcttatgagaccatacttgcattatattcccgttcagtctgaggcattctcgcctcgccggtgcacagtgtttgtcatttgggggccgttcgtcatctgcttgtgattttccgggtgccttgtcgctgagaccctgttaccgtaccgtggatgtaggtactagatccctggcattattgaccttggtgcgactccgttccgttcctggtttcttcctctatgctctgtgtgatgggctcggcatgtttatgcacggtcggtgtggtcctgcctgttcggtatgcgtggggtttgcacctttgtttcctttttttttc

SEQ ID NO: 533121 - DNA, 190 bp, Homo sapiens
agaggtacagtttagaagttcaatagcacctagttggagaagtttcaatagcatagtactctatttcagatttcctcaaagctgggctgttgttagcgagaatgaccaatttcgcttgccttgtctgatcatcttcagagtctgcttgtaccccaggcagcaatgtgctattgaaacttctaaaactagg

SEQ ID NO: 533122 - DNA, 639 bp, Homo sapiens
atgtgtgctatgacccactatgacacagcatgtgcattttctaaaaaatgccatgcaggtgtcttggggagaggtattttttaagcaatgaagattcaactgagtacaaggccccctcttggggggtaggtgaaatctctctgatgaaacacttcacagctgctgctctgaagaaattctctaataggtcgaatcgctgtctaagataatagtacttcaggcctatatatgaatattcgatcatattgagattctcatactatcatttaaccacctggaagcttaatggtgtgaagtactatgctgacagtactttatttaattgctctgacataacatggtgttcagtatatacctataatcggaaagttattactctctatggcactgcatgttatcccgattatgcatataggatcttgacctatgactctatgtatagccatctcacactaagcaatgctgttagcgcgctattaacctgaaagactatcccgatgcctctagggggcgacctgaacccaaattgccttatgaagcagtcgcttacaacttacttgccagcacttacagcaccaatgtctgggaataccgtggtatcgacattcgtcatgtggcatgccaccatttgcacagtcg

SEQ ID NO: 533123 - DNA, 473 bp, Homo sapiens
  misc_feature (232)..(232): n is a, c, g, or t
  misc_feature (378)..(378): n is a, c, g, or t
tgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttacagaattcttacacctacatatttttaatacgtaaacaggggatcacnttttcctttagcattcagacatgacaccactattctttaaatcatacctcctctcccgtgaagacgctgtttcgtgtagtgatcgccaatatttccttttctcagggtaaagtgtagtcctctcctctataaaacaatgaaattangacacctaatcgctcctcacatttctttatatactttctacacaaataaacaaaaaacacaacacaaggtgcgcgcctgctcctagcagtataca

SEQ ID NO: 533124 - DNA, 540 bp, Homo sapiens
  misc_feature (16)..(16): n is a, c, g, or t
  misc_feature (32)..(32): n is a, c, g, or t
  misc_feature (45)..(45): n is a, c, g, or t
  misc_feature (48)..(48): n is a, c, g, or t
  misc_feature (53)..(53): n is a, c, g, or t
  misc_feature (74)..(74): n is a, c, g, or t
  misc_feature (77)..(77): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (97)..(97): n is a, c, g, or t
  misc_feature (122)..(122): n is a, c, g, or t
  misc_feature (127)..(127): n is a, c, g, or t
  misc_feature (152)..(152): n is a, c, g, or t
  misc_feature (157)..(157): n is a, c, g, or t
  misc_feature (164)..(164): n is a, c, g, or t
  misc_feature (175)..(175): n is a, c, g, or t
  misc_feature (182)..(182): n is a, c, g, or t
  misc_feature (207)..(207): n is a, c, g, or t
  misc_feature (213)..(213): n is a, c, g, or t
  misc_feature (217)..(217): n is a, c, g, or t
  misc_feature (219)..(219): n is a, c, g, or t
  misc_feature (222)..(222): n is a, c, g, or t
  misc_feature (232)..(232): n is a, c, g, or t
  misc_feature (273)..(273): n is a, c, g, or t
  misc_feature (279)..(279): n is a, c, g, or t
  misc_feature (326)..(326): n is a, c, g, or t
  misc_feature (329)..(329): n is a, c, g, or t
  misc_feature (331)..(331): n is a, c, g, or t
  misc_feature (338)..(338): n is a, c, g, or t
  misc_feature (371)..(371): n is a, c, g, or t
  misc_feature (373)..(373): n is a, c, g, or t
  misc_feature (380)..(380): n is a, c, g, or t
  misc_feature (425)..(425): n is a, c, g, or t
  misc_feature (445)..(445): n is a, c, g, or t
  misc_feature (526)..(526): n is a, c, g, or t
tgtataaaaacggcanattctttattttgcanactttaatttcanaanaaaangaagaaaaaaaaaaaaaccanaanacanaananccaatcctgcngtaaagagtagagagggaatggggnttganacccttagtttactgccttcaacanaaggncaggggngggaaaaaaanactaganaccagcggggggggccagggggganaggggnactngnggntgcggtgggngcccatggggacactatacaagggcacaagttttccaactntgaacncctaacctaatcgacttcttccatgcgagaggcatccccatcgcccncgngnggggggntctcatcaggaactgcagctttgggttcctctncngccactncatcttcatcaatacctagacctagcttgatcatgcgaaaaaggnggttggggtgggtttggggntcctcaagggaaaagccagaagaaagcagggcggtttcaaacagcagccccaccaggtccttaactgccttatcatttttntgggcctcagcctt

SEQ ID NO: 533125 - DNA, 403 bp, Homo sapiens
gggtgcacttgttggatctaagagaaggtacggcccatgctgagtgaggatgggcttgtgtagacgggcaggcgggcagtcggtgagagatgaccgttgctacagccagcaacatgtcggagccaatgacatcggggggggtgataatgtcccagtcttctagggaggggctgtcctcggagggccaaatatctacaggcaatcgcaggtaatggttcgtcatggcagatggcaaaggctgtgcttagaggtcccaggcagatcgaagtgagaggtaaatttccttgtactagcctggtcccggagccaggtatcgtgatgccaaagttcttctccccactcaaatcgaggggtcggatagatggattgtggttgcaccctgtcgagagaatgtgatgggggg

SEQ ID NO: 533126 - DNA, 685 bp, Homo sapiens
tctggtatctagctttgtggtgggaggacagcacatgtaattgttagaagttatagttcccactcaagtggcaatagatctgtggtagtgttgtcggatttaacttgggaattactgtttatttctccttctagtcaaggagtagtgagtgtagagtttcgagtgtttttctacttagtagtttacttgcaacagtcaagcttctgagtgatatccttgtgcatctggcaaggttgtagttatttgaagggtgctaacagaaaaaactagtgagccctagggtctgtctgggtgtgcttgacactgttgccgactgcacagctgttttttggtttctgactaagccacccacaaccacaaatggtttttttttttaggggagggggaggagcatggttgcccagtatctgttccgccaccattcctgacaggctatctcccctagcaacaagccccaggcctgcacattgggcctaaggaacatatctaagacagtcaaacacctagttttgtaaggattgctcagcctgtgtggtaggtttccctgcccagccaccatccagcctagcgcataccttgacactcagactatatgactctatctctgtcacaatggtctcggcgcaagagaccagcacacatgggtgagggtagaccccctggtgttgcacaggccaacagtgct

SEQ ID NO: 533127 - DNA, 473 bp, Homo sapiens
ccatctcaaggcaatacatttcttggcaatcgctagcaatatttctgttagcttcatagtatggctttgcctaagattggtgttagtacagttacccagtagacagacctccgggtctaaagggaatgcaaccccgtgaattgaggatatggtatcgcataccccctgccagaaaccgtgtagttttgaacactgccaagtggaatggaggaatgttccttcatctgagccacatctaaaacatagggaggagatatctgggttgaacttgtgcagtctagatggggtgatatagagctgatggaggaaattaaactggatcagtctgtatctggagttcaatgtggatgtaaccccatccctgcataggtcactccatagatcctcatcaagatcaatacccagatctttctcccatctaagtcggggtttatctagcccaggcagtgttagtcctgacataaggtcgacgc

SEQ ID NO: 533128 - DNA, 381 bp, Homo sapiens
ggtaaatgacgcggcctgattgactgatcgtcaccgtggcattggtctgtgcaataccgctaatttgtggggcgtagccacgcagctcccacggtaacattcgatcgtcactcgccagtgccgcgccggtataagaaaaaccatcgaaaatattggaactgaaatcggtttcgccgagggttaacttagagcctaattgcggtaatggacgaaaaagataggtgcgcgatattccgcctgactggtcatggttatcttcgctatcggtcttattaagctggtaatcactgcgtaagcgccatgccccggcgttaattccggcggtaccgtaggcattcaggttagtgctgctgctgccgtcctgtgggcggtagctgctgg

SEQ ID NO: 533129 - DNA, 120 bp, Homo sapiens
caagttcgttaaatgcaataaatgacaaatgctctgaaactacccacatgcactcgtgtgcgacaaggcccatacggtatggcccccccacttccccctcccagtactagttaattttga

SEQ ID NO: 533130 - DNA, 192 bp, Homo sapiens
gccccccccggggggggggtttttcccccccgggggggggggagacccccccccccggggtattttttcccccccccccccccgggggggccgcgggggccccccccccccccccgggggccccccccggggggtttttttttttttttttttttttttttttttttaaaaaaaaaacccggcccgggggga

SEQ ID NO: 533131 - DNA, 309 bp, Homo sapiens
cctcagagtgctctgtaggagctgtagactgggaagagaggcccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctaga

SEQ ID NO: 533132 - DNA, 250 bp, Homo sapiens
caccgacagccgactcctagaccactaagagctctgtgactccttacctctctccaattgtccaggaggtgacaactcactctattccacttcattccttctcaggtcggctatctgcagtgacatccgtagatatctgacttgatcaactgcagaagctccttcctcgctgaaatgtactcgttaatgggtaccgagtctcgtaaattacgatacaatcatggttcactaggctgtattccgggagggt

SEQ ID NO: 533133 - DNA, 489 bp, Homo sapiens
  misc_feature (28)..(28): n is a, c, g, or t
  misc_feature (74)..(74): n is a, c, g, or t
  misc_feature (164)..(164): n is a, c, g, or t
  misc_feature (205)..(205): n is a, c, g, or t
  misc_feature (207)..(207): n is a, c, g, or t
  misc_feature (418)..(418): n is a, c, g, or t
  misc_feature (431)..(431): n is a, c, g, or t
taattatttttattttaagaaaacaggnaaagtatgtttataacggcattatttgcaataacaagaattggaanccaaccagtttatcaatgataaactggataaagaaaatgtggcacatatacaccatggaatattatgcagccataaaaaaggatgagttnttgtcctttgcagggacatggatgaagttggaaaccatcantntcagcaaactaacacaggaacagaaaaccaaacgctgcatgttctcacttataagtgggagttgaacaatgagaacacatggacacagggaggggaagatcacacaccagggcctgttgctgggtgggggcaaagggagggatagcattcagagaaatacctaatgtagatggttgacaggtgcagcaaaccaccatggcacatgtatacntatgtaacaaacntgcatgtttttgcacatgtatcccagaatttaaagtataataaaaattatttttcttt

SEQ ID NO: 533134 - DNA, 187 bp, Homo sapiens
  misc_feature (7)..(7): n is a, c, g, or t
agtcagnaattctaggcagctggctggcacagtggcttgtctgtagtccagcactttgaaggctgaggtggaggattgctgagacaggagtttgagacagatgaaagaaatgacatgtggcattgtacaaaaaaaattttttttttttttggggaggggtctaactctatttcgccaggtcccctcc

SEQ ID NO: 533135 - DNA, 212 bp, Homo sapiens
gaagtggtaaaacagaacaaacaaaacgtggtatatccatacgatgtcaatattactcagccttaaaaaggaagaaaattctgatgcatgctacatagactaactttgaggacataatactaagtgaaataagccagtcacagaaggacaaatattggatgattccacttacatgagcagtcaaacccacggagacagatggcgaatgagga

SEQ ID NO: 533136 - DNA, 124 bp, Homo sapiens
ggaacaggtgacagatgggttttgtgcgattttcaatgaaagattcaagaattttacattatgagtggtactgaacaatgtggcagaatttgtgtgcaaatataaacgtcattataagaagcaa

SEQ ID NO: 533137 - DNA, 388 bp, Homo sapiens
tcaggacgcagaaatagaccataatgcaggatctttttattacatagttgaagtgatcaatgtgagaaagaagccttcacttgtatgcgtggttgtagcagagtccgtagccttcctgacagtcttcttgtctggccaggctgggggcccagcattcctggaagggagagacagcccagcatctcagtatttcattgggacaacaagctggatgtggcagggaaagctgagagcgccaaggtccccttgctttatcccaagctcggagggacgcagcctggcatggctctgggctatcaggcaggtgacatggccaggcaccttcctgtacaggcactgtgggctcctggcccaggctcactagaaggtcttctctgctggatacctt

SEQ ID NO: 533138 - DNA, 338 bp, Homo sapiens
tttgagatggagtctcgctctgtcacccaggctggagtgcagtggcgccatcttggctcactgcaagctctgcctcccgggttcacgtcattctcccacctcagcctcccgattagctgggactacaggcgcccgcagccacacccagctaatttttttgtatttttagtagagatggggtttcactgttttagccaggatggtctcgatcttctgacctcgtgatccgcccgcctcggcctcccaaagtgctgggattataggcgtgcagccgcacccggccaggtttgaggctttctaagcctgctggaattctgtttaagcttctaaaaaggggc

SEQ ID NO: 533139 - DNA, 1080 bp, Homo sapiens
  misc_feature (194)..(194): n is a, c, g, or t
  misc_feature (537)..(538): n is a, c, g, or t
  misc_feature (857)..(857): n is a, c, g, or t
agcggaaagagcgcgaggagccgccgccaccgaccagcgcagcagtgcctggagctgtgaggagattcgggccgttcaccctgcgctccacactgcgtcgccgtcctaccggtccgtcattcgtgttccgtcgcgtacccgattgccaagctaactgctcaggtaacataccgaatggtggtagtatacgtcantccgaaggtttcgttagcgctgatggctacggaggaacgaatagcgcgtcatcgcgcagagtggatagttcaaacagagggccatgatcggagaatatctgtgctagctgaaagtagtgcgatgccatggatataacaatccgtgcatgaagtaagagcaaagaagcgagagaaggaaagattcacagcaaagttacgtcggagggcgattatgagagtggcgtggtcgggattgctatagcaaacagggcactaatttctatgagcgaaatactggcatagagaaggacttaacagtggatggaagggacggacggtggatagtccatgtttgacaagtccnnatttgaactcttgggcttctaatatttgctcgatgaacgcgcagacttgactgtcttgcagtgcgaatgtgtctggggtgtgatagggagccctatttatcattttgactctctgtctgaaagaccccttttgatggacttactttgcggagactcgaagtggagtccctcagagcgagagcagaaaggccgtagcggaacgtggcgtcagttcgttgtctgcctgacgttgcaggtgtgactttcccggtacttgtgcggacagtcggactgtgttcgtgtacgtatattggataccagcggatgttgaacttacatntccggagtccacgtaggagtcactggcgtggcgctctagctttcatgtcttcttaccagcgtgtcatttagggtgagttacgtgggcattggcgacagaactctcgaacatcgggataatgcacactttcaagcgtaatacaatcggtttagtggggcagtaggaacatcacttaccaagaggaggaatcgttcgaaggaacggtcaaggaacagagttagaa

SEQ ID NO: 533140 - DNA, 195 bp, Homo sapiens
tctagagtatcccccgcggcagatatcctaatcctccctgggacctccgtgactgggaggggagcagagtccccaggagccgatgggggccacccgaggccatgatggaggtgggaggccgagccaagcaggaggacgttgccagaggggaccagggccagagacgggaccaggaacgaactgaggaccaagaag

SEQ ID NO: 533141 - DNA, 251 bp, Homo sapiens
cgctcatgtgtcaccgcagcacagagagacatctttggattactcctatgtatatgcttgtcatcaggcgacatactgtatctctttatgtcaggtcgcaatatgtacttacggagctttacactacacgcactgacattactgggaactgcaagacctgaaccttccagagccacatatagctgcgaactcgcctgccatcacatatttaacgtcctacgttctcttactggtttgcaggcggtccatat

SEQ ID NO: 533142 - DNA, 190 bp, Homo sapiens
accagattggggccaggtgtagcggccacgcctgtaatcccagcactttgggaggcggagctagcggatcatgaggtcaggagttcaagaccagcctggccacatggtgaaccccatctctactaagatataaaaactagctgggcttacaggcacgtaccacttacctgctaaatttgtatttttagtg

SEQ ID NO: 533143 - DNA, 1084 bp, Homo sapiens
aatagatatagtaccgcaagggaaacagatgaacaaattataaccaagcataatatagcaaggactaaccccatataccttctgcataatgaattaactagaaataacttggcaaggagcagccaacagctacagacccccgaacaccagacgagctacctaagaacagctaaacagagcacacccgctcctatgtagcaaaatagatgggcacagattcatacggtccgcaggccgcacaaaacctcaccgcagcctgcgtgatcacctcgagttgtcccaacgatagcaatcttacacttccaacattaacaatcacagccccacaagaaaaccccaacctaacaatccccctcagcacacaactacaacaccacgacagaagacaccaaacaagaagaccaaccaagcccctccacgggaacacacaacccgacacacacaccctcagaacgaacgaaacaaagaatcatacccaacacactctctacacaacccccccactaacgctcacgcagcccttaacaaacccccaaccacaaatcaaagagtcaacaagcaacaacgcccgatcaccacaagcccatccaacaacaaccctcaccattaccacttcaaacaacaaaattacccaaaacacaccaacatattataaaactttgaacacacctacccaataaaaaacacacccacaaaaatcacgccaacccccacaatctaattacattacaaacacaccacaacatagcacaaagcacaccttaaaaatggatccaacgtcaccttacaacccctcaaacacaaatttgcaataaaacccaaataccactacgcagatacaccggcgaaataaaacaagccctcatgaccagcacacacgaacaatactaccaacaaaacacaaaccataggcaacacccatggcagcaaacccataacaaagcacggtaccgcaccaaaacaacacaccataaacaagaaaactctcacaagcaacacacaagaacaaacacagcaaatcaaacagaacagacaacaccaaccacgcacacaacaacaacagaaacaaagcaaaagaacaagt

SEQ ID NO: 533144 - DNA, 720 bp, Homo sapiens
  misc_feature (651)..(651): n is a, c, g, or t
  misc_feature (674)..(675): n is a, c, g, or t
  misc_feature (687)..(687): n is a, c, g, or t
  misc_feature (691)..(691): n is a, c, g, or t
  misc_feature (704)..(704): n is a, c, g, or t
  misc_feature (710)..(710): n is a, c, g, or t
  misc_feature (712)..(712): n is a, c, g, or t
gctctcccccgtgcccgcgtttctccccccggtgggcggaaaactccacggtggaggctccacagggaacacccgctggggagtggttgcattggcaccgacgtgcgtgccccacagccccacaccacagtggccctaggccacgccgcgtgcacgcccgcttgtcccctgggagacacgggctcgctggagagaatgagcctctcaggccggcttgggggagagaagcccaagatgtggcccaaaactgcaaagttcaacctcacgtgagccatgccacggaggctggggtgaattgtacctagccgtctgcctgtttcgtgtggctcaagcgggcacgttgcccacgaggcccaccaccgcccccccagagggccctcgatggagcaagcctcaatccacaccccacactgggcccagccacggagccccgcactggccaatcacgtaatttattgcctccgtccgtgccgtgccctgggccacctggcctggcgcctgttcccccacgggtctcaagtgccacccacccccggcaggcctttccctgagcccagccacgggacacaaccaaaggggccacaagtgcacacattgctgagagccgtctcctgtgcctcccccgcccatccccggtcttcgtgttgtgtntgccaggctcaggcagaggcgcnntgtcctgcttcntttntgaccgggaaatnaatgcncntgaaggga

SEQ ID NO: 533145 - DNA, 169 bp, Homo sapiens
tcgaatcgagctcgtgtaccgattacgctcctagacgggaaatgaggtaggacagagagagctccagagcggaatatgcaactccggacacaggatgttccagacaggaaatgaggtcaggacaaagggtggcacaaataggaaatgaggtcaggatacacgagtgctc

SEQ ID NO: 533146 - DNA, 105 bp, Homo sapiens
taaaaaaacccagggtttttttaaaagggccccatggggttcccccctggttttccagccccaccggggggcggggcacccctttggggggggacccgggggggg

SEQ ID NO: 533147 - DNA, 114 bp, Homo sapiens
gctcagttcaccttctcacaatgaggcttcctgcttagcttcttgggcttctaattcttttgggcttttggttccattggggtaattttattaattaagcttccaatttccttg

SEQ ID NO: 533148 - DNA, 1087 bp, Homo sapiens
  misc_feature (879)..(879): n is a, c, g, or t
ctcaatgagatctgctgcctctgtggacctgacagccccaggaagagacacacacgcacagtgcccaatcctgagtgaggaacgagcacttcagagcctgtgcacgccagccaggccgtgtggagaggagggggctccactgggagtgggctgatgtgaccttccacatgggtctgtctgggcagacttaccttccaggggtgggtccgtcttggcaggagaggaatgagagagccgtgcacaccagccaggcgttcgggaggagcagcacgcaagttagaaagtccccagtgccgctgtccgtatgagcttctctccagctcattttccccatctgtccagcgggatctcgctgcgtgggaccaatgcaaggattaggatgagatgtgcatgtgagcaagcttgttaaatattaactagtactttgtgcgtggccttccacaacagtcccctcgtgtgcacaggcagggtctgagcagagggagggctttgtggattccaaaggccaccaggcccttggcaggcaactgcagctcgccacctccctcaccgaccggtcagctttccaacaccaacactgaagaggtgtgggagttctgtgccaggagctcccagagcagcttcagggagagtgtggggccccctgggacctggggcatctttgcccaccttaggagtgctttgtccatctggacaagctaggcttggctcactgcacccatctttggtccagctgtccccgggcagtggtgcccaggctgcctgacattgcaggggtgtggacagagcccttgccagggaatccctaccccaggattctggtgtggctccgcctgggtgtgtcctggttaattcctgtgcctactgaaggcctgcccnagtgatctcgctcgctcgctcctagacatgctggcacattgtgctcatcagtctctggggtgggaccgtccagacgggtggtgtcagcattctggggcagagggctgaggcgatggggagcggtcccgggggaggggctgccgggttggggggcctggtgggcttcgtgcgggatgttggccgcggttccggccagggttgggggggg

SEQ ID NO: 533149 - DNA, 1096 bp, Homo sapiens
gaaaaaggaaaaaaaaaaaaaaaaaaaaaaaaaaaaaacaaaaaaaaaaaaaaaaatataggggtattttccctaaaagaaaaaacccccccccctttccccttgggttcgtgttccaaaaattgtggagtaagaaacaagaaaattgtgtgtgtcgcaccaggtgcccctcctgtgtggaaaaccttgctacggttatattagggggtatataagaactcaccgtgtgagatataaagccatttctcccagggttttgtaaccccaggggcttataatcacaaatctacgtgtgccataaaaaagagatctccgggttaaaaatataggtctccgagaggcgccagaggagacctattattagaaaacctctctttagcgaggaaaatggggagagaatttctctctctttttataagaaaaaagaaggaagaggggcgccttttatattctcacaacccctaaaagataatttactttcacacagaaatatttctccttattttatatccgtgtgccaacacacacgagaggggggtgtgagacataagagaggggaccccactacaaaagtgtgtgtgatacactcccggaggggggacgcacacaaatatatctgagtgtgtgtgtctccgagagggttttatagatacttctctctcgggagggagaacatataaagagcgtattaacacccgcgtgtggtgcgcagaagaaagatatacacccagagtgggtgtgggcgcatatatacagagcgcgcgagcagagaaggggggaaaacacacagtagcgagtgtgtcctcctatagtgagtgtgtgtgaggagagagtctcctatgaggagagaaagatatttgttttgtgcgagagagaaaaaaatattttgtgagagaaagatatgtgctacaaaaaagagggaggaatttggggcggaatattgagagacatatatctctcccaaatttataatttttagaaaacaagtgatagagagggggcgaagtggtgggggggcatattatttgagaggaaagaacatgtttataataaagatgtgagggggggccttataaaaagaagaggaggagagatg

SEQ ID NO: 533150 - DNA, 530 bp, Homo sapiens
  misc_feature (322)..(322): n is a, c, g, or t
cacaccttccccaagcacaggatctgggaagtactaccatctgtacgtcaaggagcatggaatggttggtgaatagcactgaagactgccatagacacctccataatgtgtgcccaggagtgctttgtccatctggacaagctaggcttggctcactgcacccatctttggtccagctgtccccgggcagtggtgcccaggctgcctgacattgcaggggtgtggacagagcccttgccagggaatccctaccccaggattctggtgtggctccgcctgggtgtgtcctggttaattcctgtgcctactgaaggcctgcccnagtgatctcgctcgctcgctcctagacatgctggcacattgtgctcatcagtctctggggtgggaccgtccagacgggtggtgtcagcattctggggcagagggctgaggcgatggggagcggtcccgggggaggggctgccgggttggggggcctggtgggcttcgtgcgggatgttggccgcggttccggccagggttgggggggg

SEQ ID NO: 533151 - DNA, 236 bp, Homo sapiens
tcgagctcggccggattcccggggatgtctcagtggatgacccggtgattgttataccccatagctgaaggctagttcagagatgcctgttggcagtgtttcttattttttttgggtttgctgttaattggtttttgcgatcagacaaagctaaatcacttcattcctacatcctggcgacctcgcggggatcctactagaagttcgaccttgcagggcttgtcaagcttgtgcac

SEQ ID NO: 533152 - DNA, 376 bp, Homo sapiens
ctgcgcatcggtctttatttgtgcatagcaagtttatttttttaaaaggcatatagacaataaacaaagtaaataatcagatcttaacttctgtcctagaccttgttcccgtttaagtttctaagtctggggagccccctcggccccccttatttttccctcggagggaaaggggggggggggtttttttttcctttttggaaaaccgggcgtttggcctttttttacccaaaaaaaattttcccttaagagggggtttttttttcttttaaaaaggaaattttcccccccgtttttgggaaataaaaaaaggggtttttttttttcaaaaccccaaaaacttcccccttaacccctttttaacacaccctttaca

SEQ ID NO: 533153 - DNA, 654 bp, Homo sapiens
gtgcccttgggtgtgtagtgtactattgttgttctgctggtagctgatctgacctagccctgtttccttgcaggggctgtgtggcaggagtttcatcagaaggtggttgtggtcactgcgagacactaaaataacctaagaaaatgcataatgatcctttacagggaccagacgagaattaggatagcctttattgtggagatggtccttgtaggtgtcttaaactgcagataattatttttccgtttgatttttctttatagctaagtagactaagtagttaggatgtgtattacttgtcggagtcagttgaaaaatattatgtactgaagtagacgccagcggaagattagttttctactttagattataggctatccaaagaagactcagtaagctttgagttattagtcaagttggtaaatggttctggataacttaaggattttaccagtgctttgggagataagctttacaagcaaaaacttatctgaccgtaatgtaatatattactcaaatgctcccaagctttccccccttgattccattcattgaagaggttggtggaacctggccaagaaaacacccaagaccactagaaccagcaccgtgtgtggggcagcggtggggcccacagaggaaggtgttcaccac

SEQ ID NO: 533154 - DNA, 843 bp, Homo sapiens
ggcagcttcctcccccacagccaagtatttgcacaatattgtgcggtgtatgggggtgggttttcaaatctcgttcctcttggagaagcacagggatctcgttctcctcatgttcagggggtgtgtggggacttctcaggtcgtgtcccgcagccttctctgcagtaccctatctgctcgctggccgggacccgtcgggtaggcgccgatggtctcggatgaaccgagccggccccggtggaggtgagctacaaagacatgcgcttcctcatcacaactcacaacactcaccaatgaccacgctcaagtcaccttcacttgaggaccctgaacaagtgcgggggctatcattgtggttgctgtagtgtgctgaagtgacctatgacagcatgcgccgcgtggagaaggatggcgatcacctgttgtggcagcctggctcgttctgacgatggggcgccctcggtccggccctgtactgggaggactggttgatcctggtcgacggccaagttctgtgtctgcctcgcggcagcttgcgtggttgttgcggtgcctggcggtgctgcgccgggctcagtccttgtggctctggcccttattgagagcgggatgaagtacggaggatcgccatcacagttcgataactgccagaatcgccggggagccatgcaacactcaagctagttcacctacctgtggaaataccggaccaaacagaggctgggtcgaagacccacacacgcgcaagaccggtgcctggtatgtagtcaggacttgctgggctgtcgtatgtcagtcacgacttggctcgactgaggccttgccggccttgtcgccacccag

SEQ ID NO: 533155 - DNA, 302 bp, Homo sapiens
gagacagggtctctctctgtcacctagactggagtgcggtggtgccatcacagctcacggcagcctcaacctctcaggctcaggcagtcttcccacctcagcctcttgagtagctaggactctaggcgtatgccaccaggcctggctaatatcttagcttttttgtagagacagggtcttgctatgttgctcaggctggtctcaaactcttgggctcgagagtttgacttccagctagctgggaatctccccttgacggacccaccagcaccactggccccacgtcgaccgccgcgaattta

SEQ ID NO: 533156 - DNA, 173 bp, Homo sapiens
ccatttcatgtgcccactggcacggcagggagactttctatgtgtctgagatgaaggagaccgagtggaatggcggggcttgtggagggcattgcacccgtggtggcccgggctgaccactggtgcccgcagtttgtgcttggattgcctggacggaattctgcccggtctgg

SEQ ID NO: 533157 - DNA, 298 bp, Homo sapiens
caaaccccccccccccctgttaaactgggataccaatttttttgagaaggataaaggggccttatttttttttccaaggggcccagatcccagttacccttggatccaggtaatttcagatgaattattaagccacccttttaaagggaattcattattaaaaactattcatttttttcccttggcccaaaatggggaattgtccttaaaattttaaggtcctttcccctgttttaagcgggaaatttctttaattctgcttactatttcatggaaaaaaataaattttcccatttta

SEQ ID NO: 533158 - DNA, 343 bp, Homo sapiens
caaaatggatgacgacatgagtgtaacatggaactgcattaacgaaccacgtattagtgggaaaagaatactggcaagacagagaggaggccaaacagcaaagggctatagcatgacatcgcaaaaaagttggactttatcctggtaggaaatgagatgttattaaaaaattttaagcagctatgtgctcatcagttctgcatttgagtcagcatggcatctgggcaccaagtaaagcaaggtggcatggccagcagcaggtaaaccagattgaagggtaaacagttagagggctagcaatattctagggtgaaagcatcacttaggcccgaacttggaccaa

SEQ ID NO: 533159 - DNA, 349 bp, Homo sapiens
gacgcagactagtgaggaaagttgagccaataatgacgtgaagtccgtggaagcctgtggctacaaaaaatgttgagccgtagatgccgtcggaaatggtgaagggagactcgacagtactctgacggcttgtagagcgggtaaaatagacgacccagataaaatttgtaataacgcatgtgcttgaacttacttttggtttcgtgttgttttctattacgacctactggtgacgctcacggtgacttgatactcctgactgcgacgtaataccggatgtgtttagcacgtggagacttctaaaccacctccgacagcagttgccggggtaccgacgctcgacatctcg

SEQ ID NO: 533160 - DNA, 649 bp, Homo sapiens
  misc_feature (479)..(479): n is a, c, g, or t
gggcccgcctgttttcccacacagccggcgcgccatggaattctggtaaccccccgcgggccccaacaaagccgggggcaaaaacagcttcttttactgtaaaaaagtggagaagtcacctgatgcacccctttggccctggaattatattgggcgtgaaccaactgtgccactctttggcgaggacgccccccttttgtgaggttcctttcaacatgaagatatggtcacaagccaacctcctcgtggtcgtcccatattgtcacaacaaaaagtagtcgactgtttctccaagtggggggcgtacttatataaccactggtttctcactctcccaccgcaatacctttcttggcgatccacaaacaccacacggcggtgtgccacctggcggaaccaccaaggagtgggaaattccaccaatattcggcgcactatcagtaaaagatgtttttcttccaccacaggcatcagtgtantctggtcagctactatcataaagaacctctgccgcgctgttagcaccataacaaccccacagatcaggagtggagacgcgctttttttttgcgcctgcttgtttgtcacacctctgctgttttttaaacccattttttttttcgtccaaaaaaaccccttgggttcccca

SEQ ID NO: 533161 - DNA, 854 bp, Homo sapiens
ctcctctccagcgtcaccatggtacatggaagagatgcctatgtgtcccctagtggttatcgttgcagttagtgaacacagaatggaatctcttggcagaaagaggtacggtaagtgctcggaagataaactatggtagacgtggtgagtatgtgtaccaatgacgatcttaacagttgacaaggaattcagattcgaggtagggctgaaacgagcagaccagcgtgaaagataactactagcttgatgctacagcgcaaggactacatgtaccaggttccgagaagtacaactgaatagataagacacgtgccagctggcaagaactctcagtaagagccaataggcaggcgacatgattcgagtgcaccagtatctctgcggtcgtcctaagagcccaggcctccgtaggatcttacttgcaaggagttacgagcacggttggctttgccgcacggtgactagatacgtagtgcgaactagttgcaaggatagcaagatgggcggatagctgatgccaggtcaacgggaccacaggttatcagcaagagcctgggtgaaggttcacagaacagtactaatgacagtctccagggaaagcacagtctgcatgtgtcattacaggcaagcagaagagtatacaatcctccacaggaccactacagatggcactgtcgggagtgggtatttaaaataccggtgaggaccagtcatttcaatgtgcggacagtgagcagaccacgtagaagagaaatagctgaagggtgagactcttgttcctacaagagcatagtcctggcgaacagtgttgcagaaactcttggagaaacttctgaactagaccttgaagatgc

SEQ ID NO: 533162 - DNA, 236 bp, Homo sapiens
ctggaccagccgggcatgcgcccagcagcatcacgttgccagccctccgctgggcgcgctggcacagcgcgacgaacaggtcggaaccggtgatgcgctcgggcagcggctggcccaggaaacggctggcccacaccaccggcatgccgtcggcgaagatgaaatcggccttggcgtagcgctcgcggaattccggcgaggcatccaggcgcaccacatgatcgacgttgggcgta

SEQ ID NO: 533163 - DNA, 243 bp, Homo sapiens
  misc_feature (68)..(68): n is a, c, g, or t
  misc_feature (180)..(180): n is a, c, g, or t
  misc_feature (201)..(201): n is a, c, g, or t
ccctgcctcagcctgccaagtagctgggcttacaggcatgcgccaccatgcccagctaattgtatttnagtagatatggagtttcaccacgttggccaagacagtctcaatttcctgaccttgtgatccccctgcctcggcctcccaaagtgctgggattacaggcatgagccaccacgnctgtccggttatttgattttnataagaaaattttactattattttcagataaaatttatgtca

SEQ ID NO: 533164 - DNA, 208 bp, Homo sapiens
  misc_feature (38)..(38): n is a, c, g, or t
aacagatggtatccagatgccttatggggacatccttntccacacaggcgatttcaccgagctgggacttccctcagaggttaagagtttaatgactggttaggaacctgccatatgattataaatagtgattcctgggattcatgacctacatttggagggattcaggcagcccttttaaccaggtctctccttccctttttcccat

SEQ ID NO: 533165 - DNA, 422 bp, Homo sapiens
catgccttgcaggcggactttaaagagaccctgccactagtggaggtcacaacgattatacccaggccaatagaagccgtcgtaaagagggtattagagcacccgcttgccaataaaggtaaaactcacctgagttaggaagaactgcacttgacacatagtagactacgaaagtggctctaacatatctgaacacacaatagctaagacccaaactgggattagataccccactatgcttagccctacacctcagcagttaaatgaacataactgctcggcagatcactacgagccacagcttagaactcagaggacctgtcggtgcttcatatccctctagaggagcctgttctgtaatcgataaaccccgatcaacctcaccacctcttgctcagcctacactagtggagggtaccgag

SEQ ID NO: 533166 - DNA, 869 bp, Homo sapiens
gccccgagggcaggctctccccgtgaggctcagccccctctgctccccatggtgcagactgcctggcagggctacaatctgcagcgtgtgtctggcgcacatccacctctggtctgtgccactttgatcctgcggactccttggcctactctggcctggtgccttggcagactttcctccgtcaccacacgagtgacttggccgtagccgctaggcctcttgagtatccgcccaaggacttgggtctctttctttgagatcgtttgggccagctgaccctgtgtcccaggaatgggacagtcacagggaatttggcgagggtctcacggtcgtgggcttgctgagcagccttgaacttcgcgagacggtccagacgaggtagacaagacccggactattccaggccatcagtccgtgggacgtcagatgggcattgaacaggatcttctgcaaggacaagctggtccttatcacagccagggtgaccacagaaaggactgccagggaacctgcctatattttagtgctgtaccaggaatcctaccctccagaccagccacccatatcctgctcagaggagggggctggaaatgccaccctgagccctagaatgggtgaggaatgtgtgagtgtcttggagccactgaaggccttgtgctgaccaagctgactcacctacggaggagcttggctctgtgtggctccaggctgctgggtcttgggctccttccttgcttctcttctgtggccttctctgcttgtgtcactgctatgtgcgttccgaccgcgccgggagtccgactggtctagaaccggctctgagggcactggctagttccgagttgtttctcaggtgtgatcacttctgg

SEQ ID NO: 533167 - DNA, 358 bp, Homo sapiens
caggcatccatatcccaagctcgcaataccacaagaccagtagagctggtagtatataggtctaccagtgacaaggaacagtgacagtcaattgctaattggcatgaatcatgcagttagaagctttcttgaactgtctcctgggaggtgtgggtctcttctctcaatctagagcaaccttctgaacattttcaagactgtcaaaagtcagtaataataacaaaaaaggaaattgcaaaagaagattagcaacaattaccatttttcagtacaaatcaaaacagcaacaaaattcaggctcactgtttaaaagtaaagataaatacctctttgggtgtcatttctgtgcccatttcaa

SEQ ID NO: 533168 - DNA, 756 bp, Homo sapiens
  misc_feature (2)..(2): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (97)..(97): n is a, c, g, or t
  misc_feature (105)..(105): n is a, c, g, or t
  misc_feature (118)..(118): n is a, c, g, or t
  misc_feature (122)..(122): n is a, c, g, or t
  misc_feature (140)..(140): n is a, c, g, or t
  misc_feature (143)..(143): n is a, c, g, or t
  misc_feature (177)..(177): n is a, c, g, or t
  misc_feature (188)..(188): n is a, c, g, or t
  misc_feature (203)..(203): n is a, c, g, or t
  misc_feature (213)..(214): n is a, c, g, or t
  misc_feature (217)..(217): n is a, c, g, or t
  misc_feature (286)..(286): n is a, c, g, or t
  misc_feature (316)..(316): n is a, c, g, or t
  misc_feature (327)..(327): n is a, c, g, or t
  misc_feature (448)..(448): n is a, c, g, or t
  misc_feature (484)..(484): n is a, c, g, or t
  misc_feature (502)..(502): n is a, c, g, or t
  misc_feature (514)..(514): n is a, c, g, or t
  misc_feature (518)..(518): n is a, c, g, or t
  misc_feature (529)..(529): n is a, c, g, or t
  misc_feature (536)..(536): n is a, c, g, or t
  misc_feature (539)..(539): n is a, c, g, or t
  misc_feature (564)..(564): n is a, c, g, or t
  misc_feature (687)..(687): n is a, c, g, or t
  misc_feature (735)..(735): n is a, c, g, or t
angacatttaggacagaggaacagatccatggccactgcctctgcagtatcaaagagaattagttttttcanaaaananattttgggagggaatgtntgggtttntgtggtgggtttngtgnggggtatttgtgatgatnttnggggtgttgagttggtggggaaggtgtttgtttngtgggagttgngtggttatgggtggngaggtgatgnntgntgttgggagggccatgttagcgcatgttaattgaaacagaaaagaaacaaaagaaaagaaaaacaaaanaggtacctgcgtggttcatggatccctagncatccagggancaaattccaaattaggatgacaaagagtttcccttagttcaaaatgacatgtgtttccagtcctaatcccagatgttaatctagccatagtgtcacctgagccttagtggatgtgtatatnagatacttggtctaggtttagaatgacttcacaagntgagaaagggaaaacaancataacccaganttgnatgtaagtatntggggtnaantattaaataatacttaagaggggancttatgagccttagctctttctggaaattcatctgaacaggggtgagggtgggtaggtgggtgcaaatggtgggctccctccagctcagagtgcatttgttaaggtattgccaactttctganagacactagagacaagggaggagaccaagtgctaaagaccttttatcncttttgcaaaaaacaagaaag

SEQ ID NO: 533169 - DNA, 174 bp, Homo sapiens
cactattgcctcgggcgcaatagatattgtaccgcaagggatacagataaaaattataccagcatagtatagcaaggactaacccctataccttctgcattatgaattaactagaaataactttgcaaggagagccaaagctgagacccccgaaaccagaccaggctattgttg

SEQ ID NO: 533170 - DNA, 197 bp, Homo sapiens
  misc_feature (183)..(183): n is a, c, g, or t
cttaacaagggtgatatagacagaaatgccatcctgttctgttcttaggagataattaagaagttaggagtgaattacatggttttgggaacttccttacaaatggttgagaaagaggactaagagtagatgcagaggagtttcaatagcatgttgatgattctgtatttgtacaaaagggtngggtaccgagctcg

SEQ ID NO: 533171 - DNA, 520 bp, Homo sapiens
  misc_feature (66)..(66): n is a, c, g, or t
  misc_feature (80)..(80): n is a, c, g, or t
caacgtcctccggggcatgggggggccctttgtctggttcttgtaaacgagctcaaaaaggttatntaagggccggcgcntctccacacacacacacaccccaggggaaccaagagaaccacgtagaatcctcacccgtggggcccatcacccttcgagaaattccagttgtttttttcccacccgcatcctgcctgtaaatggccggggaaggttttaaaaaaggggggcattgcgatccacccatcggcagccgattccgttttttgatcccggggtgggagggacccgtggggtccctgggtggggcccatgggtgagaccctccagtattgagccctaaagtccaaatgcttgtaggagccaagtggtgttttaagtatttatttaaaacaaaagaatccggttttcccctttgtacttcagggctagcccctgttttgcccacccgaggactggggggtatgttttatgttgggccccctgctgcaaaccaataaacaggggacgcaggggtcca

SEQ ID NO: 533172 - DNA, 185 bp, Homo sapiens
tatggaaaaaccccccgggtttattggcccggggggacgggggccccagagcctctctgggggggggggtccccgttcctttacccacccaaccccaggttttggggcgcccaagatgggcctggccgctgggggagtgtgtttggcaccccgccgctcgtcgggggggccgactatcggctctg

SEQ ID NO: 533173 - DNA, 221 bp, Homo sapiens
tcagtaatagacatggttacctgtcctgcctcttcaagtgtcgactgtataccactgatagcccttgaaatgattatagggtagtgtgggacatgattttcagtagagacacatgcagtattaaaagaacattattactcagctagggcacagatggctcattcctgataatcccagacattgaagggaggccaaggacaggtggatcactatgagtccag

SEQ ID NO: 533174 - DNA, 205 bp, Homo sapiens
  misc_feature (16)..(16): n is a, c, g, or t
accggtccacttcagngtactaggacttctttcccagtcaagttacctgatatttgattaacacagtcactactccctaggaatggctttagtttaaattcaagtattgcattgtatccagttttgtaagaatcactcttaaatctgttgtcatatctattcttgtcatagttggagagtataccatactcgtggaaaggtggga

SEQ ID NO: 533175 - DNA, 799 bp, Homo sapiens
agaatctgatggttttttttctcctggaggtggtggtggtgtggagatcgagtttggctcttgttgtccaggctggaatgcaagggcacaatctcggttcactgcaacctctgccttcggggttcaagcgattctcctgccttagcctcccgagtagctgggattacaggcaccttgccaccacgtccggctaattttggtatttggagtagagacggggtttcaccataagggtcaggctgttctcaaactcctgatctcaggtgatccacccatctcggcctcccaaagtgctgggataacgggcgtgagccaccgcacccggccttgatgtttattttataaagcacggtaatttggtagctgatgacaaagggcagccaaatgttttggataaatcaggggcaacggtattgggtctttggaaataactctgaaaacttcaggacaacatagatttcaacctgatagcacaccacacacaggtgagcggttgcttttaaaattctggaagcctggtcaggttgctctcctaaatttcaggtgtctacaataatcctatctatgaagactgaggatgaagcagatctctgagtgacgtgtaaaaaaaatggcttggagggtgtatggtgggcaacaacggctctctgaattccgtacactgatcccaaagtttttaacctaatcctggtgcaccggggctaaaaggcgcaatatgttccaacctctcgtaaccaccattaatagtttaggggggaaacctttccctgcaggccgcgctggcgagcccgggtgggac

SEQ ID NO: 533176 - DNA, 238 bp, Homo sapiens
ttaactgcataaacctgggcaatgttcaaaactccatctctacaaaaaaacacaagaattagccaggcacggtggtgtgtgtctgtagtctcagctacttaggaggctgaggtgggaagattgctagagccaggaggtcgaggctgcactgagctgtgattgcgctactgtactccaccctgggtgatgaagccctaactcaataaataaataaataaataaataatacaaataaatt

SEQ ID NO: 533177 - DNA, 1228 bp, Homo sapiens
agcggattgcctgtctgtgcaggaagcagctctgagctgccctagtggctggacagctgcacaggtatccccggcccctcccagtcagaccccagaggaaaacttggctcccagtgaagtcacgcgctctccgtggagagcacaggaacggacttgtcgtgtcacggctgtaaggacaacaagatggtccttaaaaaccgaagaggaggacgtgcccatgtggacctgatcaggctagaggagacgtcgaagaactggtagtaacatcctgacggagatacatacaggagctgctggctgaccattccagaggctgcacggatgagatagcagaagtagctgatgaagttgaaaacgctggtggatccacgaaaggaaaggaggaataacgagtgtcacgaggatacaagacaggatagccatgggcaggccagcaattctcctatggaccctaatatcggggagtccaaattctataatatgagaacgaactcgctgaagatacactctgtgaaagacattgcgccagtgtgcttatataaaggcgaaaggggctcatcaagacagtccactcggccgagctacctcggggagagagatgagtttagtatccaggttacttcagtgcatttgtggagctgcatgagtacagcgtgatcttaatctcgtccaggcactacgggaagtatacctgtggagcttccggataaccggagagggccagaagatcgaccggatgatggaggcgtatgcccagcgatatggtcagtgcattaatgggacgatggttccaaggaccacgggatacgctgggtacggtcatcgtaccataggccaatcacatcatgttggaacacccagtatggcacaaacccccaaaaggctcaaagatatagcccccatgggggagaaggtacaatggcaagaaacgcgagagacaaagagagggaacggagagacacataccggcaaagtacacactacggcgaaacacacaccatgaaaaacataaagacaagaaacccctatagaaacaccacaaaaacagccggggaaaataccccaccaacaaacatcatctgaactaaccaaaccatgaacagcatgacaatagaaaacactacgaggtgacaagtcaaatagaagtgactaaaccgaggaaatagcacgacaagcagaaatcaacagtagaacaccagaaataaggacacacagaaccaccaaacaa

SEQ ID NO: 533178 - DNA, 120 bp, Homo sapiens
cgcgaggttgttcccaatatttggtagcactttaaaactcgagcgcggggtggaaaacccgtttgctttgtgtgctgatgaaaggcagaaaaccacatccagtaacccctgccacaacct

SEQ ID NO: 533179 - DNA, 250 bp, Homo sapiens
taaaaggaagtagtagatggttatactcaagtttgggttattcagaattaccaggattgaggaagaaaaagggtgttcaaattcctagggttctgagagtatttatcttcaggtcacgagcatgaaagagagtttcaagtaagtgacccttcataagatttaaaccttctgtccttttcatctgaacctatagttttaatgtcttttcctcagatgatagagatgttttgggaagggtcatgttctgcaa

SEQ ID NO: 533180 - DNA, 1507 bp, Homo sapiens
  misc_feature (825)..(825): n is a, c, g, or t
agcgtgggaggcaggagcagacaaaccacacagccaagggatttgaattaactcagccattttggaggaacttggggaacatgaaaaaaaaaaaaaaaaaacaacaaccttttttaaaagaaaaaacagcggggaagaaaaaaattagctctcctatgggatgagtttttcatcctctcctccacatggaattcctttccctgttccccgtgaatgaaacacagcccgggtgggcccgatgtgggggcacaaggaacgccagaaagggaacccagaaattcccaggtggcccttacgaccgcacaccagccagagaccacatcttcaccacccacaacacagggtttgctacaggaacaacaacaccaaaaacgttgcttgggccggggaatatatacccgaaacgccgatagtatattaactgtggcgtgtggacaggaaaaagaatttcgagatgtgttgagaaagagacaacatttacaatttagcgcagatgtagagagagacatttgtgtggtagaaaaagggggggcgaccagacacagacaagatctcaacatgggtcagttggggagaaaaacagaggagaggggcaatatgttatattatctggtgtgggaaacattgtgggggtgcaacacgtggctgtgtgaagagaacaatgaacgagaaaagagacaaatgctagcaggaaacatagacaacgccccagccgcatagtgcaccagccacacacggcgggaaatctgcctatgttgagggacgtatcactcgttatgttgcgtaccacctgttgtgttgatgacgactcaaaccccgctggtngtttgtggggggaacaacacaccccggcgtgcgggagcacacatggcgggggacacaactgggtgggacaacctctgctagtagggcgcctgtgggaaccacttttgtcacgcacagacaagaggacaacaagacagaatgaggcactctctttaagacacgcaacgcaccagtgtgttgggacagatgtccgaaacacgatgagagcagaggcacagcaagcaatgcagcgacgacgcagaagcgagacagccagcccaacatacgagcacagagagacagatagcagacgagacagagaagcgaggaaacagcaaaaccacgtccaccgagccagcacgcggtgcgagtgtgacgaccgagcgcgccgagagacaggtagaggagggaggggataaacagcaacaacccaccgaaagggaggaggggggaggagcgaaccagcaaccgaacaccacaagcgacatagaagtggggagaggcagcaaccgaatatagcaagaggaaggacggtcgatataagttcagaacacaaacgagactgagatgaggaggaagacaacaaaacgatggagggagaacatgaagcagaagaaagagcactagcaggtgaggaaaaaaacaagacggagtaggtaggacagcgggcaaccacacagacacacccacaaaaacagagagg

SEQ ID NO: 533181 - DNA, 177 bp, Homo sapiens
ttcacagggggacactcaagaattttggacagaggaatggcatgatgatatagaccgaatcttccaggaagctgttcaggacagtgaaccatagggtaagtagcactggctttggctacggcctcctagtgtcaaccaagacaagacttttatcaatagcatatgaatatttagtca

SEQ ID NO: 533182 - DNA, 172 bp, Homo sapiens
cggcgtcacgtacggatgtgggcagtctttctccaacgaacactatgggagctgcttccttgatcccatagcatggtcattgcctactgtgaaggacatggctcccggtgatccatgcattcatcgctcacacacagaaaacacagcactcctcagatgttgtgcctgcagg

SEQ ID NO: 533183 - DNA, 208 bp, Homo sapiens
  misc_feature (12)..(12): n is a, c, g, or t
gctgcgacccgnggttatgtcttacgctgcaggagcagccctaaaaagaaaaaaaaaaacatggtaaatagacccccccccaagatataggcaactgatttttggacaaaagagcaaaggtaatacaagaagacaaagatagtgtctttaacaaatgaagctggaacaacggggcatactcaagtgaaaccgtaagacataaccgcgg

SEQ ID NO: 533184 - DNA, 731 bp, Homo sapiens
actttgggaggccgaggtgtgtgcatcacgaggtcaggagctcaagagcagcctggccaatatggtaacacactccatctctactcaaggaaatacagaaaaattacgctgggtgtggtgtgtacagccgccataatggtcccaggtcgtaccttggcagagctgctggcagaatgcagtatgctggagagtctgggcaggcaggaggttgacagtgatgctagagatcacgccaggctgtattctgagcctgggaaccctatgagctgcgactccatctcagtaatactaccattcacatccactgaagagttctactcatcgcaatatatagaaaccaaagaatactatccaagatgatacctatacccatggatggaggacgcaggccttccgtccgcaaaacaaaaagagcatcgctatttaaataataaccaggtcagcagtggggcgcactccctgctaatgcgacaacaacgccagatagatcactcgccgtgacacgaccctagtaattcccaagtggggtcaccggggcgtaccgggcaaaacgcgagtatggcatatgcgccctcgagaaagtaaaacagctcctaaggaacccacggtacccgtggtctgctgaaaccaacggaatgtgcagtttaccacggaccaatgaacagggagcactacacaacctacggagatccactggcggggaccatcctgaaagtacccccacacgaagg

SEQ ID NO: 533185 - DNA, 157 bp, Homo sapiens
  misc_feature (20)..(20): n is a, c, g, or t
  misc_feature (38)..(38): n is a, c, g, or t
  misc_feature (71)..(71): n is a, c, g, or t
  misc_feature (95)..(95): n is a, c, g, or t
  misc_feature (104)..(105): n is a, c, g, or t
  misc_feature (107)..(107): n is a, c, g, or t
  misc_feature (113)..(114): n is a, c, g, or t
  misc_feature (139)..(139): n is a, c, g, or t
aacgcacaaaatgtctatgnacaattaactacagattngcaaataatgtcactaagctttattcagtcaanacagatggcatgtgaagatgtaanatgcttttnnanaatttnnatatgggttatttgtaaataactanattgctgacaaacataaa

SEQ ID NO: 533186 - DNA, 337 bp, Homo sapiens
caggctgagcaacgagtgcatagctattagcatatcctcagttctgcagctgtacgcgcaggtgtccgtatctacatgcagacagtgtgcacgggtatcagtcgggctgtaggcgtgcatcagcagacagttgtccattggtgtttagcattggatattgatgtgatatgttccaggctatgcgatgcgtgtataagaagattcggtcctggctctctgttcctaccgatcgtaggagtacagacagccagtgcaagccgcagggttctggacaatgctgacgttgtcgcagtgtcttactacggacgtgtatcctttgtattggcgttactgtggc

SEQ ID NO: 533187 - DNA, 353 bp, Homo sapiens
ccctgattgctgcctgctgagcagttctcacttatcgaagtgatccagcgggtagttctccccgtaggtctgcaggtggcgggccagagactcctgctgcttgaggagctgcacgctcatctcctgatacacgtctgagaagagcagcgtgaggttggttttgcgcttccgctcggcctgctcaaagtcccccatcaccttcctgcggaactgcttcctccaggccttctcctgctcctcatcccaccagccttggctcagcagatagtgccgcagccggcagatgcgctggacctgtttatcccagtaattgacctcatccaccgagcgggacgctgaactgacgtcactgt

SEQ ID NO: 533188 - DNA, 168 bp, Homo sapiens
  misc_feature (32)..(32): n is a, c, g, or t
  misc_feature (117)..(117): n is a, c, g, or t
  misc_feature (151)..(151): n is a, c, g, or t
ggaagctcaatgtccggcaggtcaatgcttcncggacacggatcatttttatctgattccagcctgcttgcaaccctggaatcctcttgttccctgctgcctgccccttgggaaggnacagtgatgtctttaggggaaggaggagcccctntcggcagttgtcttact

SEQ ID NO: 533189 - DNA, 264 bp, Homo sapiens
  misc_feature (27)..(28): n is a, c, g, or t
  misc_feature (40)..(40): n is a, c, g, or t
  misc_feature (63)..(63): n is a, c, g, or t
  misc_feature (96)..(96): n is a, c, g, or t
  misc_feature (101)..(101): n is a, c, g, or t
  misc_feature (215)..(215): n is a, c, g, or t
  misc_feature (217)..(217): n is a, c, g, or t
  misc_feature (227)..(227): n is a, c, g, or t
  misc_feature (238)..(238): n is a, c, g, or t
  misc_feature (244)..(245): n is a, c, g, or t
agagcgtctctacacgcagtcgctgcnngaagtatcccantacagaatcctttccagtctttntcttaggcgatagtgtttgactctgatcttgtntagtnctgtctttgtcactttcccgatctttttcttttttatccttttctcgctcagcatcggattctggagagtcagatttatgtctcctcttcttacttttcttcttatgctttttngnctttttatancttctctcagnctctgnnctagaagaatgttctgaag

SEQ ID NO: 533190 - DNA, 878 bp, Homo sapiens
tgtcggtcctaagttcaatttgattattgacgcagtctcagaggcaaggtgcgttctagatgtcatcctagagaaaacacttcatatataattactcactatttctgtataattacatattgctgtttgtgtgttttatctgtttaccatcttatctcgggcgtcgctgtttcacacaaagaccagttcttggcgaccttacagggcgtactgatattaaggataaaacacttggaacatgattgtctcgtgcgttgtccatggtcactcatcatgtcatgactagttgtcggaggctcgaaaccatagtgtctcgctaatgagagaatttttactagaagggactcaacgtagcgaaaatggagggcacgggtgaggactattaagaagacccataggaacggtgcttaagagtgttgcctgataaaactaatgtgatagactgttcccctgggagtttaacgcaagataataatcgcattgcatgtatagttctaccccccctgattgtgcgtggtggccgttgtacagcatgacacaattcgtggtttatataaagggaataggattgttttaacagacgtcgtgaaacacagaataatacaacattactatgataaccaaaaacacaagaagggaggggggtgggggccatccaaaataaattttcgctcagggatgggcggagcacaaaggataggtgaggcgtacctaacaaaaacttttttgtaagcacaggggaggcgcaccccccaaaagcgtgcagtccgcaattttattaacgctgatgccaatggcggcggggttttaagaacagtgcacaattcaatgtggcgacaggtgtgtattagtggggtacaaggcaagaaagaaactgt

SEQ ID NO: 533191 - DNA, 491 bp, Homo sapiens
gagtgatggtaatagtttcacctgaggaccaaaaaaacatcatgcaatacgttgttgtttacgatgagacatccttggtcacagggggggggaggaaacaaatggaataatgatatggctaggttcccaggaccaaggaacagtacagttttactggagcagcccttctcaatggttatgtgggagaaaattaagccctacaaaaaatgatgagtgagtacattctcaattctcccaaggaaaaaacatagctagtatcattctagagatacaggacacaaactgctacctataatctgatacatacaacagatgctttaagatctcaaggtagaattctcccatggaactccagttgagaagggctaaattagagtaaaaacgcatttgagcagaagtggggcagtaagaaaggtaacagaagcgggttatgtgcatggagggtttgtgtgagtgtaatgtgatgcctttgcaagtagtcaatgaggacg

SEQ ID NO: 533192 - DNA, 427 bp, Homo sapiens
cattacaaacacacaacacacaccacttttcttgttgctgagagcttttgactaacacttttctccatttctgtcttcctctttctacactgggctgcatgatacaaattgttggttttgtgagtccttcttagcctacaactactcagctgtgcccatatgctgcaaaagcagctacataggcaatatgcaaataaatgggtgtgtctatatgccaataaaacttatatacacaaaaagaggcagcaggcccgatttggcctgtggggcccgtaattagcaaatccctactccgatagaaagaaagtcaggaaaagaagacctggtaaggcacaggccaagtccattttactgatgctgaacttatgatttctgatgctgcctctaattccttctgtagactcacgcaatctacccatgtataaac

SEQ ID NO: 533193 - DNA, 578 bp, Homo sapiens
  misc_feature (322)..(322): n is a, c, g, or t
  misc_feature (326)..(326): n is a, c, g, or t
  misc_feature (365)..(366): n is a, c, g, or t
  misc_feature (431)..(431): n is a, c, g, or t
  misc_feature (489)..(489): n is a, c, g, or t
agacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagaagtagcattctgggcactgtgcacaaagccaaaggcctggagtttgacactgtgcatgttttggatgattttgtgaaagtgccttgtgcccggcataacctgccccagcttccgcacgttcagagttggaaaggtccanttgntttcctggcagcgcactgcaatggcgcacattctactgnngtatgttgccagtaactcgagccaagcaagcgtctcatcatgaccaaatcattggaaaacatttngaacttggctggggagtacttcttgcaagcagagctgacaagcaacgtcttaaaaacnaggccgtggttgccgcctgggccttggccggcttgggggggaaaccaaaggcttggccaaagcaaaaaattggccccaaatttcccccc

SEQ ID NO: 533194 - DNA, 615 bp, Homo sapiens
gaggacgtaacggaggctttttgaagccgttgccggagccatgacccttggtggccagtgtgagctcgttctacagaagcatatgaaaaagcatagcgactcggatatgggaaagcgccgagatgacgacctttctgctgccgcccgcaagcagagggacttggagatcatgcatcacaagcagaagaaggcaaacgagaacaatgaggaacccaagtcgctttgcagctacgcgttcaaccctcttgccctttgcctgtgtgcctggagccagtcccaccacgctcgcgcttgcttctgtagtgatcacaggtaccagcaccgatagcattgcctttgccctgagtctgcacaggtacccttttgcgcttacttcccctcaggtagcctctgtccccctgtgccactcccgagggcgagggagttaccccttcccagagctttttattcctgagaggctcaccccaatgcattaatagcagctgtgtatacagagacatctggagatctccccttggcggccgcctcgcccagtgccctttagatatagcaggtttatgatgcggctgcattttttgccaacttgaacatttgccccatttcaacgcttcttcc

SEQ ID NO: 533195 - DNA, 347 bp, Homo sapiens
  misc_feature (221)..(221): n is a, c, g, or t
  misc_feature (244)..(244): n is a, c, g, or t
  misc_feature (251)..(251): n is a, c, g, or t
  misc_feature (267)..(267): n is a, c, g, or t
ggtggccggtcgtctccgggcctctagtcttccctgctctccgaggtagagcggggtatggatgcttagtggccctcacttctctcggtctataccggccccatctgagcacccatggctcaccatcagatcaaccttggattttacatcataaggtattcaccacgggagcttcacttggttactaaattattaatttctggctccaaaatggtatctcngaggctgagcattataagaaaangatctcngctccttttcattacngaaaatcaccgggggcttatttcagaacaacttccacttattttccatgggcccccaaactccctaagttaaaagtatgg

SEQ ID NO: 533196 - DNA, 214 bp, Homo sapiens
acgtacccaaaaatctaggccagtgaccccccccaggtctggtacattcaaggggggagctggctcccctgacgtgcaaataaaggggtccaggtccctcgccaagtcagcagcaggtggggtaatggggttcaatgccccaatgcactctcgctctcaaagtggagaaaagggggggaggggctagcgcaaacttcaattccgtgggaagggg

SEQ ID NO: 533197 - DNA, 322 bp, Homo sapiens
gagcccttttgggtccccctttccctgggccccagccctccctttctgggtgcagaaaacgaactaaggttgcctaaagggcagatttgccccccccaagtttttgtcctggcaaacagggttgttttaaaattatgcgctaattttggatgggggccccccaaaggccttacttaaagattgaaatttccaaccatctttagtttttcaatgggaaaatatcagctaggggaaaaccctccagccccttattattttttgatcttcaggtggatttttgggaaaattttaaaacatctttttccatttttgaaaaaaaaaa

SEQ ID NO: 533198 - DNA, 371 bp, Homo sapiens
ccgtgtcaggtacctggtcatccatgatctctcaaggagatgtacaaggaaattcatattattgatatgtctgctaacacaaaatccattccatagcccatagatcaaggagttatttcaactttcaagacttattatttaaggaatacattacataagcctacagctgccatagatggtgattcctctgatggatctgggcaaagaaaactaaaaaccttctagaatgaattctccattctagatgtcattaggaattcatgattcacaggaggaggtcaaaatatcagcacaaacagtttggaaggagttgattccaatcctcatggatgactttgaggcactaacaacggcctcactgacaacggact

SEQ ID NO: 533199 - DNA, 613 bp, Homo sapiens
tctttgtttctggcccatcgcctaataagaagggtaaatcttctgagctcagaagtgaaggacggcccaattgttctccttagggaacgaaaagccaagagattgttttacagcccgtgctctaagggcatttgaaagactgccaggtagggcgagcctgaaatggtctgggggattctctctagccgtgactccgctgctttgaaggtcaactgagaagtcttgtgggacacagacttgagttaggaagccctcagtcccttgccttccacggtggccagccctggtgccatcattgggtgaagccccccccggattcacggcccccaactgcttcagggtacttcgtagactctgcctccctacatggcgaaaaaggtatttgggttctcctccggtttttttttaaatcgtgggtggtgggcaccggtttgaaccctcggaaacccctccgttgacagttgttttggataggttgggggtcccccatggctgcctttgaaggcagtgtctatttttaggggagggcttcccttttttttgtggccattccctttccttttctggaaataaaatgtaaaacctggacaatataaccaagtaaaaaaaaaaa

SEQ ID NO: 533200 - DNA, 165 bp, Homo sapiens
caaaagcatgtaaatgcaacaaatttcattacctcacctaaagcagcattcaaatgctagtggcaaaatcaaagattttttcaatcatgaaagaagtagcatccaagcacccaccctatctttaaaaaatttatttcacagatattggcctaaatgaaggggatc

SEQ ID NO: 533201 - DNA, 862 bp, Homo sapiens
ttagccgggcggtacctttcaccgagctgtgtccattgcccttttgggcacattaggcagttgtccaaaaccgggtggtccctccgatttcccgggttttgtgaccacccctcccccggatactgccacggcctgtggtgaaagttcgtccctcccactgggccacctcccaatgtgtgcgccttcactcctgggaccttctctttagccgatcccggcaccttccgggggaccccggcttctttgtggttactgacccccggggttaccccccagcctctccggaggcattttatgttacctacctacccttgcgctgtgttaacaccagattctcctctgcgctattggaccattgctctccccatgcaccaccagggagctcactccgtgggtttaattggtggatgctggctcgggaaattctgcgccatgcgtggccaccctttcccgtggcacacccctggggggtcattgcctgatctgtacattcttaccagagatcctgaagagattgtaaaagaagagccaggcttctttctgagaaggccagtgacccaggaggaatttcagggtgaatggactgctccccgctcctgagttcactgctactccagccctgaggttcgccagactggtctgaaggtgtcaccaggtgccctctgtgcctattcacgccaattccctactgaaggactggagcgctcagacctccccggaagactggtttgccagactccccctgctcaggcccctgaatgggtaggagccacccctgactggttttaagactgtttttgcataggcttttaagacccagccatggaaaaatggttgatggaaaataaacacccagttttta

SEQ ID NO: 533202 - DNA, 426 bp, Homo sapiens
  misc_feature (174)..(174): n is a, c, g, or t
  misc_feature (177)..(177): n is a, c, g, or t
gacgtaggctttcctaccatacagcctctgaccaaactaggctgtcccgaacccctggtaatagaattgtgtacccttatacccagaaggttgggaaagcacccaaatctgcatgtggtgtgtgccccggcagacttcgaaggggttccgtgctgtaagagacccatataaagntgntttagatgaagagttggtcccacaagaccacaaagagaaacacatggcacgcacacgggcctcattgggtggtgtccacatgtggtgctataaatgtggtcgtgaccacggatccagcgtgcgtttccttatcgaggaccacgaaaaatcggttgtgtaaagattgttgaaggccccagccccgagtccagaaagcgtaaattaaaaaatggaacttttttgagttaattaaaatggaaagacccctgt

SEQ ID NO: 533203 - DNA, 124 bp, Homo sapiens
tattctcattgctttcgcgtttgataaatgcaggctaaaatcagtcccctgctggatctgtgaaaataattaacgtggcaggcaattacactgaggaggctctagtccccggctttctacttaa

SEQ ID NO: 533204 - DNA, 363 bp, Homo sapiens
  misc_feature (40)..(40): n is a, c, g, or t
ttttttgaacagtctgggaaaggaaaatggatttacttgntgattttgtttatggtggaagcaccatgttctgttccttttttaggttcagtttgttgtgtaaatggtggttttttttggtgtgagatttggtgatggtggcagggttcctttgaagagatggtttcactttgtggtttgaagaacaaatcagagaagagtatggtttggccagaggccccatccggtccatgtcaccgtgagtacacccctatgattggtttgttgtcaagaagtaggtttccaccaggtgtatttaacactacaatgcattttttaaactatatttgcatccaagacaataaagacaccttattttttttg

SEQ ID NO: 533205 - DNA, 112 bp, Homo sapiens
cacgagcaagacacgccacgcacctgcaaccaaccgaccgtgtgctgacgaacatcgcggcggcccagacgagccacacgcagtagcacacgcagccatgtcactagcccgt

SEQ ID NO: 533206 - DNA, 342 bp, Homo sapiens
tgcacctcatggaaatcttcacaagtcgaaaagataccagaatgaataatctccgtgagaataaccccgctcagagatcactacacaaaacagacaaggttcatatatgactactcttcggtaaaaatgtatcttcaaaagaaagggagaaaagaagttcactaaacttatactgattcccagtgctaaaccaaaactgattccatttcacgtccgtggggcaaaacttttcgcctctcacaccctgttcatctacccacaacaccctctaacaaaataaagacataagtaaatcaaaatttgaaatcagttaaggaactcttgcaaggaggctcaccacgg

SEQ ID NO: 533207 - DNA, 280 bp, Homo sapiens
tgatctagaggatctcagggcgcccttttttattacatgtatcctattagtctggtccctctagagaaacatgactaatacatggagtaagatagttcctgtcctttttttttttttaaaaaagaaaagggaatttggggatatggccaaggtgggaaggcaggggtaatgggaaggcaaaacaagggaagtgcattgagaccctaaagctcgggggtcaaaaaggttcttccaaccttcagcttccaaaggtaatcgggaaattacaggtgatcccaca

SEQ ID NO: 533208 - DNA, 323 bp, Homo sapiens
ggtagagatagggctttgccttgttgagcaggcggctctggaattcataggctcaagggatccacctgccttggcctcccagagtgttagaattacaggcgtgacacatgcacccagcctaatatttctaattaagtttagcctgtgtatatttcatctagcaacatgagtaaaggaatgtaagtctagatatacaaaggtttaatgtctgcctttttggcgataaagtcatttactgtgtgtggaaccccttttctttctttctttttttttttttttttccaagactggatatcactgtgttgcccaggctggagttcagt

SEQ ID NO: 533209 - DNA, 213 bp, Homo sapiens
gatcccgccggaagcgccaggcactgatggcgtgcacccgggatgacgagatacgagatacgctattcaagaggtggtgctcgactcgggtgactcaggtggtgaggcgacgagcaacctgcgtgatcgtcgcgttcagctccgcaacgatgtttcgagacgcgtgcgagagacaagtagcacctactcggacgatggagcttcgctcaatcc

SEQ ID NO: 533210 - DNA, 377 bp, Homo sapiens
cgtcgaccaagattttatatttacaaaacattgtaagaagtacaaagtcaatagtggtactgttgtagagaagaacatgtttcttttaagtgtcggtctagcttttctacccaaaatctcccaattggcctgtaaagccacatacaagaggaagataaacagcctctcttgacccctcttgacccctaacagtctttgaacagtgagttggtaaaaacagtcttcaagagtacaacaccaaaagagacccgtcaatagtattgtggcaggtagcattttggttatagttttgggccagtaagcgaaatgttgctggttcgaaaaaagccggcaaggtgaaatatctgtctatgtgcccacgagcaaggcgcgtcgac

SEQ ID NO: 533211 - DNA, 1295 bp, Homo sapiens
acccactgtaggaacagcgcagattccgcacatctacagcagcagtcactccactgcaggatagcaggcacagattcccacatctacagtacgggaccacactgcaggaagagtgcagattgcccacatctacagtcacggcatcctcactgcaggaacagcgcagattgccctcgatgctaacagcacagctactccattggagggataggtgcaaattcccacatctacgagcacagcatgccactgcaggaacagtgtacagattcccacatcatacagtacggtaccacacgtgtcagtgaacagtgcagattcccagatctacagtacggcagcccagtgcagtgaaacagcgcagatttcccgtgatctacagtcacagcatctcagtgcagggacagtgctagattcccaacatctagcagcgagcagtgccacacgtgcaggaacggcagcagattgcgccaaatctagcagtgcaagtgacccactggcagcgacacagtgccagatctccgcacaatctaacagacaaacgagagatcgacacctggcaggaacccagtgtcacgaattcacctctgcagtcgcgccacaagcgagtactgccaagtccatcaacatgaacgggaagtcaacaccaggccacggaccgccaaggccatacgccacacggggcacaaagacgaacactaccagtgcaccacacgtccggccgaacgcaacacacctcagacccgacaagtacatcacccacgacaacacaccaccccgcagcccgacccagagccacaccagcgccagaaccagcatgaaacaaccataaatacgcgacacggatgaacgacaacaaagaccgagccacacccacacgcaccggcacaaagcagccaaaaccgaccatgaccaccaggcacaaaagaaacgcacactgaaagcgaatcgagaacacacaccgaacacaaaagcgcaaagagcgaccacacgaacaacgcccccagagtgaccacccggaaacaccagcacaaaaacaaagacgcaaggtgcacacaacgcgacacgccgccacaacggcacccgaaaacaagagcaaaacgcagatgaaagaggactgcaaaagggacgaccgcaaggccaagcaacgaaaaccaagggaacacaaatacacaaacaacacagacaaatacaacaaaggataaaagccaaaacaccagcaagcaggaggtacaacatgccagcaaccacaatacacgagcgcaccggacatcacaacgcgacacgcacagagaccc

SEQ ID NO: 533212 - DNA, 153 bp, Homo sapiens
gccacagacctacgccagagccacagcaacacgggatccgagccacgtctgcgacctacaccacagctcatggcaacgccggatccttaacccactgagcaaggccagggactgaacccgcaacctcatggttcccagtcagattcgttaacc

SEQ ID NO: 533213 - DNA, 169 bp, Homo sapiens
cagaccaaaccaatgtaggttgatcgattgatgtctatgtctccataaaaggtatgcaaccaagctgtatcctgaccaccttgtgcacatgttctcagcatctcctgggtcacagaatattgatgagtcatattcggctcacaataaatctcttcaaatgttaaaaaaa

SEQ ID NO: 533214 - DNA, 700 bp, Homo sapiens
  misc_feature (184)..(184): n is a, c, g, or t
cctgcaccggaagtgctgtcggcctcaccgtaggtggtagtagttccttacaacaatgcctgcatgcaaaagctgaacaagaacagtagtaagggctacggctaagacagattctcgctcgcatacagctgggcacaagtttcctgtggaccgcatcccaagccacatgaagactcgctcctcnatccatgatagggtgggtgccactgttgcagtgtacagtgttcgatgtctggagaacctcactgcacaggtgctgaagctgacaggtaatgcttctaaggatctcgaagtatagcgtatcactccgcgtctcttgcagcttgcaatcagtggtgatgaagagttgtattctcttatcaaggccaccatagctgagggtggtgtgatccctcacatccacatatctctgattggaaagtagggtcagcagatatctgcttagagggatgctttatacgaccctcttcgtccccgtcattgtactgtcagtgggacacaagaaataatggggatatgtggaatttttaacaacagttaaatggagtagcatagacaatgactgtagacgtgataaaagaaacatttgtatgttcttagacccgaagtttgatcaaagtaccgtttcatgtggtgacagtggtgtgttaattgactaggtttccccgtgtgttttatacaaaaatggaattgatgagcc

SEQ ID NO: 533215 - DNA, 967 bp, Homo sapiens
  misc_feature (619)..(619): n is a, c, g, or t
  misc_feature (630)..(630): n is a, c, g, or t
  misc_feature (686)..(686): n is a, c, g, or t
  misc_feature (688)..(688): n is a, c, g, or t
  misc_feature (694)..(694): n is a, c, g, or t
  misc_feature (756)..(756): n is a, c, g, or t
  misc_feature (765)..(765): n is a, c, g, or t
  misc_feature (781)..(781): n is a, c, g, or t
  misc_feature (787)..(787): n is a, c, g, or t
  misc_feature (864)..(864): n is a, c, g, or t
  misc_feature (877)..(877): n is a, c, g, or t
  misc_feature (884)..(884): n is a, c, g, or t
  misc_feature (887)..(887): n is a, c, g, or t
  misc_feature (906)..(906): n is a, c, g, or t
  misc_feature (927)..(927): n is a, c, g, or t
  misc_feature (934)..(934): n is a, c, g, or t
  misc_feature (937)..(937): n is a, c, g, or t
  misc_feature (941)..(941): n is a, c, g, or t
cccaagagtttttgtgtagttgtgtgtgcgcccgggggtttgtgtacgccctggttgtgtgtgtctggtgtcgacctcccagtcttctgggtgtcccttgtggccattcgccgtttcccgacttgtgcctgttatcgtcttccctgctggagagtggttctttccagggccttccggggcccctgttcatctgggggccctggcaccggatgagctcctttgtagtgtgccatgttgctggggatcttcatgctgccatctcccctgcccttgtcaggcgttcccctcttgttctgttgttatggaaacatagccacacgttgataattgaagaacagaatttttttggttcctgtaacgttcagatcttgatgagcaagaccctatactcagaggcgacaagcttatttataaagctgaatcctgctaaagtgctgacatgaagactgctggtgcacagccatctcattttcgcccctccccagatagaagccagttgtccccccaatactctgctccctccactgctggatccctgtagggagaagacctgtcccacagtgaccttccgaacagccttctgataccaagaggattcagtttccatcttctcaacttnttaacacaganacacttcctgcgagcatatcgacaactctcgggccaggcgctgtggctcacacctntnatcccngcactttaggaggccgaggcaggcggatgcctgagctcaggagttcaagatcagtctgggcnacacgatgnaactccgtctctactnaatacnaaaattatccaggcatggtggcgtacgccgtagtcccagctactcaggaggctgaggcaggagaatgcttgaacccnggaggaagaggtncagtganccnagatcatgccacatcactncaacctgggcaacagacaagnacccatntcnaacnaaccttaccaaccaaaaaaaataaaa

SEQ ID NO: 533216 - DNA, 219 bp, Homo sapiens
ttatgtattcatgacgtgggacaagtttataatgcaaatatcactcattaaaaaacttaggtacatattacaacattacagatacttctctttaagctgctttggtttcaccatggagcacttggagcatcaattcacgttcaagacacctaaagtacgcagtcctcccaggtaaatattcactacaaatgggaagcatcttgcctttttcaagtatat

SEQ ID NO: 533217 - DNA, 195 bp, Homo sapiens
  misc_feature (41)..(41): n is a, c, g, or t
  misc_feature (165)..(165): n is a, c, g, or t
tgcctgagagccaggtggtagagatgtaatgtggagatggncgctgcactggcgtggactgagccgattctgaacgagatgcgtgaccagtatgagaagatggcagagaagaaccgcaaggatgccgaggaatggttcttcaccaagacagaggagctgaaccgngagtggccaccaacaggtgagcgtggtgca

SEQ ID NO: 533218 - DNA, 499 bp, Homo sapiens
gcggatcacctgaggtcaggagttcgagaccagcctggccaacatggtgaaacctcatctttaataaaaatacaaaaattaactgggcgtggtggtgcccgcctgtaatcccagctactcaggaggctgaggcaggagaataacttgaccccgggaggcggagtttgcagtgagccaagatcatgccactgcactccagcctggtgacagagacagactccatctgttgatagtgaggtggaatttcaactctatagccaaatccattatgcccaagatcttgatgatgtcattagggaggaagagcatgaataaaagaactcttggaattctgaatctttgcgtagtaaaccaaatcaggaaaagcttattgtcctttcagatagtgaggtcatccaactgtccaatgggacagaggtcattcctttttctgaataaaacagtttttttggttttataggaaaaaatggttgaattttattccaaaaaaattgccctg

SEQ ID NO: 533219 - DNA, 376 bp, Homo sapiens
ttgtcagcacccacttcgatcgctgatccagcagccttggcctcccaaagtgctgggactacagcatagccacagcacctggcatcagctagtttgttttttttggtttgtttgtttttgagacagagtcttgctcctgtcgcccaggctggagtgtagctcagctctctgcaacctctgcctcccgggttcaagcaattctcctgcctcagcctcccgagtaactgagactacaggtgtgcaccaccatgcccagccaatttttgtgttttcagtagagacgaggtttcaccatgttggccaggatggtcttgaactcctgaccttgtgatctacccgcctaggcctctcaatgtgctggatcagcggatcgagt

SEQ ID NO: 533220 - DNA, 249 bp, Homo sapiens
gtgtactcagaccctgttcacctgggtgtcacagtaaaggctgcagaacagcatagattgctgccttctccttcttctggaaacttcatcccaggaggatacccgcccaatgccaactggagcccttttgtatgaggtgtctgtctacccctgttaggaggtttatcccagtcaggaggtttctcccagtcaggagtcacggggaacccacttgaggagacagtctgtctcttagcagagctggtgcac

SEQ ID NO: 533221 - DNA, 413 bp, Homo sapiens
gcacgaggcaccgatcatcaagccgcccccgggagtttcttctacgtcgcgaagtggcagcccggtgatatcaatcaggtgctccgggcggctgatgttctctttcatcaggtccagcagattggtgccaccggcgataaaccgcgacgccgggctgaccaggtgcaccgcctcctgcacgtcggccggcttgctgtaatggaagggattcattgctcacctccctgcacgcggcacgccggcaaggcttcttcgatggcatcgcggatgttgttgtaggcgccgcagcggcaaaggttgccgctcatcagttcctggatctgcgcggtgtcgtgggcacggccttcacgggccaggcccaccgccgagcagatttgccccggcgtgcagtagccacactggaaggcatcgtg

SEQ ID NO: 533222 - DNA, 193 bp, Homo sapiens
atctcggcccctacatacccccatttactcaaaattttcaacatcacccatctatctatccctccctccaaccattcttccatgcatccgtacttccaaataactatccatgaatctataacttaatccatccctccctccatccattcccattcctccatgcatccatctatccatccatccattctaccct

SEQ ID NO: 533223 - DNA, 267 bp, Homo sapiens
  misc_feature (56)..(57): n is a, c, g, or t
  misc_feature (82)..(82): n is a, c, g, or t
  misc_feature (163)..(163): n is a, c, g, or t
  misc_feature (202)..(202): n is a, c, g, or t
  misc_feature (225)..(225): n is a, c, g, or t
  misc_feature (246)..(246): n is a, c, g, or t
  misc_feature (251)..(251): n is a, c, g, or t
gtgggaccatcctggcaaccccggtgtttggctgggttctagcgtagcgtctgtgnngccggtggggacctgcggtggagtnggaggccagtctcaccaagaggtggagaggacgggcttaggctggagcgcctagaggagcatttttccaggcggggcccangcagaggctccgacagggagcctggccatagtcgcgcanccgggaggtggagcgcgtcccanacccgagcccccgacctcagncaaanccatttcttctgtcct

SEQ ID NO: 533224 - DNA, 256 bp, Homo sapiens
  misc_feature (56)..(57): n is a, c, g, or t
  misc_feature (82)..(82): n is a, c, g, or t
gtgggaccatcctggcaaccccggtgtttggctgggttctagcgtagcgtctgtgnngccggtggggacctgcggtggagtnggaggccagtctcaccaagaggtggagaggacgggcttaggctggagcgcctagaggagcatttttccaggatgcctgtttgctttatgtgaccacagagcttacacatctgaatcaggcacaaactctcagattacagacccactatctctgttattgatgtcgtccaatgga

SEQ ID NO: 533225 - DNA, 153 bp, Homo sapiens
acaccgacgagcaggcactggagaccacttcagcgttacgaccttcctgaggtggacgtgtcaggaccggagcacagcgtacagggtaatagtttcatccttaccaccgggctctcgtgctgggctgacgggacctgtgtgagtcttgtctcg

SEQ ID NO: 533226 - DNA, 419 bp, Homo sapiens
ctttgaaggtaaatctaggatgacagtcaacagatcagtgattgccaggagtctggggtagagggagggaagaacagatggagcacagagaatttttagggcagtgaaaatgttctgtatgatactatatataatggatacatgccattatacacttgtccaaatgcacagaatgtacaccaccaagagtgaaccctaatgttaactatggactttgggtgatcatgatgtgtcaatgcaggttcgtcaattgcaacacacgtaccattctagtggagggtgttgataacaggaggctatgcatgtgtgggaccaggggatatatgggaaatctctgtacatgcctctcaattttgctgagaatctgaaactgctcttaatgaagtcttacaaaaataaagaagtctgctttgccttta

SEQ ID NO: 533227 - DNA, 188 bp, Homo sapiens
tctagaggatctccaccacgttgcacccctgactcattaggactagtaagggggaagggacacacaagaagaagggcacctagttctacctcaggcagctcaagcagcgactgcccctcctctagctgtgggggtgagggtcccatagtggtggcacaggccccctatgagtggggtaatctcttgtg

SEQ ID NO: 533228 - DNA, 287 bp, Homo sapiens
tattattcgcatcacccctacacaccgtcgttcacccccgtctcttccttctgcttatcggtttttggaacgggatccatctccaggcagcccaccctggtggggcttgtttcctgaaaccatgatttcttattatcatacataagtctgtccatgagtgcttgcctaccgttgttcggagtctcgctagcctccctcccgcggtgaggtttcttccttctattttgataaattccgttctgtggagatttttcaaacattttttcgactatacataagttatcggc

SEQ ID NO: 533229 - DNA, 93 bp, Homo sapiens
aacatcgaggtcgtaaaccctattgttgatatggatctctatgaataggattgcgctgttatctctagggaacctcaccgttggcaagttatt

SEQ ID NO: 533230 - DNA, 761 bp, Homo sapiens
  misc_feature (48)..(48): n is a, c, g, or t
  misc_feature (67)..(67): n is a, c, g, or t
  misc_feature (73)..(73): n is a, c, g, or t
  misc_feature (96)..(96): n is a, c, g, or t
  misc_feature (416)..(416): n is a, c, g, or t
  misc_feature (438)..(438): n is a, c, g, or t
  misc_feature (449)..(449): n is a, c, g, or t
  misc_feature (731)..(731): n is a, c, g, or t
gtttcagggaaagagtgtttttagccccctccagtgagggtggaggcntctccattcccaatgcagnaaggcngcagcagccacgatgattaggcnttggaggaggaagtgaacggatggggcctcatcctcctgcctccctaaagggtgagggtggaaggatggggctgtgccctcttagggcagggaaaaacagcttggaggggtttctgccatcagagatcccataggaggcaggtcagtcctgcagaatttctccccagtctggcctccagcctccctggcccctttctagaggcctccatcccactggcggcttgctcctgccaccgggcctctgcacagtcacctcctgcagcctggggagtgtcgcctctccacgtcctcaccggcgtatgcctttgcatttcccagangcacgcttcaccccactgagangtaactcagtnttgtgggatcccactgccctccaggtgccgctccgagtgctctacacagattttcattcagtccttgcggcacacgaaggtaggcggccccactgccctcacagaggcttcccatgcaggagccagtgactggcggaggccgctcacactcaggctccgcgaactgcctccctgccctcccctgccccggacagacggtcctccataagaggcaggatttccctgtggtccaaaggtgtgtgtccctgccacattgggagtacagctcactgcggtcctgtncagcttgcccccgtctcccatccacatcag

SEQ ID NO: 533231 - DNA, 681 bp, Homo sapiens
cgtgacgcgtgggtcggcccacgcgtcgctcctctcttctcgtgaacctctcttctctttctcttttcttacatattctactagttgtgttccccttcttcttctcctttctctcctttttctccctcctccttgtctcttttactccattcctgcagaagagagagggctaaacttaaagaaaaaaaaaagggaggaggaggaggaggaggaaccccgcgtacgaatacctatctagatcggttatttatacattttatgattttttttgggagggagggtgtcgggttgcccggctgaagagcaagttatatagaatactaaaaaaagaacattttagggcgatactccagggtttgtttaaactagctcgtgtgtgtatatagcagaagaggcaagaagagaggagcacagacaaggaaggaaccacgaccgaagggatactttatatttcagacctgtctttttgggatttgttcatcttcggctattaccgtgttacccccgttttgttggggcaatctatttaccttcgcgggactgagaaactatagacataattccgacggtggattttcgatcgccgggagttgaatttccccggtatgcggcaccccccttcgcacacttccgaagacaaggcgcgagaccccgggccacggacacacaagagcaaggtgg

SEQ ID NO: 533232 - DNA, 321 bp, Homo sapiens
  misc_feature (117)..(117): n is a, c, g, or t
  misc_feature (194)..(194): n is a, c, g, or t
  misc_feature (309)..(309): n is a, c, g, or t
gagagagaggagggaagccggggaagggggtaggaagaaagctagaggtggcctgcaagctggggctgggggcccccggcgggcggccacacataaatactatggggagtttagccnaatccctgagctccgcgtgtgtctggtggctaaacattctctttctctccggtgcctctgtctcccctcgtgtcccnccctcccacacctccctgaagggacgcccattgggcgctccattcagtggcatgcagggagacctatgggttcagcacacccagagttttatatacaggataatttggtcctganatcaaggaccag

SEQ ID NO: 533233 - DNA, 348 bp, Homo sapiens
ctctattggtggaatactcctcctactgaggccatcaggacttgagggctgtttcatggatcgaagtacctcctccagctgtctggctcggatctacggcacctacaacctttcctaccgagcgctccagctctccttccaggatcaccagcttcctgggcacctcttcatatttgcggtctgaatcctacagcgaagtgctatggcctccttcagctgcatctcctgacaagttccatcttctcctcatccttacatggccccgggtttaccgatgaccttcattcctctatcgctctacatcaggccgccttctcggcctcctccccagcttcttgcagggctgta

SEQ ID NO: 533234 - DNA, 113 bp, Homo sapiens
aaggagctgctatagctctcatcttcacgtcttcactgtcacactcaactctgcctaatttctgagtctttcatttccaagctagggagccagaatcttccatggttcaccca

SEQ ID NO: 533235 - DNA, 163 bp, Homo sapiens
tataagtattcctgatgtagaaaggaatatgctctatatctctgtgaacaaagtacacttgtatcaacgatcacaacacatacaatgagataccatctcacaccagtttagacatggtcgatcgattaaagaggtcagtgaaagaacagagtgcctggacgag

SEQ ID NO: 533236 - DNA, 588 bp, Homo sapiens
actgataatcatgtctaatatgatttgcaaagataggactcatttagtccttctataattgagggaaaaaaggattttaaatacatatgacttacatagctatgaactgatataaatgctgtacatacacacacagaaaacagactagatgaaattgcatcaaaatgctaatacaggttccaaatctgaaaatctgaaattcaaaatgctctaaaactcgaaactttttgagcaccaacatgaacttgaaggaaatgctcaatggagcattttggatttcagatttgggatgcttaaccattaaagcataatgcaaatattctgaatttgaaaaaatccaaaatccaaaacacttctgatctcaaccattccagataagggatactcaacctgtatttattatttctgggtgctaggactgcaagtattttattttctactttcaacttgtagtttccaaatttccaataaataatatgcaatactgtcataatcagaaacacatattatacgaggcaggcagatcacctgaggccagtagttcgagaccagcctgaccaatatggtgaaaacccaactctattaaaa

SEQ ID NO: 533237 - DNA, 714 bp, Homo sapiens
  misc_feature (72)..(72): n is a, c, g, or t
gtatgcatcatttggataaaaaatacatccaaattaagatgttttaacacataggacaaacttgtgcacttntatgccaaaaaaaaaaaaatggggtttctccttcaggggatttctagaaaacacggcctacactttatgaaaacctacataggtattcaccgtgtgacaggtagagctttatcactatctaattcttatgaggctattctatgtactttccaggtgcatccacttagcaacaagctaagagctacagggcaggctaacccttctaaaatctcccttgtgcccgtgaacttctccaatcgtggtcaccagcgtgcgtggccaccaaggccaccacacggggctaactgccctcggatcaactatttacgaacacaccctcacagacacatttacctcagtgaccagctcaccactaaagatcttccccctatggggggcctataacgtgggcaacgccaacggttctaattctagaacttatgaccacctccacaccctccccacaatcggggataacggcgccataaggcccacctcgaaccatctaccccgtcatctactaacccacaccctcgggctagaccgccactcactgatacaagcgacaaactgacacgaactgcccaacacgtggaaccccccacgccctccggcacagcggcaggggtaaccccaccccaaacatcagcgggcaaaacgaca

SEQ ID NO: 533238 - DNA, 214 bp, Homo sapiens
tggggtgttggaaggggtggaggagggggttcctgctgttcccaaaaccctttagttaaaagcgaagggatttcgcggtgctgtagttcagcgcctggggaaaggagtttgctcccaaaaaggcttcggtaggcaggggaggggcttttctcttgtaaagccaagctcatctctcaaagggttttgagctcgaatgtcagaaactgtctattcg

SEQ ID NO: 533239 - DNA, 385 bp, Homo sapiens
  misc_feature (209)..(209): n is a, c, g, or t
tgagacagggtctacctctgtcacccaggagttcagtggcacaatcttggctcactgcaaccttggcctccagggttcaagcagttctcctgcttcagccttctgagtagctgggactacaggtgtgcaacacacacccagctaatttttgtatttttttggtagacacagggtttcaccatgttggccacgctggtctcgaactcttngacctcaactgatctgcccaccttggcctcccaaataaccttaaatcttaaggttgatgcatgcctcttaatctcttgggtttgcccatcagaaactgaatcatggggctcactagggagaaatttgtcagttttaaaaatcctatgctttttcaaaagaggtttttatttttggg

SEQ ID NO: 533240 - DNA, 453 bp, Homo sapiens
  misc_feature (435)..(435): n is a, c, g, or t
cggtgcgctgtcgggcgagtctagagaagacccgacacactgcgctcactgcccctacacacatgcatgcacgcaggcacgcgcacacacacgcacgcacacgcacaaacacacaaacacacatttccctcctatgtcttcctctgataccagacgtgggccagctgtgattctgccttcatatatgttgcaatgaacagagaaccttgggttaccacaaggggatggaggtttattttaaagacactagaggctgtaaggaaacacagcagcacagccaggccctctagagacctggagcagtggcttctggggactcccagagcagccgtggtggtcaggctgtctggttgggctgctctccactttagctatgacttgacttctctttgactcttcctcaatctgcttctctttctattcccacttctcttnatgctgcctttgcttcta

SEQ ID NO: 533241 - DNA, 185 bp, Homo sapiens
cccctcgcttgtcctgcctctggtctgcctgcctcaggcctcccaaatgctgctgggattacatttgtgatgccatctggcctgtcctctagtatcttcttaactttaacgttgtctcacttataaagtagttcccagttctatctttacctaggaacctcgtgcttcaatacaaattgctttat

SEQ ID NO: 533242 - DNA, 107 bp, Homo sapiens
acctgatcaatgacagagccttctgaggacatcccaagacagtatacagtcctgtggtctccttggtaaatccgtctagttaacatttcaaggcaataccgctgttg

SEQ ID NO: 533243 - DNA, 304 bp, Homo sapiens
gggtaaaattttttttttgttgaaacggattttttatgttgcccaggctggtttcaggctcctgggctcaaaaggtcctcctgcctcagcttccaaaggcacaggccaagttgtagctttgtcccctgccctcatgccccccaaaaggttttaaaccctttaaagaattgactttcataaattggttatgttggggggccagttttttaaactggaaattgtaaattccccctgaaaagttttttcatcccgttcccctgaactaaaactccaaaaaaggatggttttgggggtccatttttta

SEQ ID NO: 533244 - DNA, 393 bp, Homo sapiens
gtggaatcatgccgccttccagcgccgccagcatcacgcggggaagttgataaagctcatgccggtacagcgatccccatttgccaccgacggcggtttctatacaaccaatcgctgcgtagtcataagcgtcctgcggttcaataccgagtttaataaattccgggatcacgatttcgtcgttgttgaacgccggcatcccgaagccgcaacggatcacctgtacgcaggcgtcgaggaaatcgttgctcattcctgcatggtaacgcacgctgaggttaggctgagtggaacgcaggcgaccgcaggattcgaggatcgcgtaagagagtggattcaccgcgtccattggttgaccatcaaccagattttgcccgccaatagtgacgttct

SEQ ID NO: 533245 - DNA, 359 bp, Homo sapiens
gactattcactagttctttccatgcctgtggacccccaatcctgggatgccacagaagagcccacaaaaatataggccagtggccgggcgcagtggctcactcctgtagtcccagccctttgggaggccgaggcgggcggatcccaggtcaggaaatcgagaccgtcctggctaacatggagaaaccctgtttttcctaaaaatacaaaattagccgggcgtggtggtgcatgcccgtaatcccagctactcgggaggctgaggcaggagaatcgcttgaacccgggaggcggaggttgtggtgagccgagattgctccattgcactccagcctgggcaacgagcgaaactccatttca

SEQ ID NO: 533246 - DNA, 1227 bp, Homo sapiens
ccgcccgcccgcctgcgctcgcaaccagccgcgaagcggcgccggggccaccagatcgagatgcgtcccacagtgtcctacacagatatgagagagcggcggatcgagaagcggttgttcgtctccaccagattgaggccgagatggatcgagaaagatattcatgtgtatttttttcgagaactcgatattgtgttgtgttgtgatgtagacatgtagcgcttcattttgtataacctaaaatctaaaaagtggccgcgcatgatttgacgcgatcgagcggccggctgggaaccacacgatctctcaaacacaaacaaaggataataaaacaaaacggggcgctggccgctctcaaaagttatctccctcacgaagggccccccgactgaattacacgcgatcccccaccgttactcctgtgatccccacggggcccccataatcggcgcacccgctactatctacggccgtctatgcacgcgcggcccatcatcgctttacaacaagcaggttgctgtcagcaccgtccgggcgggacacaacccctgtcggccaacacaccttcgggagcaccctctctcggtgtccaacgggcaccctctagctcctcgcgtgctctgttaccacacatatgtggcgcaactctcattccccctcaggcggacttttcacacgcccctcacgaggccaactgtcacgacatgctttaacaagacgcgctaacacccgcgtttataaaaccaccttcccaagaccaatgatacccgccccgacgcgtagcaaaacattgccccccaccaccacctatctaccctctccaaaactcctttttctacaccccgcaaccactcttacaatcacatgcccccaacatacactcctccacatcaccaccaccaccatcacaccacagccccgaaacacaaaacacaacaccaccctccacccacctacacacccctatcatagccactacctcacaccatcctctctcatctagcactccgtatccaacacaaccatctcaacacccccctaccaacagaccacccacccccccacacacacaatcatcacaagacacaccacataaaacaaacaacaaaccacccaaccagaccaactcactaccctcaacataactcacccacccatcattcgccctgcctcatcacaacaccgaatcacgaaccctctgccataccacccaccccccttccacta

SEQ ID NO: 533247 - DNA, 144 bp, Homo sapiens
gcaaggttcaatggttgcatcattgctcagtggtggcgcttcccacattcagtgtgcatgagtcaggtgtgctgcagtcacatgttcagcggttcaggctgtcacgtgcccagtgtgctcatatgcgtctgcacatgcagtcag

SEQ ID NO: 533248 - DNA, 168 bp, Homo sapiens
  misc_feature (38)..(38): n is a, c, g, or t
  misc_feature (72)..(72): n is a, c, g, or t
  misc_feature (109)..(109): n is a, c, g, or t
  misc_feature (134)..(134): n is a, c, g, or t
gctgacttcagagtggacttgtgttttttctttttaangaggtaaggttgggctggtgctcacagctgtaancccagcactttgagattggctgggagttcaagaccancctggccaacatgtcaaaactactnaaaataaagaaatcagccatgcttggtgctgcac

SEQ ID NO: 533249 - DNA, 143 bp, Homo sapiens
cagtgagacgaaagagattatatgaggaaatgtggagtccagcttcatttgtgtgctgtctcaaacattttagctcagagtctgaaatacttttggtcaaattaggcactgacttttacattgtcttatattatcacaatttc

SEQ ID NO: 533250 - DNA, 516 bp, Homo sapiens
gtatttatttatttactttatttttgagacagagtttccctcttgtgcccaggctggagtgcaatggtgcaatctcggctcactgcaacctccgcctcccgggttcaagtgattctcctgccacagcctcccaagtagctgggattacaggcgcccaccaccaagcctggctaattttttgtatttagtagagactgggtttcactatgttggtcaggctggtcttgaactcctgacctcaggtgatccacctgccttggcctcccaaagtgggattacaggcgtgagccaccgagcccagcctgaggtatttaattttttttttttggagatggagtttggctctggttgcccaggctggagtgcagtgtcatgatctcagttcacttcaatggtccacctccggggttcaagcgattctcctgcctcagcctcctgagtagtggggattacaggcgtgcaccaccagcctgataattatttacttaatttaattttagtagagatggggttcac

SEQ ID NO: 533251 - DNA, 495 bp, Homo sapiens
cccagccaaacccttttttaatggcatccagggaggggcccaggtttggaggggaggggttgaggaacaaaaggcaattattttgggggggaattcaccacttttccaaaaaaaaggggaaactcggttttttgttcaatcattaaaaaaacaaagggtttgttgaacttaacctcgggggggaaaaacatgggtatggccttaaaaaacatggccccagaagcttaaggcccttttttgtggaggggcaagacaaccttatgcacggccttggaaagcttaagggtgcctcctttgggaccccggaagaggcagccccattgctgaaacccttattgatgccccatggacccaagaccctttttaaaaaaaaagttcccaaaagagcagtttgggtaaatgaaactggcaaaccttttgttttatttttcaagaaactggggaaaatattggggtgaagtaaatttccaagggcgtagtttccccaaaaaaggg

SEQ ID NO: 533252 - DNA, 369 bp, Homo sapiens
  misc_feature (56)..(56): n is a, c, g, or t
tatgggcctcttttgaattccatgtctacctcttgagccaatcactgttgccaggnctggctagtcctggaccacatccccacagacagaggtggggttacctgttgtcactgacagcccatccaaactgcatataatgggttagaagcatttccccaaagagagaaatccagacaaaaaccacatctgcccaggacaccactgaaatctggaacaagagggctgagagaacccagaggattcctggaactgcttggtccaggtggcagcgtgagaaattggccctgaccttgtttttctgcattctatggatgtagtacattgaaattccagagatatatgcacaattcagtatctaatgtttgtaaa

SEQ ID NO: 533253 - DNA, 425 bp, Homo sapiens
gtgttattcagaagacaaggtccctgacccctctggtttctgcttgctggtgaggttccagctgttattgcgctctgaggccctctcctgatccaaatcttttttttgtttgtttgtttgagatggagtctcactctgtctcccaggctggagtgcagtggtgtgatcttggctcactgcaacctccacctccctgatacaagcgactctcctgcctcagcctcccgagtagctgggattgcaggacatgcaccatcagacctggctaatttttttagttttaattaagacagggttttgccatgttgagcacgctggtcttgaactcctgagctcaagtgggactacgggtgtgagccactgcacctagacaaaagtcttctttttaaataccatgtcttttatctcacactgcctggctaacc

SEQ ID NO: 533254 - DNA, 189 bp, Homo sapiens
ctagtattagaagtttcaatagcactagttagactctttaaaatactccaagggttagggcagcagagtggagcgactttagaaagaacattttaaaacaatcagttaatttaccatgtcacattgctgtaaatgataatgtgtacagattttctgttcaaatatgctattgaaacttctaaaactagg

SEQ ID NO: 533255 - DNA, 987 bp, Homo sapiens
attgaaaggaagccaggtggtcccagtgtgacagaagtggcggttgctgacgcctggaaattcccctgaaggtggagcaccagcccaacccccctgggtcccacctccctcaggcctcctccacctccagctccaccccggcgtggccctggccgctcactcctcctggggtctcctaccgtggcgctgccactcgcacctctccaagtggctgtactacacgcaccgactcacgcccgtgccccgccctagagcgtcactccaactgcgcgcgcactcgcacgcggcctgcatcggctgtcaccctgcgcctgactcctccccactcgcacctgtcccccaaccaaccacgagcctgaccccacaccccagcagccaacgggcacccagacgcgactgctacgacagccagcccactgctcccgcacatgccccctccctccaacaccaaccgcacacgacaccccgcccaggcctacctctccaccacactgatcaccccacggacacacccgccccgctgccacaccactccgccccaccccctcccgcctgcacaccccccccgcaacacaacgcggcccagcctccacagcccccgcacagcacgcggcccaacacgcaaccaccccactcacgaaacaactccaagaccactcatacctccacagcagcaccagcgcgaccacgcacacggccccgaagcgacaccctggcactttaccaaaccaacaaagttcgacacagccgacaccgccgccatagcaccgcgagcgcacctcggcgccaccccttagccccacccgtgactcagaccttcccgcttgccccccaccaggcccacacacctgcgaaggcactcgccctcgaccacgcacctccacacagcccctagcacggaggacatcgacagcgaggcgccggcaactaatggaccgacaggacccaacgaacaggcaacagaagtcaactagcaggatgcacgca

SEQ ID NO: 533256 - DNA, 254 bp, Homo sapiens
agaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggga

SEQ ID NO: 533257 - DNA, 389 bp, Homo sapiens
  misc_feature (6)..(6): n is a, c, g, or t
  misc_feature (9)..(9): n is a, c, g, or t
  misc_feature (362)..(362): n is a, c, g, or t
  misc_feature (382)..(382): n is a, c, g, or t
cgtgcnccngagcctggcccccatctctacttttaaaaataaagaaaaaagaaaaataaactgaagccaggcacggtggctcatgcttgtaatcccagcaatttgggatgccgaggtgggcagatcatgaggtcaggagttccagaccagcctggccaacacagtgaaaccccgtctctactaaaaatacaaaaattagctgggcatggtggcagacacctgtaatcccagctacttgggaggctgaggcaggagaatcactttgaacccgggaggcggaggttgcagttgggcttgagatcacaccacttgcacttccagcctgggacgattagagcttaggattttgttttcccacaaanttaaaaaattttttaaaaantttaaat

SEQ ID NO: 533258 - DNA, 698 bp, Homo sapiens
  misc_feature (252)..(252): n is a, c, g, or t
tccaagaagcgatctttaattttctggaaagtcctaaaatggttccatttttcaaaagatgatggatgccccagttcaaaaaccatattcttttcctctttcagcaatatccgggagccccaagagggtctggcagcctggatgtggaatgtgggtggactatcaagaacctggccctaccacacccaacaagtctgggatcctgggcgagcctctctggacagggctcgggtgggatggtcgcctgacctncttctctggggacacgatgtcctgtaccatggtgggcgggtactgtgatggcgtgtacgcaaggggctgggctcgtggttggcgtcgtttgggatggtcacaaacctggtcttatagaagattcacacctttttccaccaagggtcctccttccaattggtctcggagcctaacgctcataagaatctcattttctctggcggtaattctcagagggcgcaacctaagaattgaaattatcatgtgactcacagccggaatatttggcataagaggcgtgaaatttcatcctttcgtgaatttacaggggtgggaatccccagaaccgtgtttcagggaaggcgcctcgtccatcacaaccagaaagaagcgggatactcagggagtgctcgaacaaagggactcagtgggctaccctttctaattccctagggccaaaagcccag

SEQ ID NO: 533259 - DNA, 192 bp, Homo sapiens
cccacctgctacgagacacgtcaggcagtggcttgttgtcgaaggtctggccgtttccctgaggccggaaatgtgatgctgtcagcgcgtggcgatgctggcggctgggggtgcggggcttggccgtggctctgctttcggctgtgagtgccagtgacctgtagctgacccccccagctatccgtggtctca

SEQ ID NO: 533260 - DNA, 328 bp, Homo sapiens
tgaaagcacaccccagttagctcgccgtcaggcaccacttcctcgacctgccaaccgctgggccaatggacttccggctcggcggccagcacaaacgggctgcccaacaacacgcacacagcactcaacagtggcctacgaaactcgatcattgcaaaaacacccaaggttccagccgcaaagtgtgcggcccggcacgcgctgactgcaagggttgggcgcgctttttcatttggcgcagccggtgcggcttgcgtatcatggcccgcctgcatggacgcaggccgcaagccaatggaccgctcatctcacattttttctggagggc

SEQ ID NO: 533261 - DNA, 615 bp, Homo sapiens
gtaatattcccccccccgagttttttgaaataactgctcctctctccccccttactgcaccccagggcccgcggtaacccctgttctattgcacccgttgtcccccccgcccccctccttgaaaacaatgtttagaaatatttcttcccacacctccccattggcaattttgcgattaaaaatccttttcttatccacccacaccaacatttatgggctagaaaacttctgtgtaagtaaatccccgggcctcattttggtgcggctatatgtgatatttctggtagaaaaatattgcctgaccactaaacacctgggggcagagcatccggggtgacaacaaaataaccgctctttttgcgataaaagcggcccgcaaaaaaattggaacaccacgcgggtgcaaaagctgatttattatttttcctcacttctttttctttcccgaaggtgagggagtcacactgtttacgattgattatgtagtggtggtttctgtccccgaggcgagaccacagagatcatttttgtttggtgatggttcacacaagcgaggagtcagtttatgtcttgtataaagaaaaaaaaatatttaaacccccacaatagacaaga

SEQ ID NO: 533262 - DNA, 596 bp, Homo sapiens
  misc_feature (24)..(24): n is a, c, g, or t
  misc_feature (27)..(27): n is a, c, g, or t
  misc_feature (111)..(111): n is a, c, g, or t
  misc_feature (214)..(214): n is a, c, g, or t
  misc_feature (232)..(233): n is a, c, g, or t
  misc_feature (334)..(334): n is a, c, g, or t
  misc_feature (347)..(347): n is a, c, g, or t
  misc_feature (362)..(362): n is a, c, g, or t
  misc_feature (366)..(366): n is a, c, g, or t
  misc_feature (381)..(381): n is a, c, g, or t
  misc_feature (459)..(459): n is a, c, g, or t
  misc_feature (476)..(476): n is a, c, g, or t
  misc_feature (479)..(480): n is a, c, g, or t
  misc_feature (493)..(494): n is a, c, g, or t
  misc_feature (521)..(521): n is a, c, g, or t
  misc_feature (523)..(524): n is a, c, g, or t
  misc_feature (534)..(534): n is a, c, g, or t
  misc_feature (548)..(548): n is a, c, g, or t
  misc_feature (552)..(554): n is a, c, g, or t
  misc_feature (557)..(557): n is a, c, g, or t
  misc_feature (567)..(567): n is a, c, g, or t
  misc_feature (572)..(572): n is a, c, g, or t
  misc_feature (581)..(581): n is a, c, g, or t
  misc_feature (591)..(591): n is a, c, g, or t
  misc_feature (596)..(596): n is a, c, g, or t
ttttttttttttggaaaaaccacngcngtcactttattcttaagttggcactttacaaaaccacaagggagaagtccttgaaggggagacaggggtaggggattagggagngggggatggtaaagaggggaagaggaagacccagaaacgaagtcccctccaaccccatctcggggaccaagcagagactaggcctcaggctagcccagcgggnctccgggtgtccgggtgnntacagagctaggccaaaagacctcaggggaagggccagtggccctctagaagacgtgccgccattggagggacagccacgaggccaagtgttcccgtggtncccaaagaagganggtgggcctcccttncccntcccctaggccagantaactcagccgtgaggcaggggtgagggctacccattccagcagctctcaggatgctctcacgctccttcagagtctnccaggccgtggtccttntcnntcctggggggganntccgctctcttcgtgccgggcagccangnntcttgcgaanggcgtccatgaccncgtnnntcngccatgcgcncccgntgcctcagntcctgccggntcacn

SEQ ID NO: 533263 - DNA, 533 bp, Homo sapiens
gttgtatgagtggcatgtgacctgtgtcttttccttcactaagggaggagacacccctcatatgtcttatgcccaatttctgcctccaaagaaagaagtagtaaaaactaaaaggcagaaatgaaatccacaagcagacagcccggcgccacaccccgggcctgatagttaaagatcgacccctgacctaatcggttatgttatctatagattatagacattgcatagaaaagcactgtgaaaatccctgtcctgttctattccattctaattaccggtgcatgcagcccccagtcacgtaccccctgcttgctcaatcaatcacaaccctctcatgcggaccccttcggggtcgtgagcccttaaaagggacaggaatcgctcactcggcgcagctcggccgtaggaggcatgacgtctgctgaagctcccagccgaacgaagcccttccctcttcaactcggcgcctgaggggtcccgtctgcggctcgccccgctacatcacaactgaacacacggtccagcgcgttgaa

SEQ ID NO: 533264 - DNA, 413 bp, Homo sapiens
gaggaagaaaaccacacttactaatgttttctgtatctaatcaaatactcgtcatatataattaagcctcatgttaacctttttttaaatcaaccttttggacctcaactacagtcctaaagtcctggaggtaaccaaagtggaattaaccttttggctccacggattttatagttagtggaaaatgcctttaccaaatgtatttaaaatagccgtcatctcatttgtgaattttgtcgcgtattgtgatatagtgaaccctattgtccctatgaaatggtagctctgtgaaatacattcaccaaaaatcacaatttgaacatctttatgattccttaccagctgaagccagatagacaggtattaattgagctgatgccccacttgagtttatagactgtttgataactgcc

SEQ ID NO: 533265 - DNA, 247 bp, Homo sapiens
tgggctctttttttcttattagaagagcagaaacttcataaatatagctgtgcttagataccagataacaaatattgtgtccctgaagatatgacctactagaactactcacatatatagtccaataattactgagcttaataaggtactggtacaaatagcttgatacgattatgagcagggtacccgagcgtcgagatttcgtgaatcatgtgtcactatgctgttttccctgtgttgaaaattt

SEQ ID NO: 533266 - DNA, 406 bp, Homo sapiens
agggccgaaatccggtaaaggctgggggtcatgtttgcctcacgaggggtggtacaaggcggagggacgtactgtatgccctattcctcaccatcttcactctcccactgagtatcacctcacaatataggtgcccttcgcactgtgcttagcctgtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttt

SEQ ID NO: 533267 - DNA, 110 bp, Homo sapiens
agtactctcctaatggctcttagatttccccggtcatgacttggaggacgcacttgcggcctcaacttcacgatctgccgagaaagctatggagtgattgaacagaagaa

SEQ ID NO: 533268 - DNA, 254 bp, Homo sapiens
tgctaggctggagtgtattggtgcaatctagctcactgcagcttctgcctgctcccgggttcaagctattgtctgcctcagcctccagtagctgggattccaggtgcatgccaccacgcccagctaattttgtatttttagtagagacggggttttaccactgttggccaggctggtctttaactcttgacctccaataatccacccacttcagcctcccaaagtcctgggattatcggcatgagccagtatgc

SEQ ID NO: 533269 - DNA, 301 bp, Homo sapiens
  misc_feature (106)..(107): n is a, c, g, or t
  misc_feature (137)..(137): n is a, c, g, or t
  misc_feature (147)..(148): n is a, c, g, or t
  misc_feature (153)..(153): n is a, c, g, or t
gatctggagagcttttggatcctgggtgatgtcttcaatccgccagtactttacctgtcttcgggaggggcaaacgaacctaggtcggcctgccccccgtgccttnngcctaagtctcttcagccacctcccaggangatctggccnntgtcngtgcccactttagatgtatctaattctcctgactgttcttcccaggggagtgtggaggtcttggccctgttccctgtcctaccaataacgtagaataaaaacataacccactgacaacggccgtcactgacaacggcttgggtaccgg

SEQ ID NO: 533270 - DNA, 430 bp, Homo sapiens
  misc_feature (106)..(107): n is a, c, g, or t
  misc_feature (137)..(137): n is a, c, g, or t
  misc_feature (147)..(148): n is a, c, g, or t
  misc_feature (153)..(153): n is a, c, g, or t
gatctggagagcttttggatcctgggtgatgtcttcaatccgccagtactttacctgtcttcgggaggggcaaacgaacctaggtcggcctgccccccgtgccttnngcctaagtctcttcagccacctcccaggangatctggccnntgtcngtgcccactttagatgtatctaattctcctgactgttcttcccaggggagtgtggaggtcttggccctgttccctgtcctaccaataacgtagaataaaaacataacccactgacaacggccgtccgtagtcacgtgcccactttagatgtctctaattctcctgactgttcttcccaggggagtgtggagttcttggcccgtgtccctgtcctaccaatcacgtagaataaaaacataacccactgacaacgggggtacccgagctcgaaattcgt

SEQ ID NO: 533271 - DNA, 173 bp, Homo sapiens
ataggctgctgctctcgctgacataaagagccttgcgttgcactgaaaaaaaaaaaaaaaaatcccaaaaagttttggtcctctagggttgccccccgaagccttggcattaaaacagcccagcgcccatttcggctaggaaaattttccttggctcttaggcacttcaggct

SEQ ID NO: 533272 - DNA, 160 bp, Homo sapiens
cagagaaagctttgttgagatataatttacccatttaaagtatataattcaatggtttttaatatattcacagatttgtacaattatcaccacattcaattgtagaacattttcgtcaccccaacaagaaacctcgtaccacaccttagcaatcaccact

SEQ ID NO: 533273 - DNA, 416 bp, Homo sapiens
cagagcaatctgtcatcattgcccagcatcagagaagcaaggagtatggagcaataagacaaacaacatgaccatggagatcaggaatggagtcaggtcagttgaacatgagcatacccataaaacaatgtacaaatgtccccatcaccaacacactcacatgaaatggctcccgagccctgagatctgtatcccaagaacctcagttgagaacatatttctggacagattcactgttgctcaagagcctgggtattgtaagcagcctgagggcaggtagtccctaatagtactccaagattcttcaaatcaagccagaatcccatctatgcttgtctccagcaaatggaggtggcccctctgctgacgtgccctctcttccagctctgacatcatgggccgcagttgcctgcaaa

SEQ ID NO: 533274 - DNA, 324 bp, Homo sapiens
ttcagatacatggtttgcaaatattttctcccattctgtgggttgtgttttcactttattgataatgtccttagacatataataaatttgtattttaaaagtgagccaccgcgcccggccaaattgccctgttcttctaaggacagcagccattggatttagggcccaccctaatccagtatgacttcatcttgatagatcaacaaatactctatttccaaataaggtcatattcataggatctgactagatgtgcatttgaggggggacgtaattcagcccatacaccaggctgccttctcttattcccagtcaccccttccg

SEQ ID NO: 533275 - DNA, 938 bp, Homo sapiens
aacaaaacttgaagcataaaaggttaatgttaggctatagagtttccttgtctccctacgtttcccttatcttatgtgccaaatgaaaatgagaggttcttaatacttttgtgccatggaccccttttccaatctggcgaagttcgtggaattcagtctcagaattaaaaaaaaaaaaattaagcaatgtgaacctcaaaagtcttagatttttttttttttgtggaaagggagtctcgcctctgtggtgtgcccgaggcttttcagtgtgccagggggtgactctcccgactctccatgggaaacctctccaaccttccggggtttcaaagggaattcctcctggccctcgagcccggggaagtttcgcggggatttaaccgggcgccaaacaacaaggcccagatagtttgggaattttcaagaacaagtgggggatttccccaggtttgggccaggagggtctggaatccttaaacctcaaggtgatccacccgtctgggtctcccaaaggggcggggatcacgggtgtggacgccacggggccggacaaaatggttatttcttcgccccaaaacaacatgttcaacggattggacacgggaataacctcaatctagaaaatattcggccaacaaatatttctaaatctctaaaatggtaatcactgaattggacaatagtacgggagcgggatactttcaaacggacattcatctggggtcggactaggtgcacatttcctacattttatttgtgggcacaggttaacaaattaagggtggggcgtgctctaaaaggaataaccttcgctgttcgaaaaaatgcttttgccaaaagataatccattggtattaagggggaaccacacgagaccaaggctgtaaaatttggcacaaactagtatcgtgagaaaaacgcttgtatacctgtaagag

SEQ ID NO: 533276 - DNA, 536 bp, Homo sapiens
  misc_feature (23)..(23): n is a, c, g, or t
  misc_feature (51)..(51): n is a, c, g, or t
  misc_feature (152)..(152): n is a, c, g, or t
  misc_feature (157)..(157): n is a, c, g, or t
  misc_feature (162)..(162): n is a, c, g, or t
  misc_feature (179)..(179): n is a, c, g, or t
  misc_feature (204)..(204): n is a, c, g, or t
  misc_feature (269)..(269): n is a, c, g, or t
  misc_feature (325)..(325): n is a, c, g, or t
  misc_feature (328)..(328): n is a, c, g, or t
  misc_feature (345)..(345): n is a, c, g, or t
  misc_feature (362)..(362): n is a, c, g, or t
  misc_feature (382)..(382): n is a, c, g, or t
  misc_feature (386)..(386): n is a, c, g, or t
  misc_feature (389)..(389): n is a, c, g, or t
  misc_feature (402)..(403): n is a, c, g, or t
  misc_feature (416)..(416): n is a, c, g, or t
  misc_feature (423)..(423): n is a, c, g, or t
  misc_feature (425)..(425): n is a, c, g, or t
  misc_feature (429)..(430): n is a, c, g, or t
  misc_feature (437)..(437): n is a, c, g, or t
  misc_feature (441)..(441): n is a, c, g, or t
  misc_feature (456)..(456): n is a, c, g, or t
  misc_feature (468)..(468): n is a, c, g, or t
  misc_feature (474)..(474): n is a, c, g, or t
  misc_feature (521)..(521): n is a, c, g, or t
agctctgacactgcggtactganccacaaccccctaatttgttccccccancccccaggccttgtacagctccatcaagaatgagaagctgcagtgggccatgtcatcaagcggatcagcgggggcatttgcagtggctccagccctttccnggacntgacncccttagcctggtggcngccgtctacaagcacggggccctgnttcgaaaggtgcacgcagaccctgactgcaggaagacacctcggggcaatcggggctggaagagnttccacgggatcctcaagggcatgattctcttaccttcagaagtaggagtacaagnctnggaaggccctttcaganacggagctcaataattncatcagcattcatcatgccnttgnaanttgtgtaagggannaaagtaataggcnccacgtntnctanntgcgcanagcngaatggcgggtcttnctcttccatgcncctagnctggagcagatgcagtcctggtatcactcgcatcaatgtagtatccnctattttctctgcgc

SEQ ID NO: 533277 - DNA, 281 bp, Homo sapiens
  misc_feature (86)..(86): n is a, c, g, or t
  misc_feature (107)..(107): n is a, c, g, or t
  misc_feature (265)..(265): n is a, c, g, or t
atctttgcatccctgggacgatttccagttgagcatggtgaataatctttttgataggctgttggatttgagttgctagtattttnttggggcattttgcatctgtnttcatcagggatagtggccttcagctttcttttcgtgtgtgtgtgtccctgtcttgttctggtattggggtaatattggccttgtagaatgaatttagaagaattcctttccttttgatttttttggaataatttaagaagaattagtattagttctnctttaaatgtttggta

SEQ ID NO: 533278 - DNA, 791 bp, Homo sapiens
aaatcacaaagacagtgcaacactatacctattattcggcgcatgagctggagtcctagggcacagctctagagcctccttattcgagccgagctaggccagccaggcaaccttcataggtaacgaccacatctacaagagttatcgtcgacagcccatgcatttgtaataggatcttcattcatagtaatacccatcataatcggaggctttggcaactgacgtatttcccctaataatctggtgcccccgatatggcgtatccccgcataaacaacataagcttctgactctgacctccctctctcctactcctgctcgcatctgctatagtggaggcgcggcagcaggaacgaggttgaacagtcttaccctcccgtttagcagggaactactcccaacctgagagcctccgtagtacctaaccatcttctccttgacacctagcaggtgtactcctctgatcttaggggccatcaatgtcatcgacgaacaagttatcaatgataaaaagccccgtgccataacgcaatatccagaacgccgccgtcttcgtctgatccagtcctacatcacagcagtcctactctctgcctatctctcccgagtaccgtagccgtgctggcatctaggtatactactaacagaccgaaaccgtcaaaccaacttcttcgaccccgaccggaggaggagagcccattctatacaaggactattctgatttgcgggccaacctgaagttatttgcttatcctaccagggttcggatatttcccttttggtatactatc

SEQ ID NO: 533279 - DNA, 168 bp, Homo sapiens
acatcatccactttaagcctcatttttctggtctgtagaatgaagctagtaataaaatgggctagttctttagactggtgtgaggactaggtcatgccttgtgtgtggcacatagtgggcaccaggatacaatggcaggagtgctttggcactgcatgtggggggaaa

SEQ ID NO: 533280 - DNA, 215 bp, Homo sapiens
tgctgctcatcccaaagtagtctaccttagtttaactcaaaggtagcacttgttgaaactacatgagagaaacatggctgcagagggtggataaggggcatcatgtgcctcttgtcttgatcaatcagtgccacacacagaagccacattatcttgcaacataatctccattatagcgccgttagattccatcatagacgtcatccacttccatt

SEQ ID NO: 533281 - DNA, 733 bp, Homo sapiens
gtgagagataaaagaagaaagaggatcactacagtctgatcttcctagagtgggctttagtggtcagagaaagccaaagatgaagacagaatttaagaccatatagacacgacggggtaaacaagaagaatagggcctagaagtcaggagctaaggcacaaaagtagggcagtgcctgggataccctcagaccccatggatacttgctggtctgagggtatcccaggggtctttgtgtgtgtgtgtttgtgtatgtgtgtgtgtgtgtgtgtgtgtgtaattagctgcccagatatttacatatttcacctaaaagaaatacagatttctgacttcttgaaaataatccagagttctggaccacagctctacattctttgatgacatccatcaatgagctgagatagactgcctcctttagatgagtcatccattctccagtttgccacagtccattgtatcgttgtctctgctgtattatctttggcttgcttcccttattcaccttatcagtctagaatatagattccttggaaataaggccaaaagggtacacttcagaaagattaagattgtgtgctatcagtgctttttttcagagcttaacctttcctttgttcttttatcattctatctaaatttactgcctttcttctttgtaatttctgaccttttcttcttcagtcatctgacttcatttcacttacttacacatttcttcattagtctattc

SEQ ID NO: 533282 - DNA, 832 bp, Homo sapiens
  misc_feature (832)..(832): n is a, c, g, or t
tggctgtaacagggtaatggatgatgagtccagggctccgtggctgaagccctgtgtgtgtggggagggtgcacagagcgaaagggggcgtaagggaatgctgtgaagggctgtgctccgtgatgtcggtgtctggaggcttccaaactatgtgctgatgtgtgcatgggttgatgtgcctctgtggcacacatgccgtgcgcccagtccaccctgtgcccacgatgtgagtggctgtgcctgtgtgccccttgcacaaatgtgcacgtgtgccaatggtgtgtggctctccaacaactctcacgcgccacaactctcacgcataccttgtgagagactctcactgtgtgcccttgtctctcccaacaactctcctaacacacgcgtgccaacatttgaccttctcatggcgtgccaacatttacacatctctcaaagaagtgtgcgacggtgtgtgtgacacacaaagaatgctccgcgtgcgcaggcgccccttgcgaaacctcctctctccaaaacacacaccacgggacaaatgaccgcgcgacaaacgcccccacgaacacccacacccagacaagacacacagacacagcgccagtgaacacacagcacgccaccgacaaaagacaggggacagcgcgtgcggcatgtgcgcgccaccgcgccggccatcccaactcccccccgtccgctgcggcaagcgcacacagccctccactactctcccgtggggcgccaatcgcaagtccgcagcgccgcgggccccgctggcgcgtgacgccccacaaccccggctccccgcccccgacccaggcggcgcagtactgcn

SEQ ID NO: 533283 - DNA, 683 bp, Homo sapiens
  misc_feature (437)..(437): n is a, c, g, or t
  misc_feature (554)..(554): n is a, c, g, or t
tactagccatggcagtggcctgactcggccttcccctgtcgctctgggggctatgacctccgaagagtcggggctccttcaccctgcttcccacacccgggcctgaggggttccctgcgtgagcaggagattcaagacatacagggcgcccagaaactccccgtacgcccaagagccaagggctaacctgcgtcctgagagggcagcgggagttcagtaacaacacgagtgcgacccccttcttcatgacttatggaccacccgccttactccagcccccgggagagaggggagccgcctagaggggtccttcttcgggggaggattcagtccttcctccattgtgtgatcataagcagtccgggtttaaatcctagttaagcctttaagtaactatgtgaccctgggcaagtcgcagcctttctttgaatctcgtntcatgatctgtgaaatgggagaacaatagctaccgttctctgaacgttcgaagaatcagaagaggttagatgggggaaagctccggaggctcaaactgccacgcgggagcgggtttngtcctcttcccccaggattcaaagttcaaggctgaggccgcgccggctctcaggtgacggggaagggcctcttcccctcctgaccccacgagaaggcgccgaggtcttccgcccccgggccgggaagct

SEQ ID NO: 533284 - DNA, 331 bp, Homo sapiens
tgggacgaagctcatgcagaggggtccagatagatatgtgggagaggcttattgcctattgctatacttgtctgtctgttccttttactgctgtgacttacttaagcgctgagaccatctccattttcccatgctgttgatactctataattacatcatagtgggcaaaatgcactatagtgaattaaataaagcctcttggggccaaagcagaatatattttagactcctcttttcttccctgtaactgatatgggctaggagaagtattcatatattgtgtgtttgtgcacatcgctgctggctatcattgcacttgagagtgtaaggt

SEQ ID NO: 533285 - DNA, 321 bp, Homo sapiens
cccaagttgttggtgctttgggtttttataagttgtgaataggaagatgctcattgtcttcattctccatggttgtgcatggcaaatgtgtttgagatgtggatgtataatacatcgagtaatatagaattagctggcttttgaaatacgtgcattgttcgatgcttcaagaggtattatccttttttattagcacaaatttgctagctaattagagtttatctattatagaaaggacaccgtataggttcgtaaaaaatatttacaggacgcaaaatagatctattactactttaccgactttacccccttttccagggg
